United States Patent 7,560,542 (NUCLEIC ACID MOLECULE SEQ ID NO. 68811 AND OTHER MOLECULES ASSOCIATED WITH PLANTS) - sequence listing, part 2

SEQ ID NO: 6425 - DNA, 330 bp, Zea mays
  Clone ID: LIB148-044-Q1-E1-B9
tacaacaccctgacgtgagtcgtattacgtcagacttcgtcgccatctcaaatggacatgttctctgggctcaatctttcatatgtatgacgaggtcgcatcttcgtcaccagcactcggggcggatttgggtgacatggactctcatcgggaagaatcaccacgtccatttgacataggatttgcctccgacgttgatgccaacgacacgttaatagttctgccatcactgcaacatgcataactacatcaacgcattctcaaagttctactctgagacctctaacacaccaatcgatttctgtacattccacaatttcatatatacct

SEQ ID NO: 6426 - DNA, 383 bp, Zea mays
  Clone ID: LIB148-044-Q1-E1-C1
gcccgtcacggtgcacacgctggtgtccatcctggagaggtacctgcgggtgaaggccaagaagaacgtggtggagatgcccggcaatggcgacgtgccctacacgcacgcaaacatcagcctggcccgggagcagctcggctacaagcccacgacgagcctggagatggggttgaagaagttcgtcaggtggtacctctcctactacggatacaaccgtgggacgcataccttccggaactcatgatgtcgctcgtgccttccactctcgtctgggtccacacaagttgtgggggaaattgtgttgactggctgttgtagttgggttaggacagaagaggaggggacggcgacagaacgatcaaacggagggccggcttttt

SEQ ID NO: 6427 - DNA, 388 bp, Zea mays
  Clone ID: LIB148-044-Q1-E1-C10
caaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaa

SEQ ID NO: 6428 - DNA, 380 bp, Zea mays
  Clone ID: LIB148-044-Q1-E1-C11
cccacgcgtccgcggacgcgtgggcgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcac

SEQ ID NO: 6429 - DNA, 390 bp, Zea mays
  Clone ID: LIB148-044-Q1-E1-C12
cgatcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacg

SEQ ID NO: 6430 - DNA, 443 bp, Zea mays
  Clone ID: LIB148-044-Q1-E1-C2
gtcgatgcaccactctaaattgagtcgtataaaaccctcaaagccgaaggcctcgtgccttctcttcctccctggcatggaggaagtacctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagcc

SEQ ID NO: 6431 - DNA, 293 bp, Zea mays
  Clone ID: LIB148-044-Q1-E1-C3
ttcaaaaacgcttctcctgctggttactccgcgcgccttctctttctctcccggacttcaatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccataacgcccgcgacgacaagaagaccaccaccggccctggggctgggaacgcgcgcgcatgcattccgccggccttcaggaacgg

SEQ ID NO: 6432 - DNA, 381 bp, Zea mays
  Clone ID: LIB148-044-Q1-E1-B10
atccacctcgctcaagtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcg

SEQ ID NO: 6433 - DNA, 404 bp, Zea mays
  Clone ID: LIB148-043-Q1-E1-H7
agcccatcaacctgacggaccgcctccaccaggtgctgcgctgggcgaccgggtcggtggagatattcttctcgcggaacaacgcgttcctggcgtcgcggaggctcatgttcttgcagcgggtggcctacctcaatgtcggcatctaccccttcacctccatcttcctgctggtctactgcttcatcccggcgctgtccctcttctcgggcttcttcatcgtgcagacgctcaatgtcgccttcctctgctacttgctgactatcaccgtcaccctcatcgcgctcggcgtgctcgaggtcaagtggtccggcatcgagctcgaggactggtggcgcaacgagcagttctggctcatctcgggaacaagcgcgcacctgtacgcggtggtgcaaggtctgctc

SEQ ID NO: 6434 - DNA, 340 bp, Zea mays
  unsure at all n locations
  Clone ID: LIB148-043-Q1-E1-H8
accacgcgtccgctctcctctccacctcatccgtatctccctccctcttctcggcggccgtggcggcgccggaggactatgcgcggcctccaccgctgcccgcaccagctcctcctggtctctccaccgccgcggtccgcccccgcgtgccgccagtcggccaccgcctcatcgcggggcctcatgagctccctcgccgtcttctccgcacccggggctcgggtagcggcggcggcgcgcgagcagaagtggggccacgtggagggtgatgaagacggtggagaggacggcctacgggaggcgctccacangacgcgggagctcgtggagtgcgccatgt

SEQ ID NO: 6435 - DNA, 384 bp, Zea mays
  Clone ID: LIB148-043-Q1-E1-H9
atgaggtcaaacctgctgtcgacccagttcaaactccagccacaagtgcagattcaccaaaatccgagcctagtgccccaccactttctgagaccgaagaagtagacaacatggcaatcgatgaggtcagtggtgatgctgcagagggcgcggaagagcttgaccctgcgctcgaggagacgccgatggaggagacgatccgtgtgacgcgcgccaagctaaggaggcgcaccgccaccgaggattctgctgggaattagctgcatgccgttgttttccctgcacattgtattgatctttttccgagttttaggctcacatgttgtttgctggaatggagatatgttgttgttcacttggttcttgtgacacagagttaattaa

SEQ ID NO: 6436 - DNA, 303 bp, Zea mays
  Clone ID: LIB148-044-Q1-E1-A1
tgcacctctctaaattgggtcgtatttagatttgaaccgcctttgtaggcgtccggtggcgatcgacgattctgatactgctaggtcctattcagttggttccatctcgtcgtcagtcgtctgcccggtcacgtcgtggatcggacggaacaagtcggtgtgcagttgcatcatgaccgtataccttaacactttgacgctcggcacgttcatctgcaccgtgttagagatgcaggggatacggagcatctctgcaggatactagactagcaacgtctactcatgttacatagccagtttccc

SEQ ID NO: 6437 - DNA, 364 bp, Zea mays
  Clone ID: LIB148-044-Q1-E1-A10
tatacagagtcgtcttactgagggccacgacgcggcgggcgctggcgaggtacgatggaccgtgcatggcgaccaaccccatcgaccggtgctggcgctgccgcgccgactgggcgactgaccggaaccggctggcgcagtgcgcgcgcgggttcggtcacaggaccgtctgcggcgcggccggcaagctgtacgtcgtgagggacccgagcgacgacgagatgatcatcccgcggaagggcactctgcggcacgccgtgatccatgactggccgctgtggatcgtgtacgcgcgctatatggtgatcgagctgcggcatgagctgattctgaatcacaacacgacgatcgacgggccgggcgc

SEQ ID NO: 6438 - DNA, 398 bp, Zea mays
  Clone ID: LIB148-044-Q1-E1-A11
agcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagct

SEQ ID NO: 6439 - DNA, 389 bp, Zea mays
  Clone ID: LIB148-044-Q1-E1-A12
cattcgttctcctcatcttacattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgaccccc

SEQ ID NO: 6440 - DNA, 426 bp, Zea mays
  unsure at all n locations
  Clone ID: LIB148-044-Q1-E1-A2
cagggagcttcaccagggcacggtgttgcagggtcggacatcaatcgcgacgtccctagctccccgccggtgtcggggattgaacatgtgccgctgcgagcgaatcagttggccgctgtcaggaatcttcaaccgcttcaacgatttggtggtgctcggtggtcgggaagcttctctggctcacccctcacatgtgtgtggccttattggacaaagatagccttccgagctcgaccaattgctcatcggtgcaatggctccaccgcgggcgggaccactgctgcagacccatttcactcccttgccatcaccgcgtgaggtcacgagtcacctgaagatcatcctggtacctggaatctcaagtcncaggtcaagaacaggtaccacaggatgaggcgcatggaggatgctgcgatatgttcgtga

SEQ ID NO: 6441 - DNA, 426 bp, Zea mays
  Clone ID: LIB148-044-Q1-E1-A3
ccgggatccactcaaacgacgcatctgccaacgcgtccgcccacgcgtccgatcgccattacagaagaagccgagtggaccctcaccgacgctaatcaagaagggcggaggtgaaggaaggaagactccaaatggtaaaacaggaaccaagaagtaagcaatccagatgaaacttggttttgctgtgaccaacttcaccttggttagggacagataaacatgttgatactatcgggtgatacattgatatttgccacacgaatacgtcagtcctcttaagggaggaggtcgctagatcttcgggcatctgctgtaaatcactcgttgatttgttgtagtacgaacagaaaacggaccacaaaaaactcgaggatgggaggaagatcatcatcacaaggacgtttttgttagatgtatatgttgctt

SEQ ID NO: 6442 - DNA, 426 bp, Zea mays
  Clone ID: LIB148-044-Q1-E1-A4
aagcagcatcaagggttgcccttggcgttcgtgcatatagccatggtcttgttgttggtgccgctatactcgaacgccaatggcagcaccaagggttgcctcaaggagcttgcatgcttctagaccctccgtcgactgacccatctctctagttataatttttctctcgtccttgcattgcccattacatgctatccattggtaacgcacaacagtaaaacgacagacatccgacagctatactatgttcgacggtgtaacaccctgaatttgagggtataaaatttcttctctaaataccatccacattcacgtgttacctcttgtctctctctctctctcttttccttttgattaacagtaagtgaattatgcgacggtttaattatttattttgtcaaaacttatgtgactcatgatacgttg

SEQ ID NO: 6443 - DNA, 424 bp, Zea mays
  Clone ID: LIB148-044-Q1-E1-A5
actatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtcgttcaaggccaggttcccagccccggcctacgccgtcgaccccgccgggtcaacgccgccgcaggccgacttcgtgtggcggatcatcctgatgctgggcgcaatgcccgcggcgctcacctactactggcgcaccaagatgcccgagacggcgcg

SEQ ID NO: 6444 - DNA, 407 bp, Zea mays
  Clone ID: LIB148-044-Q1-E1-A6
ctcgaccatccctgcaaattaccgcgatggctcccaagatcctagtcagccttgtgttcctcgccgtggcctcaccggcggctctggccgccttcgatgtgatagagatgctgggcgacaagcccacgtactccacgttcctgaagctcctgcaggacaccaaggtcgcgggcgaggcgaatcagctccggtcggcgacgctactggtcgtccccgacaaacttgccaagcctctggcgtcgctgctcgccgataacgtgcggccggcggtggagaaccacgtccttctcagttacttcgaccccatcaagctggacgagatgaagacacgcaccgccatcctctccacgctgctctccgtcaccgacaagaaactcggcgtcctcaactacaccagggccgacgac

SEQ ID NO: 6445 - DNA, 419 bp, Zea mays
  Clone ID: LIB148-044-Q1-E1-A7
acgctcttgcagaaacgaggaaagaaaacatgtcttctcgctgggttagggcggaggtgtacccgctgttcgcgacgacaggggtggcggtggggatctgcgtgatgcagctggtgcgcaacatcaccaccaacccggaggtgcgggtgaccaaggagaagcgggccgccggggttctggacaaccacgacgaagggccgcgctactcccaacaacgggttccccaggtccgggtcctcaaaccgcggcaactacttccaggcaatggccaaggtgccaacggcccctattatgtagacgacgacgatataccccaatgcatggcaagaatatatatatatcagcacaacgcaactgcatgcgatgctgcttgttgctgcaattaatccactatactatatactatgggagtattattg

SEQ ID NO: 6446 - DNA, 215 bp, Zea mays
  Clone ID: LIB148-044-Q1-E1-A8
aagccgccactactaccagaggtgctacctccacggcaagatcgacttcatcttcggtagctgccagtcaaccttccactggacctacattatcgcaaggcctgatcggacgactgcgatacgccgctccatcaccgctcaagtacctcaggatgaggaaagcagcggattcgtcttctctcaagggcatcgtgtacggcagtccgggatgtgta

SEQ ID NO: 6447 - DNA, 383 bp, Zea mays
  Clone ID: LIB148-044-Q1-E1-A9
aggacgcgtgggccactgccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgacgactacctgtatggcgagtccctatacttactcatacataagctgcgccgccgtgtcgtcggtgcgtgcaccgcg

SEQ ID NO: 6448 - DNA, 425 bp, Zea mays
  Clone ID: LIB148-044-Q1-E1-B1
cagctcctcaatccatcaattgcaagaggagcaagataccaccaccgtagcaccacacgcaggtacgaagaacgcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattatacattggt

SEQ ID NO: 6449 - DNA, 336 bp, Zea mays
  Clone ID: LIB148-043-Q1-E1-H6
ctcctaatcactgccctaaacacatgtgtgccgggccgaggtcacaatcgatgcacggaggaggatgccgccgtagctgcggagattgataatataaagcgggcggagaccgccggcccctctggcctcgctgctcctccccccttcctccccccacatgcgctgcccccgcccggccctgccctgccctgctgcgcccaaccagctgaatctccgcacagacaattagagtagctgcattggcggggaaagcgcaagaagctcagcagaaatggcggagcaggcaggcgccggaaggtactggtgccacatgtgcgccgcggtcgtgagccccgc

SEQ ID NO: 6450 - DNA, 389 bp, Zea mays
  unsure at all n locations
  Clone ID: LIB148-043-Q1-E1-G1
ggaaaaggtatcagcgtcgccaatctccatggagctcacaggcgccgcgctccggcgatacgcgctgccgtcggcgtccccggtggccgcgagggtggggaggaggaggcgaccagccagggtggcctgcgtcgggggcggggggttcgcggaggaggggcacctcaggtactacgaggcggccccgcggaggaaggcggtggaggcggtggcgagggacctgggaaagctccgggccatggggctcgtcgcgggggacgcagccaaggagaaggtcctctcggaagccacggatcttctgctgcangagctgagccagatgaaggatgcggaatacaagataaacaagatggagaaagaacagaatgctgctatgaaagcactgaaga

SEQ ID NO: 6451 - DNA, 434 bp, Zea mays
  Clone ID: LIB148-043-Q1-E1-G10
ggtccacgcacgcgtccgactcgcagtacgagggcatcgacttctacaccaccatcacccgcgcccggttcgaggagctgaacatggacctcttccgcaagtgcatggagcccgtggagaaatgcctccgcgatgccaagatggacaagagcaccgtgcacgacgtggtgctcgtgggcggctccacgcgcatccccaaggtgcagcagctgctccaggacttcttcaacggcaaggagctctgcaagagcatcaaccctgacgaggccgtggcgtacggtgctgctgtccaggccgccatcctgagcggcgagggcaacgagaaggtgcaggacctgctccttctggacgtcaccccgctgtccctgggcctggagactgccggcggcgtgatgaccgtgctgattcctcgcaacaacaacattacaacgaag

SEQ ID NO: 6452 - DNA, 206 bp, Zea mays
  Clone ID: LIB148-043-Q1-E1-G11
gggtccacgcacgcgtccgaattcattttcaccgggaagatttgtaactgtcctcctccctccttgtaagttgctcctgtaaactcttcctgaattcatggcgtgtcgttgtagcaatcaccacttcctccctgtgaatgcccacagcgtgtcttggtaaaagcatgtatgtatgaatattggagtatatgttactactcagctcc

SEQ ID NO: 6453 - DNA, 203 bp, Zea mays
  Clone ID: LIB148-043-Q1-E1-G2
tgagacgtattatctcgaatctccacttaactcatacgcacctctctccggccatcctcgctgccgtctccatctccttcggccactaggctacgaaccccttcgggaccagggaccgtatgccgtatctctggcacgtcttctcgccgcctcgggcacctctcgtaatatcaatctccctgcacctggaacgccgctccagc

SEQ ID NO: 6454 - DNA, 272 bp, Zea mays
  Clone ID: LIB148-043-Q1-E1-G4
tgagacgtattatctccagtctcgatggaactcagatgcgccgcgctccggccatacgcgctgccgtcggcgtcaccggtggccgccagggtcgcgagcaggagggggccaggcactgtgacctgcgtctcgagcggggggttccccgaagacgggcacctcatgtactacgaggcggccccccggttgaacgcagtggtggccgttgctacggaccttggaaagctccaggccatggggctcgtcccgcgggacccagtcaaggagaacgt

SEQ ID NO: 6455 - DNA, 386 bp, Zea mays
  Clone ID: LIB148-043-Q1-E1-G5
cggaccggcagcgcctggcccgttgcgccagaggcttcgggcacgcgaccaccggcggccttggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcccccacgcacatcggctcccgc

SEQ ID NO: 6456 - DNA, 388 bp, Zea mays
  Clone ID: LIB148-043-Q1-E1-G6
ggctgcggcggcggcctcaacgtgctcctggagcaggtctcgcaccggccgcccgtgacagcgctgcacgccacggacgcccgcggggaggtgcggctggtgtggtgccagagccccgcgccgcggttccacggcgccagcgtggaggccgcggtgcgcggcgcgcgggagctccgcctgctccggcacgccgagacgtacgttatcgggtgccccggcctgctgatccgcctcttcccgtcgcccgcctgcgaattgtccggggacgttcgcctcctctgcgccgaatccgggctccaaggccaactcaactactggcggacccggcggttcttcctccgcttccgcggctgcgacgcccgctgcgtcaggggcaggatcttccgct

SEQ ID NO: 6457 - DNA, 377 bp, Zea mays
  Clone ID: LIB148-043-Q1-E1-G7
accacgcgtccggaagaagtaacacttctccgtgaggcctgagcccctcgccgcggtgagccaagccggcgcacgtcgccccggggctcacgctcaccaccgagccgcaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcatcgctaaccaggagtactgggcggagcgcgcggatgcggcgcacgcgtacaaccgcgcggcgttacagaccgacccgtggccgtcgtgc

SEQ ID NO: 6458 - DNA, 388 bp, Zea mays
  Clone ID: LIB148-043-Q1-E1-G8
cccacgcgtccgcagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgc

SEQ ID NO: 6459 - DNA, 416 bp, Zea mays
  Clone ID: LIB148-043-Q1-E1-G9
gtcgatacacgaatctaaattgcctcgtatcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcatgcggacagggaccg

SEQ ID NO: 6460 - DNA, 357 bp, Zea mays
  Clone ID: LIB148-043-Q1-E1-H1
cccacgcgtccgcgaggaaataacatgccgcggcacacgtcgccgttcctttttgccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgccaacggcttcaccctggtcgggctcagaaccatcgac

SEQ ID NO: 6461 - DNA, 237 bp, Zea mays
  Clone ID: LIB148-043-Q1-E1-H10
atcgacattcggcgcccgttcaggatccacatcttcccgagcgagttcttggttgacctcttcccccttcggaccacctccaaggctcttggtgtagcttggcactctcagcaatcaagttttcatgtctgatctcgacattcagatcccaactgccgtcgatcccttcgctgaggccaatgctggggactctggtgtcgcatcagggtcaaacgactacgttcaggtgagcatcca

SEQ ID NO: 6462 - DNA, 376 bp, Zea mays
  Clone ID: LIB148-043-Q1-E1-H11
gggtccagcacgcgtccgaaagatagcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccat

SEQ ID NO: 6463 - DNA, 404 bp, Zea mays
  Clone ID: LIB148-043-Q1-E1-H12
cgtcgtcgtgggccttcatttctcctagaaggtacaaggtcgagaggagaagaaggcgagacgtgcagtccgtcgggcaccgatcgagaacagggaagcaagaggctgctagagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaagtggacgacaaggcggtgaagctgggaactgtggccatggacatcgccagcgcgatggccaccacgactgatgagaagacggcgttcagggaacctgaacccgagaccggatactacggtccggtcaccggcacgaatgaggtggacgccgccgacctgc

SEQ ID NO: 6464 - DNA, 225 bp, Zea mays
  unsure at all n locations
  Clone ID: LIB148-043-Q1-E1-H2
acggacccgtccgcactcacaccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctgggaccgccgtcgancaacgactccccgactacgtcatccaaggccgcgtctattgcgacacct

SEQ ID NO: 6465 - DNA, 333 bp, Zea mays
  Clone ID: LIB148-043-Q1-E1-H3
aaagaggacatgcccgtgggccgcgtcatgggcgacatgctgatcctccccaccggcgacctgctgctgctgagcggcgccgccaagggctgctccggctggggcttcgggcggcagccggtgctgaccccggtcctgtactcgccgcggaaggcgcaaggcccgcggttccgggcgctggcgtcgtcgaccatcgcgcgcatgtaccactccaccagcgccgtgctgcccgacgccacggtgctggtggccggcggcaacacgaacgcggcgtacaacttcagcggcgtggacttccccaccgaggtgcgcgtggagcggttctccccgccg

SEQ ID NO: 6466 - DNA, 180 bp, Zea mays
  Clone ID: LIB148-043-Q1-E1-H4
tccacgcgtcagaaacgcgcggtccggtgatcggtgtggccggtggcccggatgagtcagttagagagcgagctttttttttgatacgggggagttaaaaaatccaaaaatcttggtgtatgtacagttctgtctatgagaaatactaacgcgtcttgcagtgctgctgcctgctgcctc

SEQ ID NO: 6467 - DNA, 148 bp, Zea mays
  Clone ID: LIB148-043-Q1-E1-F9
catgcatgcatgcatgcattgcgtttgcgtctcaagagttcacttgtaaatttgtaatcgaggaagaaaagcacctctcgatcgattaacatgtctagctgctacgatcctgtgattcgacgatgttaattaatcggcagctttcatt

SEQ ID NO: 6468 - DNA, 280 bp, Zea mays
  Clone ID: LIB148-043-Q1-E1-H5
atcgtaccgaacattgccacaagatagtgcagctccatacactcgaagaagaagctgagaggttggaaccacgtacaccgagcgaagggtgaatctaggttcatggactgtggatgtgttgttgctttgaattgcgctgtcgtgtttacctactccgagtccgacaacagcctcgacgccgagtgccttttcgtttcaacgatgtgctatatcttggggccacggaacggcagatcctagctttctttgtaaacaagaggatgtggaaagttggctgcgt

SEQ ID NO: 6469 - DNA, 374 bp, Zea mays
  Clone ID: LIB148-043-Q1-E1-E3
aaagataatgcagatgactgtcgccttcaaccacttcggcagaagcctcgtgcagacgatgccaaggtgccgctggggcttcttccacgtggtcaacagcgactacacgcactggctcatgtacgccatcagcggcagcaatgcccccaccatcatcagccatggcaatcgctacatcgcgccgcccaaccttgccgcgacgcaggtcatcaagcagcatgacacgccggagtcggtgtggaagaactgggtgtggcactccgagaacgacctcctcatggaatgcgcccaacttaacgtcaacgggcggcaaaatcaacaggaatttcaacactacggacctcatcatgccaaggaacggttccaacttcaca

SEQ ID NO: 6470 - DNA, 136 bp, Zea mays
  Clone ID: LIB148-043-Q1-E1-E4
tattaacattttgccctcctccaactttctcattttcttgcaatagcatgtcactgttcgtcatgatagcacctcaagtatgcatctatgtcatatcagtgagtcttggggcctgtaatatcagctgcacaatctt

SEQ ID NO: 6471 - DNA, 413 bp, Zea mays
  Clone ID: LIB148-043-Q1-E1-E5
attttcctcctcttgcacaacgtggtggcggacacgtgcgtcgcgatgggcgattgggtggcgcacccgcaggcgcacacggcgctggacgacatcctcccgtgcgtggacgtggccacggcgaacgagtcgctgtaccggagccaggaggtgacgtcgcagctggtggcgctggtgaacaacgtcgtcgtcaacatctctaaccggaacttcccgccggggctccgcccgctctacttcaaccagtcggggccgctcatgcccgtgctctgcaacccgttcaacccggacatgagcccccgccggtgcgcgcccggcgaggtcgacttcggcagcgcggcgcgggagtggaagcggttcgagtgccagaccacggggccgccggggtcggagctgtgcgccacgccggggcg

SEQ ID NO: 6472 - DNA, 388 bp, Zea mays
  Clone ID: LIB148-043-Q1-E1-E6
aactgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaatggcatcgtgtcaccgaccaacggcacggggtggtacaatggcatcgcccgggagttcgtggacgcccacaacgagctccgcgcgcgctacggcgtgccgcccatgaagtgggacaggaagctggctcg

SEQ ID NO: 6473 - DNA, 416 bp, Zea mays
  Clone ID: LIB148-043-Q1-E1-E7
aaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcg

SEQ ID NO: 6474 - DNA, 258 bp, Zea mays
  Clone ID: LIB148-043-Q1-E1-E9
gggtcccagcacgcgtccgaatgaagatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttctgtttgattttcaatgtgttatcatgttgttagttaactgtatcgactcatggtatcaaggtctaaaaaattatcgtc

SEQ ID NO: 6475 - DNA, 395 bp, Zea mays
  Clone ID: LIB148-043-Q1-E1-F1
aaacataccgtcggactacacctgggtcgatgccaccgagaagaagcggaggatgaaggcaaagaaagccaagagcaggcggaccacagcccgaaaacagtcctcgaagaacacttcttcggaaggaggccaccgccccatgatggatggcttcgaggagtaaaccgcgttctcacaagcatagtaagttgtatttgcattcttaaaatgttagttgttgatggcagctgcacgccagaggcagattgattgatgttgtgcctggagcaccccctcccttggcgtggcaatgaatcggagtcgaatctccttgagaacgtacaggatggcttatacccaccccactaatctgttattcagccagcgctatttttttttgcccccctccgtgtttc

SEQ ID NO: 6476 - DNA, 421 bp, Zea mays
  Clone ID: LIB148-043-Q1-E1-F10
aacacgcgtccgcccacgcgtccgcaaccactccctccccggggacgccttcgacgccgtggtgcgcgccaagctggccctggagctggagtgccccggggtggtgtcctgcgccgacatcctcgcactggcgtcgggcgtgctgattaccatgaccggcgggccccggtacccggttccgctggggcgcagggactcgctgtcgtcgtcgcccacggcgcccgacgtggagctgccgcacgccaacttcaccgtggaccgcctcatccagatgttcggcgccaaggggttcacggtgcaggagctggtggcgctgtccggcgcccacacgctgggcttctcccactgcaaggagttcgccgaccgcctctacaacttccgcaaccagggcgggaagccggagcagttcgaccccagcatg

SEQ ID NO: 6477 - DNA, 382 bp, Zea mays
  Clone ID: LIB148-043-Q1-E1-F11
acagcgcctcatcttcgccggcaagcagctggagggatggcgcaacctggcgggttacaacaaccaaaaagggaacaacccccaactggtggtccggctcaaggggttgcagccaaatttttgtaaaaacattgacgggcaaaactataaccttggaggtggagacctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcaagggtggtatgcagatctttgtgaagaccctgactggaaaaaccataaccct

SEQ ID NO: 6478 - DNA, 244 bp, Zea mays
  Clone ID: LIB148-043-Q1-E1-F12
accacgagtccgcagcaatggcggccaaggtgttcctcctcctccgactaagcaatggtcgccgtcgtccgggctgcaaccgcaacagtaccgctcgcggaggaagccgatccgcgggcactgccggaacattggaccaccgcaaaaaattacaaggccacaatggacgccaaaacccggaaggctttcaacggcttggtggccgccgctacggaaaaaaaccggtccaaggcgttgaaggcct

SEQ ID NO: 6479 - DNA, 414 bp, Zea mays
  Clone ID: LIB148-043-Q1-E1-F2
gttcgccagcccgcccgcccctcccctctctctgtctcgccgcccggggagaacgagggctccgccgctcccggggaagagcgcgccattgccgccgccgcgctgactggggaatatggttgtccaagagttcagaattgatctcaagaagccccttgttttccagcttggacatcttgatgaatcgtaccacgacatgggttcaccaatcgattatcagcaagggaggtccatgctttttcggaaatgatgtcctgcagttcatgactcgcacgaagtggtaggctgtgccaactatatggctgactgttgtctgctgcctggccgtgaaatctattctgatgggtcatactgttcaggacgtaactatgatggctctgtttgggatatttattttgacgctgatcgaataca

SEQ ID NO: 6480 - DNA, 396 bp, Zea mays
  unsure at all n locations
  Clone ID: LIB148-043-Q1-E1-F3
aaagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccangtggtgctggtggccagcccgcgcaaggactgcgacgaggtccaggcgctcagggaccgcgccggcgtcctgctcaccaggaacgtcggcatctccgacagcctgcgccccgccaacccgctcggctacttcaaggacgtgccgctccccgtctgcgccgcgctgctcaagcagctggactcggacgacgacgacgaccagtaaactgtaccacggcggcgtcgcggacaggctgcacaaaactataacga

SEQ ID NO: 6481 - DNA, 354 bp, Zea mays
  Clone ID: LIB148-043-Q1-E1-F4
acggggcactgctcacgtcgcgacgaggatctcctcgagggagacggagagctcgaggtggtggcgcacggaggccgggctacgcgtgggcgtgggcgtggtctcggcgcggcacatcgggcagctggtgctcccgcgcagccacgtgtcgatgcagtcggcgtggaagtagtgcatgcactcggggagcacccgcacgacctcgccgtcgtcgaagtcgggcaggcacaccgggcacgtcgactcgttccaggcctcctccttgcggtaccggcacaccaccgccgcgcccaccaggacgacgcatgcatggcgcggcgcgctagatgtggcccgcgacgatggtggcgggct

SEQ ID NO: 6482 - DNA, 336 bp, Zea mays
  Clone ID: LIB148-043-Q1-E1-F5
acccacgcgctccgaccatgacgtcgtacttaacgcgtgggcgagacgcgtggaggtcggaggaggcaagctgtgtcagcgcacgcagcagataggtcgagcgtgacgaccatcaggtgactcgtcgtaggaggggcttcgaggattgaggaggcagatcgccctcatgtacggatagttttaatggactaaaactcagttctcacaacacagtgatcagttgtaggtcgaggccatggcatttaatgttgttgcatagtagcttgcagccacaggcacagtggttggcgttgtgcctggatcaatgacttccttggcgtaggaatgaatgcagtg

SEQ ID NO: 6483 - DNA, 389 bp, Zea mays
  Clone ID: LIB148-043-Q1-E1-F6
accacgcgtccggtcctctcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctg

SEQ ID NO: 6484 - DNA, 386 bp, Zea mays
  Clone ID: LIB148-043-Q1-E1-F7
acaagcttctcgaggtgattgatgctagtgagttgccagaaatttttggtggaacctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacatcctcacgtgtcacctcttcacgaggaacttatccccacttcaattcatacccctggatcaccctattcttgtgatgtcccg

SEQ ID NO: 6485 - DNA, 389 bp, Zea mays
  Clone ID: LIB148-043-Q1-E1-F8
accacgcgtccggggtgcggtcgtaccgggtgaagatgtccttgacctccttcttggcggcctcgtcgacgtacttctggtagtaggcgacgagccccttggcgacggcctggcggatggcgtagatctgcgacgtcttcccgccgcctcggacgcggatcctcatgtcgatgtccttgaacctggagcgccccgccagcaggatgggctcgaaggccttgaggcggagcatctccggcctgatgagctcaatcgggacgccgttcaccttgatcagcccgcgccccggcttggtgtaggcgacggccacagccgtcttcttgcggccgaagcactggaccgtgccgggggtcgggcgctggaacacggtagacatgtttgcgaccttg

SEQ ID NO: 6486 - DNA, 405 bp, Zea mays
  Clone ID: LIB148-043-Q1-E1-E2
accacgcatccgccgcgaccttggtgtcctgcaggagcttcaggaacgtggagtacgtgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggagccccctgcgtggccaagctcgtcaaggtcgtcgcagcgcggccgtactctgtgtccatcatggagatcagcgagcccattt

SEQ ID NO: 6487 - DNA, 209 bp, Zea mays
  Clone ID: LIB148-043-Q1-E1-C9
agcacgagtccgcggacgcgtgggcggacgcgtgtggcaagcaacggtttacgttttggaaacggaatttcttcgggaaccaaattaagcttggccttacgaaccttggccctattgggcgtgctctgctgcaacatggcaaccaccggttccgccaacaagaaaggaatcaaggtcttcggaagcttcgagggttcagaatacggaag

SEQ ID NO: 6488 - DNA, 342 bp, Zea mays
  Clone ID: LIB148-043-Q1-E1-D1
gatgagcaccaaggaggtggacgagcagatgatcaacgtgcagaacaagaactcctcctacttcgtggagtggatccctaacaacgtcaagtccagcgtgtgcgacatcccacccgtcgggctgtccatgtcctccaccttcgtgggcaactccacctccatccaggagatgttccgccgcgtgagcgagcagttcacggctatgttccggcgcaaggccttcctgcattggtacaccagcgagggcatggacgagatggagttcaccgaagccgagagcaacatgaacgacctcgtcgccgagtaccagcagtaccaagacgccacagccgaggagtacga

SEQ ID NO: 6489 - DNA, 225 bp, Zea mays
  Clone ID: LIB148-043-Q1-E1-D10
ggtcgagcccgcgtccgacacgagtccgcgcaccagtgccgacagcgacagcatctcgctcattctcggccatcaagttctggatcgacaacatctccatgtccaaatgcaaagacagcgtcatcgacgtcatgcagacctccactgggatcatcatctccatctgccacttcagcaaccacagcaacgtcatgctcttcagcaccagcgattcctgggcggaag

SEQ ID NO: 6490 - DNA, 431 bp, Zea mays
  Clone ID: LIB148-043-Q1-E1-D12
gggtcgagcacgcgtccgcccacgacgtccgcccacgcgtccggcgcgaccacgagcagccgcaggacgcgcattgccgctccgaggcgctggtgcagcaggtggccgccgcggcccgggaggccggcttgggcctggccggcaagaaggcgttgccgcgctacgacgacacggcgcacgaccagttggtggccactgccgccgacagggccgccgaggaccgcatggtggccttcacgtacctgcgcatggggcccgacctgttccagcccgacaactggcgccgcttcgccgcgttcgtcaagcgcatgacggacccgggcgcgcgggaggcttgccgggagcaggtggaccgggaggccgagggcgtcgcgcaggccacccagcccctcgtgcacgaggccgccgtcgcgctcatcaactgaccggac

SEQ ID NO: 6491 - DNA, 391 bp, Zea mays
  unsure at all n locations
  Clone ID: LIB148-043-Q1-E1-D2
agtcgtcatctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggngtgaccgacgggaacggcacgtacacgatcgagctcaaggacagcacgangaggacatctg

SEQ ID NO: 6492 - DNA, 342 bp, Zea mays
  Clone ID: LIB148-043-Q1-E1-D3
accacgcatccgcccacgcgtccggaggaacggcgccatcatcctgtcggtgcggccgagcgccacgaactgcctcgccgacgagagccacgtgtgctggaggaacggcaagttcgcgcaggacatgatcctccggctcaggaacgtggagagcggggagattcagctgcagctgcagtggctcagcatccctcctgctgcagccagcaggtgaaggaaacgaagcaatcgcattttcaacctctttgtgaatgtcggattgtaacaacttaaaccagcaattaatggggtcagggtcagtcagggtagttcatgtgttgccctattaatggtacattgggg

SEQ ID NO: 6493 - DNA, 364 bp, Zea mays
  Clone ID: LIB148-043-Q1-E1-D4
agcgcctacttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacg

SEQ ID NO: 6494 - DNA, 409 bp, Zea mays
  Clone ID: LIB148-043-Q1-E1-D5
agaataacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatcgagtcacggtgtacatcactgacatgaactacgagcctatcgctcccctac

SEQ ID NO: 6495 - DNA, 397 bp, Zea mays
  Clone ID: LIB148-043-Q1-E1-D7
atgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagacgaggaggaagttgtggagaagaccgtcatcgagaaggagaagccatcagcagtccatgcagaggaaaatattgccaccaacaaggtggcagccgagcccacgacagaattgaagaaagaca

SEQ ID NO: 6496 - DNA, 430 bp, Zea mays
  Clone ID: LIB148-043-Q1-E1-D8
agcgaacaaccaacgatcgcctcatcgccatggcacgctctgtccccatcgcgcctctgctcctgctctccctcctcctcctcctcgtctccactgcgtccgctgcacggaccgtgggcgacaccgtgcaggacgcgtgcagcaagacacaattccccaagatctgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggatccaccgacgccaagttcctggagcttaagtcgtggggtctcctc

SEQ ID NO: 6497 - DNA, 348 bp, Zea mays
  Clone ID: LIB148-043-Q1-E1-D9
agctagctaccgatggctggagcctgggcactgctcatcgtcctcgcggctgccgtcccggtcttggccgcgcggccggcgtctgcaggctggggacccccggccgtggcagagatctgcatgaagactccgtcccccgacctgtgcaccaggacggcggggaagcacgccaacaggtacaacgtggtggacacggtgacggtgctagagatgcatgtggacgcgttcaagaagcgcgtgaacgcggcactgaggctcaccatagaggaggtcaagacggtcgcgacgcccgacgcgcagagggcactgaacctctgcaagacctactacctggacgccgccgacaac

SEQ ID NO: 6498 - DNA, 391 bp, Zea mays
  Clone ID: LIB148-043-Q1-E1-E1
gaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgattgcgacatccgcgaagtgtttggtgccaaccaacaact

SEQ ID NO: 6499 - DNA, 414 bp, Zea mays
  Clone ID: LIB148-043-Q1-E1-E10
aggacgcgtgggtttcgttatcctcctcttacattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacat

SEQ ID NO: 6500 - DNA, 392 bp, Zea mays
  unsure at all n locations
  Clone ID: LIB148-043-Q1-E1-E11
accacgcgtccgcccacgcgtccgctcgtcgtcgtctcactcaccccgccttcacgcctccctcaccaaataaggtcccgcccttttccgacattcacaagggggacangaaatcagcggccatggcctcgattccggcgacgaccttcgccgtcatcttatccgtcctcttctgtgccgcngctggcaccgccgtcgacaacgacctccccgactacgtcatccaaggccgcgtctattgcgacacctgccgcgccgggttcgtgaccaatgtcaccgagtacatcgcgggcgccaaggtgaggctggagtgcaagcacttcggcaccggcaagctcgagcgctccatcgacggngtgaccgacgggaacggcacgtacacgatcgagctc

SEQ ID NO: 6501 - DNA, 351 bp, Zea mays
  Clone ID: LIB148-043-Q1-E1-E12
gggtcccagcacgcgtccgaaaagtatcacatgatcatcatttcttcctcaaagaatgtctgccttttctggcctcggcacaatttcacaagcatcaatagtaatgcaaatccataataccatgttgacaactcaagcagtcatgcttacaagacaagggaacttgggaagttcctgggaattttaaccttatatacaaagatgaagacaagaatgatgggcaaatttccaaagtttaataatgatttaaccttgaaggacattcctttacaaggtccgagtttcacttgggcaaatctgcaagctgattcggtgttggtaaagcttgacagtttagtgggaacaactgtt

SEQ ID NO: 6502 - DNA, 432 bp, Zea mays
  Clone ID: LIB148-043-Q1-E1-C7
agaagagcaagatcctggtggtcggcggcacggggtacctgggcaggcacgtcgtggcggcgagcgcgcggctgggccaccccacctcggcgctcgtcagggacacggcgccgtccgacccggccaaagcggcgctgctcaagaccttccaggacgccggtgtgacgctcctcaagggcgacctgtacgaccaggctagcctggtgagcgcggtgaagggcgcggacgtggtcatctccgtgctcggatcgatgcagatcgccgaccagagccggctcgtcgacgccatcaaggaggccggcaacgtcaagaggttcttcccgtcggagttcggcctggacgtggaccgcacgggcatcgtggagccggccaagtccatcctaggcgccaaggtgggcatccgccgcgccaccgaggccgcgggcataccct

SEQ ID NO: 6503 - DNA, 380 bp, Zea mays
  Clone ID: LIB148-043-Q1-E1-B2
accacgcatccgcgaggaacgggcctcagtgctcgccgccagcaacaaggtctccgatgaagcggcggcggctaccgcggtgccgcctgcaggtgccagtgccaagacctcgagcagcaacgatgcccgcgacggcgccatgggcagcgtgcaggacgagccgcgggagcagcgccacgatgactatcaccccgagatcgtccccgagaagatcatacacgatgacgcgttgccggtcgttgctgcacagaaggagaccgccgccgccgccgacgtctcgaatgaggacgacgtggagtcgcccaagaaaagagcggctctgtcgccggtgccggagactatcgtcatcgtcaccgacgcaacctcgaacgaggaagacg

SEQ ID NO: 6504 - DNA, 369 bp, Zea mays
  unsure at all n locations
  Clone ID: LIB148-043-Q1-E1-B3
atcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaacgcgcaggcgcgcaagcacgtcgcgaggtcnggcccgcaca

SEQ ID NO: 6505 - DNA, 387 bp, Zea mays
  unsure at all n locations
  Clone ID: LIB148-043-Q1-E1-B4
accacgcgtccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacganggcatcaccatggacaatgtctcctaccccatcatcatcgaccagaagtactgccccaacaaca

SEQ ID NO: 6506 - DNA, 121 bp, Zea mays
  Clone ID: LIB148-043-Q1-E1-B5
aaaaaaaaaaaaaaaaaaaaaaaaaaaaaaaaaaaaaaataaaaaaaaaaaataaaaaaaaaaaaaaaaaaaaaaaggcaatcaaaacaaaaaagttaacaacataaatatgggggggctc

SEQ ID NO: 6507 - DNA, 418 bp, Zea mays
  Clone ID: LIB148-043-Q1-E1-B6
aataatctcgaccaatggcggcaccaacggtggtgctcatcccgttctgcgtcaccggccacctgacgtccatgctccaagccggcaagcggatgctgatgagcggcggcggcgacctggccatgtcgctcaccgtgctcctcgcgccactgccgatggccaggttcgcgcacatcgtagagcgggaggccacctcgggctcggggttcgacatccgcttccaccgcctccctgacgtggagctccccgccttctccggcccggaggacatgatctccagtttcatccagctgcaggcgtccaacaccaaggcggccattgccggcctggcaagccccgtcgccgccgtcgtcatggactactttttgcacacgctgttcgacgtcgcccgcgagttggcactgccggtgtacgtgta

SEQ ID NO: 6508 - DNA, 384 bp, Zea mays
  Clone ID: LIB148-043-Q1-E1-B7
aagggcacttgaagatgaccaggagtttctcaagcaggtgttgagttccctccaatgcggtagtgatggactgcagtgtatacaggagataagcggccatctagcagagttgcgaagagttgtgactcgctaaggaaaatggttttgccccgagtccaaattgttaggtcatcatgaggtcttctcatgcagcagactaacgagggtgcttccactgagtgcccacaatcccatctatctgaagatggatgccgttgcaggaaatacccatgctcttcgcttctgatcgggctcaacagcagaccaaaattttccatcttttgcactttgagttcctcatcgacatttgcagactactgaagcagatgggactctaaaagaaag

SEQ ID NO: 6509 - DNA, 438 bp, Zea mays
  Clone ID: LIB148-043-Q1-E1-B8
accacgcgtccgcccacgcgtccggggatggcaaagcgccggcgccacgagttggcgccggtcgtggaggagctgatttcgccgatgaacagcctggacgacggctgcctcatgcacatcttcagcttcctgagcccaatcccagatggcgcttccttgcatgccaccctcggctatggctgcgtgttgagaggccaatcagagatgcgatggagcctggagtttatcctgatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggcttcgacaacgcactggagtttctatcaacatgcaagattgcaaatctga

SEQ ID NO: 6510 - DNA, 370 bp, Zea mays
  Clone ID: LIB148-043-Q1-E1-B9
gtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcataattgaagccatcctcttagaccgtctccagcactttatccatatggtctccccctcttagtcgattgttatttaagtgcagcctcttcggagatgcaattacaatccatcctctctttctttttccctttctcaaagagctaagaccttgctcgact

SEQ ID NO: 6511 - DNA, 322 bp, Zea mays
  Clone ID: LIB148-043-Q1-E1-C1
atcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctc

SEQ ID NO: 6512 - DNA, 413 bp, Zea mays
  Clone ID: LIB148-043-Q1-E1-C10
acacaaacccggaccgaccacgccatggcgctgtggatttcgatcttcggtgagcggtgcccaagctcctttccatcggtgctcgcccgcactgctgccaccgagatcctgtcggcacccgcctccgcgcgctcccgctgccgcacgggaccaacctgttcgcctgttcatccactcagcgacattcacgcccgcatctcgccgtgggcagcaccgcactcaccaccgccgtcgcagtgaggtcacgagtcagctgaagagcaagttggtacctggaatctcaagtcccaggtcaagaacaggtaccgcaggatgaggcgcatggaggatgctgtggcgagttcgtgagaggtctaggccatcgtctcccagtcaactttgggttgctggaccgttgtctccttataatgaaa

SEQ ID NO: 6513 - DNA, 379 bp, Zea mays
  unsure at all n locations
  Clone ID: LIB148-043-Q1-E1-C11
accacgcgtccggccctcgtcatcgcggtcgccggcatttcccttcccttcatcatggggcaaccggaactcccttggtctccaagaaaaccttccccggcgggttgccaacggctcgtttcctcgtcttcaggggtgtcgcgctctccatcacggcgttcccggtgctggcacgcattctcgccgagctcaagctgctcaccaccgacctcgggcgcatggccatgtcagctgccgccgtgaacgacgtcgttgcgtggatacttctggccctggccatcgctttgtcaggcaccggttcccctcctgtccccttatggggtgctgctancgggaactggctttgtcctcccggcgttcctgttgctccgcccgggcc

SEQ ID NO: 6514 - DNA, 403 bp, Zea mays
  Clone ID: LIB148-043-Q1-E1-C12
cagacaatcccatcttcatcgacatgaagtactgccccaacaagttgtgtactgccaacggcgcctctaaggtcaccatcaaggatgtcaccttcaagaacatcaccagcacctcctcaaccccggaggccgttaccctgctctgcactgccaaggtcccatgcaccggcttcaccatggatgacgtcaacgtcgagtatagcggcactaacaacaagaccatggctatatgcacgaacgccaacggcagcaccaacggttgcctcaaggagcttgcatgcttctagaccctccatctactgacccatctctctaattataatttttctctcgtccttgcattgcccattagatgctatccattggtaacgcacaacagtaaaacgacacacatccgtcagct

SEQ ID NO: 6515 - DNA, 375 bp, Zea mays
  Clone ID: LIB148-043-Q1-E1-C2
attcttcatccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaacgtcacagattccagccaaccactgaagctggaagtgttcgacaaggacaccttcaacaaagacgaccccatgggagacgcggaggtggacgtggcgccactgatggaggcggtgagcatgaacccg

SEQ ID NO: 6516 - DNA, 338 bp, Zea mays
  Clone ID: LIB148-043-Q1-E1-C3
accacgcatccgcagcagatgaggttgttgactgttcccatgggcggtcactgtgggaacttgctgaagtgaagtacgagccgctgtggatcaaaggcggaaaccactgcaacctagaactgtacccggaatacatcaaacatctgaagaagttcgttggagccatagagaaatcgccacccccacctccgatcgacgagtgcatggagagctcaagcccgtcggattgtaccccagcagaacccgagtgtacagcggactcaaggaagagcacggactgcagggacaaagcaaggccaagcatagatcagagacaaagcacggaccggcgggacaag

SEQ ID NO: 6517 - DNA, 381 bp, Zea mays
  Clone ID: LIB148-043-Q1-E1-C4
gtccaccgacccgtccgagacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaagctgtgcaggatgcatgggcatcggcgtgccggaggactgtgaagcagacaatcctcaataccaagggcgaattccttttccgacaactcaacttcacacggccttgcaaaggcgacgtgaacatccaagttgattgcaatctgctggcgaccacggacctaagccagtacaacgaccatggt

SEQ ID NO: 6518 - DNA, 354 bp, Zea mays
  Clone ID: LIB148-043-Q1-E1-B12
aacacgcgtccggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcat

SEQ ID NO: 6519 - DNA, 405 bp, Zea mays
  Clone ID: LIB148-043-Q1-E1-C6
cctcattatcctttgtgttctgctgtactgcaaactgaaagtgaatataatacaatggtgtagctgatatatgtacaggaaggcttcttgtagcagatacaaacaacaacgcaatcagatatataactcttagtgacaaaggtgctgaggtgaagacactagagttgatcggagtacaaccgccatcaccaaaaccgaaggtgttgaaacgcctaagacggcagttatcggcagatacagatgttattaatgtcgatggtggttcttcaaaggaaggattcttgtctcttgcagttacagtacctgatggttaccatttctccaaggtcatcaataaccataagacattgttttttcttatcttacttgcaagtttgcattattcatggtagtcactaatgactg

SEQ ID NO: 6520 - DNA, 392 bp, Zea mays
  Clone ID: LIB148-042-Q1-E1-H7
aacgaagccccccacacacaaaaaagcaaaagcatcatcacaataatggcccgcgcgtgcgtgttcctcgtggtgctcctcctggccgccgtcgcggtggcgccgtttgcgggggctgcgcgcgtggatgtcgtggagggcaggtccatggcgtccgccgacgcgcctgaggcggcggctgacgcgcccgctcccggtcccgactccgcctcatccccggactcgtcgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatgaaa

SEQ ID NO: 6521 - DNA, 432 bp, Zea mays
  Clone ID: LIB148-042-Q1-E1-H8
gatccacgcgtccaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcgtccctgcggcacctgcaccgacgcctcccgacgagccagcagcggcagctgaggaagaagccgacgcagctgcagatgccccttcagcagatggagcctcaagctccac

SEQ ID NO: 6522 - DNA, 196 bp, Zea mays
  Clone ID: LIB148-042-Q1-E1-H9
gaacaacatcacctgtggccccgggcagggcatcagtgtgggctgcctaggccgctacaaggatgagaaggacgtgagcgacgtgacggtgcgggattgcgtgcttaggaacaccaccaacggcgtgcgcatcaagtcgtacgaggatgccgagtctgtgctcacggcgtcccatctcaccttcgagaacatcagg

SEQ ID NO: 6523 - DNA, 384 bp, Zea mays
  unsure at all n locations
  Clone ID: LIB148-043-Q1-E1-A1
ctgctgttcttcgaaccgtcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatgaaggatgaacggttgcngccgatgatcgatgtgtccgtcggcatg

SEQ ID NO: 6524 - DNA, 376 bp, Zea mays
  unsure at all n locations
  Clone ID: LIB148-043-Q1-E1-A10
acgtcaacctcgccgtcgccgtcgccgccgcgccattagcagcctacgctgccgccacgcgccatcaagccatcgcccgtgctcaagtccagcgtgtgagactagtagaacgctgcgatggcagcgtagggaatcacggttcaattccacaacgtcaatcgccaccgggagganagccangaccgcccacgcgctccgcgtgcagccgcactagctgctgtcatcgcacgactacgtatcgctcgcgatgcgcgcggctacacgtcaacgggaaaggcaagaggtccttcatgtccagcatctacatgtgcctgttcccaaaggtcatcgactgagtgatccgaagatggatattcacaatcgctcacccgtatac

SEQ ID NO: 6525 - DNA, 391 bp, Zea mays
  Clone ID: LIB148-043-Q1-E1-A11
cggacgcgtgggctactgcggccaacaaggccttgcaagagcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgc

SEQ ID NO: 6526 - DNA, 406 bp, Zea mays
  unsure at all n locations
  Clone ID: LIB148-043-Q1-E1-A12
aattcaagtaacacagttgagcacgacgatgggatccctcgctaataacatcatggtcgtgggcgccgtccttgcagcacttgtcgtccgcgggtcgtgctggcccccgaacgtgccgcccggccccaacatcaccaccaactacaacggcaaatggctcaccgccagcgccacctggtacggtcagcccaacagtgccggcgctcctgacaacagcggtgcgtgcgggatcaagaacgtgaacctgccaccctacagcggcatgacggcgtgcggcaacgtccccatcttcaacgacggcaagggctgtggctcatgctacgatgtgagatgcaaggaaaaacctgaatgctcgggcaatccagtcacngtgttcatcacagacatgaactacgagcctatcgct

SEQ ID NO: 6527 - DNA, 158 bp, Zea mays
  Clone ID: LIB148-043-Q1-E1-A2
attctaggtcgaccgacccgtccgcaacaggatggcatgcacaaacaatgcgatgagagccttgttcctcctggtcctcttctgcatcgtgcatggtgagaaggaagagtcaaagggcatcgatgcgaaagcgtccgggcctggtgggtccttccaca

SEQ ID NO: 6528 - DNA, 442 bp, Zea mays
  unsure at all n locations
  Clone ID: LIB148-043-Q1-E1-A3
gtccagggacgcgtcagaccacgcatccgatctggttctcagtgaaacactctgcacttgaaaggaccgatgcaaatgtaaagattaaggtatgtgctcatgctgtgctaatgaaagccttaaattcagtgttttgttttttttctggtggcgtactgtcactgttgactggcctacggatctgagtttttgtgtaattgtttggaagcaattccattgtcgccgaaatggcgcggtagtttctctgactgctgctgctaaatactaggaactttagttttcttcaagtccaaagggtcagagttgagagcacctgagatccggcgatgcttcatggccacggtcccccagaggctattcgcaatagttgactctaaatttctctctatatatcagttttttgtgtcacattatcaacatttcataccttaacttttttang

SEQ ID NO: 6529 - DNA, 321 bp, Zea mays
  Clone ID: LIB148-043-Q1-E1-A4
gtccaccgacgcgtccgaggtaggtgggtttcggatttgagccgcctttgaaggcgtctggcggcgagcgaacattctgatactgctaggtcctattcagttggttccttctcgtcgtcagccgtctgccctgtgactcgtcggctggactgagcaggtgcgtttgcagttgcagccttaccatatagcttataactttgtggtaagttagcatacctgcatgctgtaacagacatggaggatatagtggagctctgcaggataatagagtggtaatgcccactcaggtgacctaagacattgcaagggcgacgtgaccat

SEQ ID NO: 6530 - DNA, 270 bp, Zea mays
  Clone ID: LIB148-043-Q1-E1-A5
aacgccgcgccgcgggtgttcgcgcacgccgcctccgtggccatggcgttcctgtggctcgagttctcgcagtcgttccaggtgctggcaatcctcgcgtccaagctcaagcacgccgtcgcgctcggctacaagttctgggtcggcgcggggctccccgccaagggagccgcccacgtcgcgctcgcctgccagctgggcctcctccggtgcaaactcgcctgccaagtcggggtcctgttgatgcaacttggggccgtccgggggggg

SEQ ID NO: 6531 - DNA, 306 bp, Zea mays
  Clone ID: LIB148-043-Q1-E1-A6
cgtttgaccttgcaacaccctgacgtgagtcgtattatgttcgcgcacgccgcctccgtggccatggcgttcctgtggctcgagttctcgcagtcgttccaggtgctggcaatcctcgcgtccacgcgcacgcgcgccgtcgcgctcggctacaggttctgggtcggcgcggggctccccgccaggggagccgcccacgtcgcgcgcggctgccagctgggcctcctcgggtgcaagctcgcgtgccatgtcggcgtcctgtggatgcatcttggtcccgtcggcgggggttgcagcggcatgcgg

SEQ ID NO: 6532 - DNA, 310 bp, Zea mays
  Clone ID: LIB148-043-Q1-E1-A7
cggacgcgtgggcggacgcgtgggcgtccccaatggggctatcgttaccatttcaacatacacgaccattttctacacacaactttgagtgaagatttatcggacacaggtggtaatcgtctgacatgtcctgagatacacggagactgatggtgccaggctagtgggttgagtacaggatgagcgcaaccggtagtgtgtatatcacgttctttgtactcaagaattttgtacagacagaatgcggtgcggatagcatgccttgcatacataataatttcaatacaggttgaaaacttgaaatcaaaac

SEQ ID NO: 6533 - DNA, 418 bp, Zea mays
  Clone ID: LIB148-043-Q1-E1-A8
agacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacatacagcacgaaggctgtgcacgaggcatgggcatcggcgtgcggcggcactgggaagcatacaatcctcatacccaagggcgacttccttgtcggacaactcaacttcacatgcccttgcaatggcgacgtgaccatccaggtggatggcaatctgctggcgaccacggacctaagccagtacaaggaccatggtaattggatcgagattctacgcgtggataacctggtcatcaccggcaagggaaac

SEQ ID NO: 6534 - DNA, 383 bp, Zea mays
  Clone ID: LIB148-043-Q1-E1-A9
accacgcgtccgcattaacgcgcaggtgctcgtggagatggagatcccggagatctacattgagtcgctgccaaagaaagggaagacgagcctgggcgacgccatctaccggagcatcaccgaggaaacgttcgacccgctggagttcttggccgggatggacctttcgacggagcacaaggtgctggacctcaagaaccgcatcgaggcctccaccgtgatctggaagcgcaagatgcagaccaaggactccaagtcctcgtggagctccatcgtcagcttcgagaagcgcgagcagttcgaggagcgcgccgagaccatcctccacctgctcaagctccagttccccggcacgccgcagtcgcagctcgacatctccaaga

SEQ ID NO: 6535 - DNA, 324 bp, Zea mays
  Clone ID: LIB148-043-Q1-E1-B1
cacgcatccggtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacg

SEQ ID NO: 6536 - DNA, 291 bp, Zea mays
  Clone ID: LIB148-043-Q1-E1-B10
cacacgacgtccgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggaaaaaaaaaaaaaaaaaaaaaaagaaagaaacacaaaaagaaacaaaactaaagtggaagtaaatgaaaagggataaaatcttacgat

SEQ ID NO: 6537 - DNA, 412 bp, Zea mays
  Clone ID: LIB148-042-Q1-E1-H6
acccacgcgtccggttcatatctcccctggatcgctgcccaagggcctccactctcttgatctgtccaggaacaagattgccagcgtcgagggcctccgggagctcacaaagctacgcgtgctcaacctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgttggcaacccggtgcaggccaacatcggcgacgacgccctgcgccgggcggtcacgggcctcctcccg

SEQ ID NO: 6538 - DNA, 306 bp, Zea mays
  Clone ID: LIB148-043-Q1-E1-B11
aaaacaaccacgcctccatcacatcactgccgccgcggtcgctacagtcgctgataagccgctgcatccacggatggagatgaacaggatcccccacacagtctcctcctgcctctgcacattcacttacacctctgcgctagcgcaatctctgaccagatgatcgtccgccgtcttacacgccatcgccggggaaaacgttggcgttatcctcgcgaagcacattcacttaaccccccgattaagaaccggagccagaaggaagaaagccaggtccggtgacacatctcactactctgcgctgct

SEQ ID NO: 6539 - DNA, 401 bp, Zea mays
  Clone ID: LIB148-042-Q1-E1-F8
ggaatgtatgggtttgcgtgaagtaaagtctttgcggcgcatgaatcatcctaacattgtgaagctcaaagaggttatccgagaaaatgatatattatacttcataatggaatacatggagtgtaatctctaccaacttatgaaggataaggtcaagcctttctcggagtctgaagtccgcaactggtgctttcagatatttcaggctcttgcttacatgcatcagaggggctactttcatcgtgacctcaaacctgagaatctgttggttagcaaagatgtcataaagctagcagactttggtcttgcaagggaagtttcatctttgccgccatatacagaatatgtctcaactcgctggtatcgggcaccagaagtattgctccagtcatctgcttatg

SEQ ID NO: 6540 - DNA, 197 bp, Zea mays
  Clone ID: LIB148-042-Q1-E1-F9
ggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaa

SEQ ID NO: 6541 - DNA, 276 bp, Zea mays
  Clone ID: LIB148-042-Q1-E1-G1
ctagtgtaacggttaaggcttccgagtagcacctcaaggtcctaggttcgatcccctcgggggcgaatttctggcttggttaaaaaaaattcctcgttgtgtcctgtccggcatccgctcccgggttacgtcctgcgtgcacccttcgggtgggctgtttgagagttagcggttacggccagggttcggggattttctcgaccgggatcatgtttcggtctcttcttaatataatatcgagagggcggtctttccctcccctgtcgagttttctgt

SEQ ID NO: 6542 - DNA, 205 bp, Zea mays
  Clone ID: LIB148-042-Q1-E1-G10
cacgcaaccggctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagc

SEQ ID NO: 6543 - DNA, 199 bp, Zea mays
  Clone ID: LIB148-042-Q1-E1-G11
aacctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgg

SEQ ID NO: 6544 - DNA, 182 bp, Zea mays
  Clone ID: LIB148-042-Q1-E1-G12
caggtccttccgctggaacctgacggcgagcgcggcgcggcccaacccgcaggggtcgtaccactacggccagatcaacatcacccgcaccatcaagctcgccatgggccgcggcaaggtggacggcaaggagcggttcggcttcaacggcgtgtcgcacgtcgaccccgagacccccgtca

SEQ ID NO: 6545 - DNA, 396 bp, Zea mays
  Clone ID: LIB148-042-Q1-E1-G2
cggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaacgtcacgtacgtggtggaccccatcggcaagggcgactacaccatcatcaccgcggcgctcgaggatctcgcggtgagcaacaccaatcgcgtgatactggatctcaagcccggagctcacttgcgccagaaactgatcctgaagatcaagaca

SEQ ID NO: 6546 - DNA, 325 bp, Zea mays
  unsure at all n locations
  Clone ID: LIB148-042-Q1-E1-G3
agcgcctcacgggatgcatgcagatcttcgtgaagaccctgaccggcaagactatcaccctcgaggtggagtcctcagacaccatcgacaacgtcaaaggcaagattcaggacaagganggcaatcccccaagaccagcagcgggtcaatccttgccggaaaacaacttgaagaacggcgcaagccttccgactacaacatccaaaaggagaacaacctccacttggtgctgcgcctcaagggaagcatgcagatcttcgctaagaccctgaccggcaaaactatcaccctccaagtggagtcttcaaacaccatcgacaatgtc

SEQ ID NO: 6547 - DNA, 418 bp, Zea mays
  Clone ID: LIB148-042-Q1-E1-G4
aacactctagactgagtcgtgatatgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggc

SEQ ID NO: 6548 - DNA, 412 bp, Zea mays
  unsure at all n locations
  Clone ID: LIB148-042-Q1-E1-G5
cccacgcgtccggacacttctaaggacatcaccgtgaaggatgtgaacatcacggcgcccgcggacgtcgagaacacggacggcgtccatgtcggcgggtcctccaatgtacgcatcaccaactcgaccattggcaccggcgacgactgcgtctccatcggccccgggagcgacggtgtcatggtgaacaacatcacctgtggccccgggcagggcatcagtgtgggctgcctaggccgctacaaggatgagaaggacgtgagcgacgtgacggtgcgggattgcgtgcttaggaacaccaccaacggcgtgcgcatcaagtcgtacgaggatgccgagtctgtgctcacggcgtcncatctcaccttcgagaacatcaggatggangaggtggccaancccatcatcatcg

SEQ ID NO: 6549 - DNA, 432 bp, Zea mays
  Clone ID: LIB148-042-Q1-E1-G6
ctcgcgggtcgacacacgcctctacaaagattctacatcatacacaatactgtgtcaatttatcagtatcaacagtgcagaatttccttagagttgcaataattatatccccaatagctcaattgaagcaatttaagcaacaaggacaatggggagccggacgtttccataaccataataacaaggttaaccttgtatagtaagaattgaacctttggatctaacaacaaacaacacatccaccggatgaggaaggatttcacctttgaggccaatcctcacaccgcggaaggttcctcgacgtccctcccccgtccgccgccaacgccaccgagcctgggcacatcgaggcctccaccgattccgtcgggcatgaacgaggcaggtcgattctcgatgacctcgtcgatgaggccccagtcgcgcgcctct

SEQ ID NO: 6550 - DNA, 262 bp, Zea mays
  Clone ID: LIB148-042-Q1-E1-G8
ctcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtgacaatagcaagaatccagcactcagaatttggtacagccacgcagttacaaattctgagtgctggattcttgctattgtca

SEQ ID NO: 6551 - DNA, 195 bp, Zea mays
  Clone ID: LIB148-042-Q1-E1-G9
cccacgcgtccgcggacgcgtggcaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactg

SEQ ID NO: 6552 - DNA, 370 bp, Zea mays
  Clone ID: LIB148-042-Q1-E1-H1
gaggggcacaggaggagtagctagcggagaggttgatgcgtgagggaggaggcgccatggacgtcgacatgcaagcccgcggtggcggtggtagccatggcggcgaacttgacgacgacggcaaggagaagaggacagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaccgactgctaccgcttcggcgaccctgccaccgggaagcgcaactacacctacactgaggccgtcgagtcctacct

SEQ ID NO: 6553 - DNA, 210 bp, Zea mays
  unsure at all n locations
  Clone ID: LIB148-042-Q1-E1-H10
cacgcatccgagacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatggt

SEQ ID NO: 6554 - DNA, 195 bp, Zea mays
  Clone ID: LIB148-042-Q1-E1-H11
gcgaaaggcaagggacgtaagaagtcgtctaattcttggatcgaattagacgacctcttcgtccctctcttcattaacaggctaacttgtaatcagcaggatctaagcatagacttgatttagttatggacggattggaaggcctcttgaaagttcgcgtggtccggggtatcaaccttgcctatcgcgacgcaa

SEQ ID NO: 6555 - DNA, 417 bp, Zea mays
  Clone ID: LIB148-042-Q1-E1-F7
ggaaccatagaccacaaaggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaatgacgacgacgtcctgtacaagtgcatcgacacctgctccgaggacatccaagaag

SEQ ID NO: 6556 - DNA, 194 bp, Zea mays
  Clone ID: LIB148-042-Q1-E1-H12
cacgcgtccgcccacgcgtccggacacgggcttcttccggcgcgagggcggctggagcacggagtacggggagttcttcatgagctggtactcgcagatgctcctggagcacggcgagcgcatcctgtcggcggcgacgggcgtgttcacggggtcccccggcgtgaagatctcggtgaaggtggccgggatcc

SEQ ID NO: 6557 - DNA, 401 bp, Zea mays
  Clone ID: LIB148-042-Q1-E1-H3
agcgtcactcgacgaactgaacgagggggtgaagccagggcagagcatgatgttcagctccggatcggagtacgactccggggccaactacgcggccaacatcagcaagttcaggaaggtggccttcgagagcagcgagttcagcaacgactacagcgggacaagcgagtacggcgccgactccggggacgcggcgacccagcggcagcaacatcgctgacctcctcgtccgagatgcgtgtgtggtgtacaatatttataccaaggggtcgatgtcgactgtcggatactatcagagatacccaaccctcgatcgtgacagctttagtacatgtaatgatgctcataaaatgtcatgtaacgtacgtatttgtgtgtgacatgttgctgcttgcttgact

SEQ ID NO: 6558 - DNA, 307 bp, Zea mays
  Clone ID: LIB148-042-Q1-E1-H4
ccttaacatcaaaaggccaacctacaccaacttgaacaagctgatctcacagatcatatcatctctaaccacctccctgaagtttgatggtgctatcaatgtggatgtcaccgagttccagaccaaccttgttccatacccacgtatacatttcatgctttcctcatatgcccctgtaatctctgctgagaaggcttaccatgagcagctctctgttcctgaaatcaccaatgccgtctttgagccctcaagcatgatggccaagtgtgacccaaggcatgggaagtacatggcttgctgcttgatg

SEQ ID NO: 6559 - DNA, 405 bp, Zea mays
  Clone ID: LIB148-042-Q1-E1-H5
gccgtgtatgcatggattgacaaagatgttggttactgccaaggaatgagtgatttgtgctcaccaatgatagttctactaaacgatgaagcagatgcattttggtgctttgagaaattgatgcgtagattgcgaggaaatttcagatgcacagatcaatctgtgggagttgccaaccaacttcaacaccttgcgtctattattcaggttcttgacccgaagctacatgaccacctagaaactcttggtggaggtgactacctttttgcgttccgtatgttcatggtgctttttaggcgtgaagtatcatttggagactccttatacctctgggagatgatgtgggctctggaatacgaccctgacattttcttcgcagcgtgtgaagaacaaggtgcagtaaat

SEQ ID NO: 6560 - DNA, 202 bp, Zea mays
  Clone ID: LIB148-042-Q1-E1-D9
ctcgcgggctgatagtttgctgcaaacatcatcttaatagatctggcttccttttgggtgcagtcagtttggtgtaggcaccatcagagccctgtgaaaaatagaagcactcacgcatggtagcagcttgttattgttgttagctgctgacgctttgaggcatgtcaacaagtagagatggattgcaaatcctaatcaatgt

SEQ ID NO: 6561 - DNA, 197 bp, Zea mays
  Clone ID: LIB148-042-Q1-E1-E10
gcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcac

SEQ ID NO: 6562 - DNA, 196 bp, Zea mays
  Clone ID: LIB148-042-Q1-E1-E12
cccacgcgtccgcccacgcgtccgccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggc

SEQ ID NO: 6563 - DNA, 366 bp, Zea mays
  Clone ID: LIB148-042-Q1-E1-E3
gtgggtcgatacaagactctacagtgagtcatacataaagcgttgaactcgcctaagcagctaccaaccaaccctagaaagctagacaccgtacccatggctcgcgctagcgtcgtctttgtcattgctgctctcctcttcgtcgccatggtcgtagcaccgatggccgaggcaaagtctgccgatgcccctgtggctgacgcgccggccgatggacctagcgggccggctgctgcacctggcccccagggtgtcgaaggcctgtcaggcaatgaggatgacgatgatgactccatgatttgaggccacacatgtctgcacggttaaatttggaacaagacatggaagaacaatgatagcaatgtc

SEQ ID NO: 6564 - DNA, 414 bp, Zea mays
  Clone ID: LIB148-042-Q1-E1-E6
ctcgcgggtcgatacacgcctctacagtcatctccctctatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaag

SEQ ID NO: 6565 - DNA, 404 bp, Zea mays
  unsure at all n locations
  Clone ID: LIB148-042-Q1-E1-E7
accccacaccttgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggncacgcgcaagtgcttctgcaag

SEQ ID NO: 6566 - DNA, 410 bp, Zea mays
  Clone ID: LIB148-042-Q1-E1-E8
acccacgcgtccgcccacgcgtccgctctgattgggcacggcagtggcacaccttcgtcttccttttgtttgtttttttcctttcctctttctgattttcatttaactaattggtatcgctgatgtaccagtttaatttggtgccccgttatttgttctttccctcgagagagggatcgacacctgtaccattgcttgccatttgtctggaccagttcaacaattcaatttaaccatcgcgtaaaaaaaaaaaaaaaaaaaaaaaaaaaaaaaaaaaaaaaaaaaaaaaaaaaaaaaaaaaaaaggaagaaaaaacaaaaagataaaaaataaaaataaacataaaaaaaaaaaaaggggcggccccccaaagggttcaaactttaattcccggtgcatcgaaattaaaa

SEQ ID NO: 6567 - DNA, 211 bp, Zea mays
  Clone ID: LIB148-042-Q1-E1-E9
gtccatacaactcactagaatgagtcgggctaacataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgc

SEQ ID NO: 6568 - DNA, 410 bp, Zea mays
  Clone ID: LIB148-042-Q1-E1-F1
cgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctcca

SEQ ID NO: 6569 - DNA, 192 bp, Zea mays
  Clone ID: LIB148-042-Q1-E1-F11
aatcctctcggcccaagttggccagctctccccgtcgtcgtccgtccctctcctcgtctccgcctccccggactccgtcagggagggagggaggtgaacgggccggggagagagatggggccggactcgtcgcccaagaagttgagcctcaaggagcagcgcgctgcctacctccagtggttcgccctcgcc

SEQ ID NO: 6570 - DNA, 425 bp, Zea mays
  Clone ID: LIB148-042-Q1-E1-F2
tcgtgggtcgatacaagcctctacagggactcctgctatgcctcgcgcgccgccgccggcacggccacccccgagaacgagcccgagcccttcgacccggtcatgttcttccagaattacatccatagcctcgttgagggaggcgccaacatccaggtcctcctcgacgacgccagcgtcaccctcggctccggacccggcctcgggcgtatcggcggggcaagctttggggattacttcgtcggcccaggcctcgaacaactcatcgagcagctcgccgagaacgaccccaaccgctatggcacgccgccggctgccaaatcggccctctcctcgctccccgacgtcctcgtgactcatgccatggtcgcagctgcggagggcgctgagtgcgccgtctgcaaggagggattctcgcctggaga

SEQ ID NO: 6571 - DNA, 372 bp, Zea mays
  unsure at all n locations
  Clone ID: LIB148-042-Q1-E1-F3
taccgccacatcaaccatgggcgcctgcgcaaccaagcccaagacgcttgaggggcaagccccagctgaggccgccgtctccacacccaaggttgcgcccgaggccactccaatctccgttgaagttgcggctgatgaacaggtaactgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagangaaaaggtcgccaccgccgccgagaccacgacgacngtggangcgaagaagaa

SEQ ID NO: 6572 - DNA, 418 bp, Zea mays
  Clone ID: LIB148-042-Q1-E1-F4
actgatcgacatagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaag

SEQ ID NO: 6573 - DNA, 195 bp, Zea mays
  Clone ID: LIB148-042-Q1-E1-B9
gcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcact

SEQ ID NO: 6574 - DNA, 373 bp, Zea mays
  Clone ID: LIB148-042-Q1-E1-C1
gggtcgatccaagcctctagagaaactcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaaaggatgcgggatggccaccttcgtgcaccgcaagtacagcgacaatgaggacagcgacatattcaagtgctacgacagctgctccgacgacgtgg

SEQ ID NO: 6575 - DNA, 216 bp, Zea mays
  Clone ID: LIB148-042-Q1-E1-C10
gtcggtcgatacaagccactagactgagtcgggctagcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgatgactacctgtatggcga

SEQ ID NO: 6576 - DNA, 223 bp, Zea mays
  Clone ID: LIB148-042-Q1-E1-C11
ctcgcgggtcgatacaagcctctaaaatgagtcatcataccttctacaacgagctccgtgtggctcccgaggaacaccccgtcctcctcactgaggcgcccctgaacccaaaggctaaccgtgagaagatgacccagatcatgttcgagaccttcaacacccccgctatgtacgtcgccatccaggccgtcctgtctctgtatgccagtggtcgtaccacagg

SEQ ID NO: 6577 - DNA, 406 bp, Zea mays
  unsure at all n locations
  Clone ID: LIB148-042-Q1-E1-C2
gcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacngtgaccgacctgtgcccgcccaaggaccaatggtgca

SEQ ID NO: 6578 - DNA, 395 bp, Zea mays
  Clone ID: LIB148-042-Q1-E1-C3
cgaccatccctgcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgccggcgaggcgaatcagctccggtcggcgacgctactggtcgtccccgacaaacttgccaagcctctggggtcgctgcccgccgataaggtgcgggcggcggtggagaaccacgtccttctcaattacttcgaccccatcaagctggacgagatgaagacacgcaccgccatcctccccacgctgctctccgtcaccgaaaagaaaactcggcgtcctcaactacacca

SEQ ID NO: 6579 - DNA, 401 bp, Zea mays
  Clone ID: LIB148-042-Q1-E1-C4
acccacgcgtccggtcccggagctggtccttcgtggagcggcccggcgcgctgctggtgatcgccttcctggcggcgcagctggtggcgacgtgcatcgccgtgtacgccaactgggagttctgcaagatgcaaggcatcggctggggctggggcggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgacaggcgcagtgggccacggcacagaggacgctgcacggcctcaaccaggccaacgccacctccgacctcttcggcgaacaccaggggtaccgcgag

SEQ ID NO: 6580 - DNA, 415 bp, Zea mays
  Clone ID: LIB148-042-Q1-E1-C5
cgccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaagatttctcaaggcaagaaagtttgatatcg

SEQ ID NO: 6581 - DNA, 406 bp, Zea mays
  Clone ID: LIB148-042-Q1-E1-C6
ggccgacggtctcggtctcgcaggggcagggctgggcggtcgacggaggccaattctccaacttcctccctccgtcgatcatccagcaccagcaggagaatcccgtcgaatccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttctgttataattactaccgagctactatctccacattattattggtaaagaaagaaagggcgcctcctctaatttgatgggcattccgtttccttctcaacttcaacgccaacaacagttgat

SEQ ID NO: 6582 - DNA, 400 bp, Zea mays
  Clone ID: LIB148-042-Q1-E1-C7
gacgcgcgggtcgatacaagcctctatagatagtcatcggacgcccttttttttttttttttttttttttttttttttttttttttttttttttttttttttttttttttttttccagattgccctcctttcgtaacactaatttgcaccatttacagaatcagctttagcttacagggactaaccaagtctgaaaaatatcagttaatgatgcaaagccagcatcgatgcatcataaacgatgactgaatgagccaggcgtgtgtgtttttataagctgagacgtaggaaaatgtacaagatcccatagaggggtgcctgatcaaggttgggagcttgcatcggaagtggcagcaggaggcggcgaaggcttgcttctttggcggctgagcaagttgtg

SEQ ID NO: 6583 - DNA, 199 bp, Zea mays
  Clone ID: LIB148-042-Q1-E1-C9
cgagacgctcttctacgcggaggtggacaaccgcggcgacggcgccgacatgagcaagcgcgccaagtggggaggcatcaagaccgtcacctacgaggaggcgcagaaggagttcaccgtggagaccttcatccaggggcagcagttcatccccaagttcggggtgccgttcatcccgggattgctgccgcaggagcag

SEQ ID NO: 6584 - DNA, 316 bp, Zea mays
  Clone ID: LIB148-042-Q1-E1-D1
actgagcctctgatgagagcagcagtaccgttggtcgcatcggcgacagcgggcggccggcggacgctatgtccgttgtggaggccgtggggcccaccgggcgcggcgtcatacgggcagccactgtgatgctgcggggcgaggaagatgaaggacgcgggcgtggtccaagaccaagaccacgaccacagatgcagggtcgtcgttgcggggtggtaagaacgccgcgctgttcctgctgaaaacagtggaggaagaggcggacgcggacactgaaacggcatccatcggcgcggcgtcccaagactgcgaccac

SEQ ID NO: 6585 - DNA, 194 bp, Zea mays
  Clone ID: LIB148-042-Q1-E1-D10
gccccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgc

SEQ ID NO: 6586 - DNA, 199 bp, Zea mays
  Clone ID: LIB148-042-Q1-E1-D12
caaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcag

SEQ ID NO: 6587 - DNA, 148 bp, Zea mays
  Clone ID: LIB148-042-Q1-E1-D2
gacaaggactacgttgtcaaggccgctgaggtcaccaaggcctgcaacaccacctgcgccaaggagaagcagcctctgctcagcgagaactgcaggaggtcctggcaccctcctccttcctgaacgcaaagcacgcccgccggtcgtc

SEQ ID NO: 6588 - DNA, 405 bp, Zea mays
  Clone ID: LIB148-042-Q1-E1-B8
gggatcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctccaacctgcagctgcaggaggaggaagcagcagctaccgcggggcgtgtaaccaaagcagaagaacaggaggcttctactc

SEQ ID NO: 6589 - DNA, 401 bp, Zea mays
  Clone ID: LIB148-042-Q1-E1-D4
actttcttcctcctcatcgtcctctcgaattccgtctcttgtctctgtcctcctcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccaggaacgatattcatgtcactgctttctggtgctctgtttgg

SEQ ID NO: 6590 - DNA, 337 bp, Zea mays
  Clone ID: LIB148-042-Q1-E1-D5
cttgtattctagcagcaaagcaaagaggatcggatcagaagaaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagattcgacctgc

SEQ ID NO: 6591 - DNA, 414 bp, Zea mays
  Clone ID: LIB148-042-Q1-E1-D6
acccatcgacgtctctgctaacgcgtgggcggactcgtgtgccggacatggcagccgacgatcaaccgccggaatcggcgccaccgcaagacggggaaggagaggacaactaggaggaatggaccgccaccaatatatatcacacacacacacacacactcacacattctcacactcaagtctgcgtttgccatttttcatttctttttctctacgacttcgttattccctcctttcatctatctctccgtgaactcggtttgtcgtccagctggctgtaagtgtaccagatgccttcgttacgtctgattaggctcatgacaatggcgattttggcatggagttgtgttagcctcgcggaaaaactgtgactgtgttagcagatatgctatatattgtccctaacatgttgtc

SEQ ID NO: 6592 - DNA, 197 bp, Zea mays
  Clone ID: LIB148-042-Q1-E1-A10
caagaggaggttcgtgaagctggccgacccgttgctgggcaacaggtacccagtgaaggcgctgtaccaggcgctcgccgtcgcgtccatgtgcctgcaggaggacgctgccagccggccggggatcagcgacgtcgtcgcggcgctctccttcctcgccgacccgcaatactaccctcccggaggcacggaagctg

SEQ ID NO: 6593 - DNA, 197 bp, Zea mays
  Clone ID: LIB148-042-Q1-E1-A11
ccaagggctggctcaagtggaacggcgacttcggcctcgagacgctcttctacgcggaggtggacaaccgcggcgacggcgccgacatgagcaagcgcgccaagtggggaggcatcaagaccgtcacctacgaggaggcgcagaaggagttcaccgtggagaccttcatccaggggcagcagttcatccccaagttc

SEQ ID NO: 6594 - DNA, 197 bp, Zea mays
  Clone ID: LIB148-042-Q1-E1-A12
gctgcgacgcgtccatcttgatcgaccccatgtcgaaccaggcctccgagaaggaggcgggccccaacatctccgtcaagggctacgacgtgatcgaggagatcaagacggagctggagaaggagtgccccaacgtggtgtcgtgcgcggacatcatctcggtgagcgcccgcgactcggtgaagctgtcgggaggg

SEQ ID NO: 6595 - DNA, 366 bp, Zea mays
  Clone ID: LIB148-042-Q1-E1-A2
ctccaccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttggttgttggatgctgagagattggttctcagctcagatgcaagctgcgcctagcctgtgtaggtttgtgctggtacattgagagctcttatttatttgctttgattgcaattaaccaggatgaccatagcccttgtttggtttgctgtttt

SEQ ID NO: 6596 - DNA, 397 bp, Zea mays
  Clone ID: LIB148-042-Q1-E1-A3
ctcaagactaggcggctcggtccaagcctccggttcaagaactgccacatcgtcacgcggcggcccatggacaaccagcagaactcggtgaccgcgcacggccgcacggaccccaacatgaagtcggggctcgtcatccagaactgccgcctggtgcccgaccagaagctcgtccccgaccgcttcaagatcccctcatacctgggccgaccctggaaggagttctcgcgcctcgtcatcatggagagcaccatcgccgacttcatcaagcccgaaggctacatgccctggaacggcgacttcggcatcaatacgctctactacgccgagttcaacaaccgcggccccggcgccggcaccagcaagagggtcacctggcctgggttccacgtcatcg

SEQ ID NO: 6597 - DNA, 397 bp, Zea mays
  Clone ID: LIB148-042-Q1-E1-A4
agccaagggcgacacgctgtacaccggctcggacagcaagaacatccgcgtctggcgcaagcagaaggactcgggagggttcaagtcctcgagcggcctcgtgaatgcgatcgtcatgtccggcgagcgcatcttcacgggccaccaggacggcaagatcagggtgtggaaggtgtcggccaagaacggcatgcacaagcgcgtcggcagcctgccccgcctgcgcgacttcctgcgcggctcgctgaacccgtccaactacgtggaggtgcgcaagaaccggtcggcgctgtggatccggcacagcgacgccgtgtcgtgcctgagcccgacggacccggcgcaggggctgctctactccggctcgtgggaccgcaccttcaaagtgtggcgcatc

SEQ ID NO: 6598 - DNA, 372 bp, Zea mays
  Clone ID: LIB148-042-Q1-E1-A6
aaaagaagcgattttgaacggctccgctagctaaagcagggcaaggcggccggacggcaggaaatccgtacgcacgccgaggtcgaggtcgaggtctcagcagggaggatggaaacggagcagcagggcgtggttgcggcggtgaagccgacgcttgccaaggggacgccgtcggcgtcgttccggctccgcaacgggagcctaaacgcggtgcgcctccgccgcgtgttcgacctgttcgaccgcaacggggacggcgagatcacggtggacgagctggcgcaggcgctggacgcgctgggcctagacgcggaccgcggcgggctggccgccaccgttggcacctacgtgcccgacggcgccgcgggcctc

SEQ ID NO: 6599 - DNA, 404 bp, Zea mays
  Clone ID: LIB148-042-Q1-E1-A8
gactcgcgggtcgatacaagcctctaaaatgactcgcggcagcccttttttttttttttttcaacgtcttttgtcaaattaacacaaatcaatggacgacatatatgacagatcaccgtggtcaaacaaattttgtcgagaatttaaatacgggtatatatatagagagaagctacgcacaacgacagcaatggcagtagtttttttcttttctttttggggtgtgtatgtgtaattgtgtatatatatactgtcgtagcgccaccgcctcctccaccgtccaacggcacgtacggccgcgacgacgacgtcaatgtatggtgtgcgatcggtggagccaggctgcgtgacctggcaggcaggcagaccataccagaccagaccgaccggctcggcgacaacgg

SEQ ID NO: 6600 - DNA, 198 bp, Zea mays
  Clone ID: LIB148-042-Q1-E1-A9
atcctcaccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgac

SEQ ID NO: 6601 - DNA, 196 bp, Zea mays
  Clone ID: LIB148-042-Q1-E1-B10
gccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcaga

SEQ ID NO: 6602 - DNA, 200 bp, Zea mays
  Clone ID: LIB148-042-Q1-E1-B11
ctctagaataactcatgggagatgtactcagaaaaagtcccgaagtaccgtgatactaaagtcaggatgaaggaacccctggagcaatttaaccaaaccaaggacgctagtgattacttatggtacaccacaagctttcgcttggagtcggacgatttgccttttagaaatgacatccggcctgtgcttcaggtcaaaag

SEQ ID NO: 6603 - DNA, 197 bp, Zea mays
  Clone ID: LIB148-042-Q1-E1-B12
gcaccatcaaggtcatggtctcccgcggccacatcgacggcaagctccgctacggcttcaacggcatctcccacagggacaccgagacccccctcaagctcgccgagtacttcaacgtcaccgacggggtgttcagctacaaccagatgggcgacgtgccccccgccgttaacgggccactccatgtcatccccaac

SEQ ID NO: 6604 - DNA, 406 bp, Zea mays
  Clone ID: LIB148-042-Q1-E1-B2
ctttgtgacgaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcgaagtatctgctgttcgtgtcagtgttggtttaataatggaccggttgtgttgtgtgtgcgtactacccagaactatgacaaatcatgaataagtttgttgtttgaaattaaag

SEQ ID NO: 6605 - DNA, 387 bp, Zea mays
  Clone ID: LIB148-042-Q1-E1-B3
cccacgcgtccgacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctc

SEQ ID NO: 6606 - DNA, 392 bp, Zea mays
  Clone ID: LIB148-042-Q1-E1-A1
gtctagatgagaagaaggcgagacgtgcagtccgtcgggctccgatcgagaacagggaagcaagaggctgctagagatcgagctcatcaaccaatcaagtcgtacgtcgtcagcatcacgcgaccggatggcgcgcgccgcgtccagctatgtatccaggagggggctctccgcagcgatgacggtggcggaggactccgtgaagaaggtggaggacaaggcggtgaagctgggaactgtggccaaggacatcgccagcgccatggccaccacgacggaggagaagacggcgttctgggaacctgaccccgagaccggatactaccgtccggtcaccggcacgaaggaggtggacgccgccgacctgcgcgccgagatgctcaagcggagga

SEQ ID NO: 6607 - DNA, 354 bp, Zea mays
  Clone ID: LIB148-042-Q1-E1-B4
gggtcgacccaagcctctacacagacgcctgccacgcgtccggtcgtcatcacactcagcccgccttcacgcctccctcaccaaatatagtcgcgccctttaccgacattcacaggggggacaggaaatcaaccgtcatgtcctcgattccagcgacgaccttcaccgtcatcttatacgtcatcatctgtgccacagcgggcacagccgtcaacttgtacctcctcgactacgtcatcaatagccccttcgactgcgacacctgccacgccccgttctcgaccaatgtcatcgaatatatcacggtctccaaagttcggctggacttcacacagttcggtaacgacaagctcg

SEQ ID NO: 6608 - DNA, 373 bp, Zea mays
  Clone ID: LIB148-042-Q1-E1-B7
actcgcgggtcgatacaagcctctacacagacgtcctgttacgcgtccgcgttcgtcaagcgcatgacggagccgggcgcgcgggaggcgtgccgggagcaggtggagcgggaggccgagggcgtcgcgcacgcgacccagcccctcgtgcacgaggccgccgtcgcgctcaccaactgaccggaccggccggcgttccccgtcgactgtgttcgatcgctagacggggtggcacgctgcgatgactacctgtatggcgagtccctatacttactcatacatgagctgcgccgccgtgtcgtcggtgcgtgcaccgcgcagtagtgtgcgtacagcggagagctgcgacggctagcgaggtacggtggtgggt

SEQ ID NO: 6609 - DNA, 377 bp, Zea mays
  Clone ID: LIB148-041-Q1-E1-G4
ccatgctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtg

SEQ ID NO: 6610 - DNA, 395 bp, Zea mays
  Clone ID: LIB148-041-Q1-E1-G5
agcatgtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgt

SEQ ID NO: 6611 - DNA, 426 bp, Zea mays
  Clone ID: LIB148-041-Q1-E1-G6
cgtcggtcgacacacgcctccaccgatacaccttggacgggcgccgcgcgtcgagggccagccaaagcttgccatggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctg

SEQ ID NO: 6612 - DNA, 297 bp, Zea mays
  Clone ID: LIB148-041-Q1-E1-G7
tcgcgggtcgatacacgcgtctaaaggaagtcatctcaagccagtagcactaacagactggtgataggtagacatgatatgttacttcgctggcgaaagttttcatgagtcagcgctatttggaggggattttaacattcattctttggtgtagagccattcgtcttattattacatcatttaattcattcttggtaaaaaaaaaaaaaaaaaaaaaaaaaaaaaaaaaaaaaaaaaaaaaaaagaaaaaaaaaaaaaaaaaataaaagaaaaaaaaaggggggcagcccaagaggt

SEQ ID NO: 6613 - DNA, 404 bp, Zea mays
  Clone ID: LIB148-041-Q1-E1-G9
aacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatccagtcacggtgttcatcacagacatgaactacgaacctatcgctccctaac

SEQ ID NO: 6614 - DNA, 373 bp, Zea mays
  Clone ID: LIB148-041-Q1-E1-H1
agaccgttcaggatcaacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctcc

SEQ ID NO: 6615 - DNA, 336 bp, Zea mays
  Clone ID: LIB148-041-Q1-E1-H10
tcgcgggtcgatacacccgacttagtggcgcccagctcccgcatcttcgggcgccgcgaactggtgaaggaacccgaccagattgccatccggtacctgaagaacgacttcatcaacgacctggcaaccatgctcccgataccgcaaatgatcaaccgggttgttaaaccaactgtgaatacatcctccggcaatcacaacaacaacaacaagctctccaagattgtgccgattcaattcataccaagaatccaacccaaaataacccttaactccaaaattgttcaaggcaattgaattggtaacaaaaattgcctgggcgggggcggcttaaaa

SEQ ID NO: 6616 - DNA, 376 bp, Zea mays
  Clone ID: LIB148-041-Q1-E1-H11
aagactctgaggtgactcgtattaagctgctcggtgagtacggtgtcacagtcactccgtgtaggcagtgccatttcgaagacaatattgcaaaatttaactaacttggatttacagtgcgtttggttggaagtaaaaataataaactggattgtaataccaactataaataaaatcacagaaaaatcacaacaccaacaaaaaaactctcaatgatcgtgctgatcaaatacataccaagagtcaatctaataatatccttgaactcaaagatagtcggggcaacctccagtggtgaccagataagcctgcgcgagggcggagtacaacctgcttctctacacgctggcaatccatgtcctcggtgctctctgaa

SEQ ID NO: 6617 - DNA, 360 bp, Zea mays
  Clone ID: LIB148-041-Q1-E1-H12
accccagggtctccgaaccaaacaacttcccggttaaccaagggtttcaacaaatggccttgtgatttttgcgggcaaccctggtcaaaagaaagctaaggtctcagaactaccaaaatttggaaaaccggcaaaactgcggagttcctcgtggtggacaaaatactttgtccaaactggcttaacagagaacgaacggccactgaagaaatttgaagaggctacatcccagaacatataccaaccagattgtcagatcttccacttaagttcgccaaggtgatgcgcatccagaacaccttgggttgttgtcagttgtcacatcagttctgtaagcagcacctttgcttacccctgttg

SEQ ID NO: 6618 - DNA, 399 bp, Zea mays
  Clone ID: LIB148-041-Q1-E1-H2
accaaacgtctgcccacgcgtccgcgaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatggg

SEQ ID NO: 6619 - DNA, 408 bp, Zea mays
  Clone ID: LIB148-041-Q1-E1-H3
cagacgcttgggtcacaccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggaagtgcaggcacttcggcaccggcaagctcgagcgcgccatcgacggggtcaccgacgcgaccggcacctacacgatcgagctcaaggacagcca

SEQ ID NO: 6620 - DNA, 410 bp, Zea mays
  Clone ID: LIB148-041-Q1-E1-H4
ttcgcgcgtcgacgcatccggcccaggtcatgaaactggagtcgcagggcgtgcccaccaagcaggcggaggcgatcacctccgccatcacggaggtcctcaacgacagcctcgagagcatctccgagtccttcgtctccaaggccgagatgcagaagagtgagatgctgcaggagtccaatatctccaagttcaagtcccaagtgcagagctcgcaggaaaaccatttctctttactacagcgggagactgagaaacttcgcggagatattgataagatgaggagtgaactgaagtatgagatcgacaaggtcaccgcaggacagcgattggatctgaatcttgaaagagggcgcatacgtgatgagcttgccaagcagaatgaggaaaccactgagcttaccacaaag

SEQ ID NO: 6621 - DNA, 385 bp, Zea mays
  Clone ID: LIB148-041-Q1-E1-H5
gcacgccctccgccaacggccggatcgacagcaccgatcaccctgaccgtctgcgcgcggcggctctcacacaccggcgacacgcagggcgcgcataggcgagggcctcccccccggcgagggatggtgtggtcggctgggatggcaacaatgcgaggcgcctccgccgccgcgctactggtgctggcgctcgccgccgccgtggcgcgcgcggaggacccctaccacttcttcgagtggaaggtgacgtacgggacgaggaccatcatggggacggcgcagaaggtgatcctcatcaacgacatgttcccgggccctaccatcaactgctcatccaacaacaacatcctcgtcaacgtgttcaacatgctcgagcagccgctcc

SEQ ID NO: 6622 - DNA, 398 bp, Zea mays
  Clone ID: LIB148-041-Q1-E1-H6
agcatgatccacttcacgcagctgttcatggagaaggggagctacaaccacatgaacaagaagagcccgtcccaggaggttctgccggacgtggctgacgaggagcaaccgccggaaccagcgccaccgcaagatgagaaagaagaggacaactaggatcggagcgaccaacaaccacccatgcatatatatcacgcagactgaagtctacacgtttgccatatttctttacgacgacgacgcttctttattccctcctcccttttttttcctcttaatctctctgtgaacccggtttatcatcacgctgcaatcaagtgtgccagatgccttcgttacgtctgaggctcacgacaatggaaaatctgacatggacctgtcttagcctcgccgaaaaa

SEQ ID NO: 6623 - DNA, 396 bp, Zea mays
  Clone ID: LIB148-041-Q1-E1-H7
tactactccctgaggtgagtcgtattataccctgcttcacacaaacagtaaggatcagtctcggccttttgctcaggcatccacaggggggattgggaaaacacttgcatgcatccggcggcaataatggcatcggttccggctccggcgacgacgactgccgccctaatcatatgactatgcgtcctcctctcctgtgccgcagcctgagtacctaaagctccccgactacgtcatccagggcctcgtgtactgcgacacctgccgcgccgggttcgtgaccaacgtcaccgactagatcgcgggcgccagcgtgatgctggagtgcatgcacttcggcaccggcaagctcgagcgagccatcgacggcgtcaccgacgcgaccggcacctacac

SEQ ID NO: 6624 - DNA, 390 bp, Zea mays
  Clone ID: LIB148-041-Q1-E1-H8
gagacacttcatcgcctccatcccatcccgccgccgccgtctctacggtcgctaataagccgccgcatccaccgatggagatgaagaagatcgcctgcgccgtcctcgtcgccgcctcggccaccgtggcgctggacgcggaggcgccggctccgtctcccaccagcggctcctccgcggtcgcacccgccatcgtcagggccgccgtggcctccttcttcgcgtactacattcactgagccgccggacgatgagcctgatccggagggaagagaccaatgtggggggagagacttggctgcgctgcgctgctctgctgctcacgcgcattcgcgatgcgtgggcgtgctctgattgggcacagctgtggcagtggcacaccttcggcct

SEQ ID NO: 6625 - DNA, 278 bp, Zea mays
  unsure at all n locations
  Clone ID: LIB148-041-Q1-E1-G3
cccacgcgtccgcacacgccttcttccgcgtagtgcttggtgatcactttggcggcgatgtttggtggtgctatgtagcggttgccctcaagtactgtgttgtggcattgttacacatcacagtacagtttggtcaaattttttttccacagaggaagtanggattgatttaatcattgatttaatcccacacgcgtgtatctacgtatacagtttgtataacatgaaccacctctgtttgcgattggtctaaaaataaatataatacttatatattg

SEQ ID NO: 6626 - DNA, 395 bp, Zea mays
  Clone ID: LIB148-041-Q1-E1-E3
tgcacgctcacgtcagatcaccggggcgggctcagcatcctttcaaaaaattaacacttctccgtgaggcctgaccccctcgccgcggtgagccaacccggcgcacttcgccccggggctcacgctcacaaccgacccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgttacagaccgacc

SEQ ID NO: 6627 - DNA, 415 bp, Zea mays
  Clone ID: LIB148-041-Q1-E1-E5
caggacctggactcgcgggatcgacacacgcctccacaatgcgtcgaacgacggggtgttggacgccatggcggtgttgcggatgcaggtggacgcgttcaacaagcgcaccgaggcggcgagggcgcacgtcaaggaggccgccgtgacggcgtcccccaaggcgcggacggtgctggacctgtgcaacaacctgtacctggacgtggaggacaacctgggagcctgccgccgcgccatcggcttcaaggacgccgtcaccatccgcgccaccatgggcatggcggcgcaggacatgcagaactgcgacgagcagttcaggcagatcggcgagaagaaccccatggagcagttcgacgcgtcgctcgtcgagatgtccgagaactgccgctcgctctccaacatgatctgatcg

SEQ ID NO: 6628 - DNA, 139 bp, Zea mays
  Clone ID: LIB148-041-Q1-E1-E6
tgagtcgtattaaggggtgttggacgccatggcggtgttgcggatgcaggtggacgcattcaagaagcgcaccgaggcggcgagggcgcacgtcaaggaggccgcggtgaccgcctcccggagggcgtgaaccgtgctg

SEQ ID NO: 6629 - DNA, 388 bp, Zea mays
  Clone ID: LIB148-041-Q1-E1-E7
gtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaagacat

SEQ ID NO: 6630 - DNA, 401 bp, Zea mays
  Clone ID: LIB148-041-Q1-E1-E8
aagccgaattgcgagcgagcgttcctctccgtccgcttccgccgtttgcccgtcgatcagttgttggctgccggccgggtactaccgcctgcacgagcagcggctagccacagcccacagacagacgacgtcaggtcttggcaggtgtgcaagcagacagagctcgctcggtcgccatgtctttcaccggcacgcaggacaagtgcaaagcctgcgacaagacggtccacttcatcgacctgctcaccgccgacggcatctcgtaccacaagacctgcttcaaatgcagccactgcaagggcgtcctctcgattagcagctactcttccatggacggcgttctgtactgcaagacgcacttcgaacagctcttcaaggagacagggaacttctccaagaaa

SEQ ID NO: 6631 - DNA, 392 bp, Zea mays
  unsure at all n locations
  Clone ID: LIB148-041-Q1-E1-E9
cacacgacgtctgcccacgcgtccgcattgggagatttggctgaacactcacagttcgggagcagcaattccctaccagagttgggacctgatgccacacaagatctagccttctaccaaagaagcaactccgaacagcaatggagctggtctgggtctgttgcaacggaggattccgatgatttcgaggttgcaactaattgctcgttagagctggactgcgtgaggccatctagtgccccaaaagcttcaggtttatcaaatggagggggcacagctgtaaaaaagatccaagtcaagggttcaaaaggttcagacgttaggggagtgaatcctggaaaaaggtcatcgccattacagaagaagccgagtggaccctcancgacgctaat

SEQ ID NO: 6632 - DNA, 329 bp, Zea mays
  Clone ID: LIB148-041-Q1-E1-F1
agtcggactaccggaggccgaggaagagacgaagcgggagagagagtgacatggctgcgcgcattccgatgcgtgggcatgtttttgattcgacacaccttttgtcctctttttctttgttccctctttctccttaatttaacgaattgatgcatgccgctgatgttcttccccctgagagagggattaacacttgtatcatcgcttgccatttgtttgaatccattcaacaattcgatttataaaaaaagaaataaaaaaaaacaaagtaaagcaaaagtgaaaacacttcaacaagatgaattctcgaacggtccaccgaaggggtg

SEQ ID NO: 6633 - DNA, 306 bp, Zea mays
  Clone ID: LIB148-041-Q1-E1-F12
gtacaacgaataggagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcctgctggcgctggcgctggcgctgccgccggcgctgtcgctgcggggccc

SEQ ID NO: 6634 - DNA, 379 bp, Zea mays
  Clone ID: LIB148-041-Q1-E1-F4
aacacgcgtccgcccacgcgtccggacgcgcaccaggggaggaagcagttcctgcaggaggtggaggtgctcagctgcatccgccaccccaacatggtgctcctcctcggcgcatgcccggagtactgctgtctcgtgtacgagtacatggaccacggcagcctcgaggaccggctgttccgtcggggcggcacgccgccgctcgcgtgggcccagcggttccggatcgcggcggagatcgcgacggcgctgctgttcctgcaccaaacgaagccggagccgctggtgcaccgggacctgaagccggccaacatcctgctggaccgcaactacgtgagcaagatcagcgacgtcgggctggcacgcctggtgccgccgt

SEQ ID NO: 6635 - DNA, 382 bp, Zea mays
  Clone ID: LIB148-041-Q1-E1-F5
ggctggttcgtggatggcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgatgtgcgctgcgtggacagccccagcgggtgcaagcccagcgcggcggcgctggtggtg

SEQ ID NO: 6636 - DNA, 410 bp, Zea mays
  Clone ID: LIB148-041-Q1-E1-F6
ccggcctgtgcatcaggtcaaaagtagtgcacactcaatgatgggatttgccaatgatgctttcgtaggatgcgcacgtggaagcaagcaggtgaagggtttcatgtttgaaaaacccgttgatctgaaagtaggtgtgaaccatgttgtattgctgtcgtcaactatgggaatgaaggacagtggtggtgaacttgctgaagtaaagagtggcattcaggagtgcctaatccagggtctgaacactgggacgttggatttacaagtcaatggctggggccataaggctgcactggaaggtgaggacaaggagatctactcagaaaaaggtgtgggcaaagttcagtggaaacctgccgagaacggccgggcagccacttggtataagagatacttcgatgagccagatg

SEQ ID NO: 6637 - DNA, 378 bp, Zea mays
  Clone ID: LIB148-041-Q1-E1-F8
acagacactcgtgtcatctcgccatcggccatcgctggctcatgatcgagccgcacgaccgaggcatcacgtgagtcgcacacaccaccatgcaagccacgcgtcaggccacggagggggacgcacatgagcacgcggtgagggctgaggctgacgaggtgaagacggaggtggcgaacgcccacgatgaggatgaggcggtgcctgatgagaaatacgtggcggttgtaggggaggacgcggatgccgatgcggacacggagacagagactgaccgcgaggcggaggcataggtcgaggccgaggtggaggtcgaggtggaggcggaggccggtgcatcgtctgcgaagaagaagcgtatccaggtgtccagcaaca

SEQ ID NO: 6638 - DNA, 415 bp, Zea mays
  Clone ID: LIB148-041-Q1-E1-F9
acgcatccatggccctcgcgtgcgcgcccataccgctcccgagtccctaggacgcggcacgcacccttctcgcgggcgcgggcgcgggcgcggggcgcgggagcaggcatggcgtcgcaggtcgctgggtcaaccccggcggtggcggcgcttgggttccttctcccgaccttctgggagatcgaggtcacgtgcgccgccgcgatgatcctcgtggcgctttacgttgcctacgagctcctcaacccgcgctcctcgcaggcggcagcggcgggcgacgccgacgagctcctcgtgcgggggctggacggcgccgacaagttcaaggggggtgtgagcggcccctctgcctatgtagtgaagctcgaattgttggctgcaaaaaatttgatggcggcgaacttaaatgggacat

SEQ ID NO: 6639 - DNA, 344 bp, Zea mays
  Clone ID: LIB148-041-Q1-E1-G1
tgcacaactttgaaccagaaagggatgatatcgcaaatgatatcatcaattggttgagcgcaagacttagtgttcttcagagatggtgagctgaatcaagtatgaactacaaggtgcttccccttatgtagttaccggcggttttactggaactgtatacatggcatagagtgcagaatagtgtaaatgtaaactaggatgttatcattatgtcttcacggtcacggtcatttcttgtcttcagctctgctgtataagtttgggaagagcctacatgagatgtaaataatattagagttaagctgaaaataatgtatctcctaatacaaaggtagttcagtgtc

SEQ ID NO: 6640 - DNA, 364 bp, Zea mays
  unsure at all n locations
  Clone ID: LIB148-041-Q1-E1-G10
aggaagcgtgggcangagccggggagatgtggagaccccgcgacaaggcaaaaaaaaggagcggcgctgcatcaagcaggctcctcgacccggcgttcaagccctccaaactatcccaggaccggctcgacaagtttaaggaattacacaagaaacggttacagataactgaaaagccgaagtataaaagaaaactgaaaggaaccgctgggagaagtaccaaagtaaccagtgattacaaattcactaatacggatgcatctgctgatagttctccaagagatgtacatcatacgtcatcaattacaggaatccaaggggatcctgcatcangcctgtcctcgangaacaaaagaaagctaca

SEQ ID NO: 6641 - DNA, 180 bp, Zea mays
  Clone ID: LIB148-041-Q1-E1-G11
tgcgcgcacagaacgtcaacccgtacgcagacgcagacgctgacaccgcccacgccaacgctaacgccaacgccaacgccagcgccagccttccggagccgccactcctctacgacgtcggaaacccgtccgcgttgcactccagcataccgtcactgtcacaaacagcctcgcactctc

SEQ ID NO: 6642 - DNA, 386 bp, Zea mays
  unsure at all n locations
  Clone ID: LIB148-041-Q1-E1-G12
gtgggtcgatacaagactctacactgacgtcctgattacgcgtccgcccacgcgtccgctcggcggcggtgttcaaaaactgcctcatcatcacccggcggcccatggacaaccaccagaactcggtgacggcgcacgggcgcaccgaccccaacatgaagtccgggctcgtcatcaagaactgccgcctggtgcccgacaagaagctgttcccggaccgcttcaagatcccctcgtacctgngccgcccctggaaggagttctcgcgcctcgtcatcatggagagcaccatcgccgacttcgtcaagccagaagggtacatgccctggaacggcgacttcgccctcaagacgctctactacgccgagtacaacaaccgcgggccc

SEQ ID NO: 6643 - DNA, 281 bp, Zea mays
  unsure at all n locations
  Clone ID: LIB148-041-Q1-E1-G2
ggggggggnggggnggggggggngggggggggggggggggggngggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggngggggggggggggg

SEQ ID NO: 6644 - DNA, 370 bp, Zea mays
  Clone ID: LIB148-041-Q1-E1-C7
cggtcgcttggggcagtcggcgctgcggcggggaggggcgtccgcgaggcaggtcgcgttggcgggagaagcctcgccgagagacctcctccggatgcgcgtggcggagcgggagcgcgcgaggcggcggcgtcgcgacccgggccgcgacgagttcttcgtgcccacgccagagtcgctggcgtggctcgactcggtctccctccccatggtgctcaccgccgccgccgtggccctcttcaccaagctcctcatgatggaacatgaagctacagatcaagaaaggagagagcgcaagataaagaatagccaccctgatcaaggaacagtaaggatgctatctcgtgaagaatgggacgaggtccaagaa

SEQ ID NO: 6645 - DNA, 376 bp, Zea mays
  Clone ID: LIB148-041-Q1-E1-C8
cgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttctcgacagagtcaacgctgctcct

SEQ ID NO: 6646 - DNA, 375 bp, Zea mays
  Clone ID: LIB148-041-Q1-E1-C9
accacgcgtccgcccacgcgtccgcccacgcgtccgtcgagctccggcgggcgggccatgcacgcgtccagctagctcacacagcgccgtctcgaccggctgccggtgctccacccggcccgcgtccacatcacggcgggcgggcgcgcgcgtgaacggtttcctctccgcatgaccctgtgatggtcggtgggttcctgcggcgcggccacagcctcgacaggctcctgtcgaggaggcgccgggccgtttcgcccagcccctcgttctcgtcctcctcctccacgccgtcgtctccgcgtggcagcagcgtcaggagcggcatgatggcagaggacgacgacgacgcgcccaccaccgtggcggcgccaccgc

SEQ ID NO: 6647 - DNA, 267 bp, Zea mays
  Clone ID: LIB148-041-Q1-E1-D1
aggagacggcgcggcgcctgggcatgggcagcaacatgtacccgtccaccaccctgctgggcgacaacaagaccggcgagatgggcggcctgaacatcgacgagctgatcgagaaggccgacgggttcgcgggggtgttcccggagcacaagtacgagatcgtgaagcggctgcaggaccggaagcacatctgcggcatgaccggggacggcgtgaacgacgcgccggcgctgaagaaggcggacatcggcatcgcggtggacgacg

SEQ ID NO: 6648 - DNA, 333 bp, Zea mays
  Clone ID: LIB148-041-Q1-E1-D10
gtcgtattagataccggcatggagctctggatgtggaacattagcgaatggcagcgttcctatcaatggacaatcttcccgaacacactgttgctggacttcgtggcgaatgcccaaatccgcaggatctcactgcggagtagcaggttcttcgacatgaacatcttctcgagcaagaacgtggtgatgtacaatgtgaccatcaaggcccccggaaaaagccccaacacggccagcatcaacatcagcgactcgatcaacgtgacgatcagtggcaccatcatcaccctcggccacgactgcttctccatcggccccgggaacaagaccatc

SEQ ID NO: 6649 - DNA, 363 bp, Zea mays
  Clone ID: LIB148-041-Q1-E1-D12
taaaataaataggcacacaagaacaaatacctcgctaccaacaatggcctccaggtcctccatcctacttgcaacgtcaatgctggctgcgctgtttgcggttggtttgtgcacaaccccgctcaccttcaaggttggcaagggatccaagcctggccacctgatcctcacccccaatgttgcaaccatatccgacgtggaaatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctga

SEQ ID NO: 6650 - DNA, 413 bp, Zea mays
  Clone ID: LIB148-041-Q1-E1-D2
caacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatacgaggtcgcggcggggcgccgcgacggcatgcgctcgaacatggacgacctcccggggcaacttccccgtgccgggccaccacgtgccgcgcctcaccgagctcttcagccagcgggggctctcc

SEQ ID NO: 6651 - DNA, 379 bp, Zea mays
  Clone ID: LIB148-041-Q1-E1-D3
aaaaccctgcgtgtacgtgtcaaccgacccctccccctgcgagcctgcgacgagtctcctgccgctcttcccggccgggcgaaatggacggtgtcgttgtcaggagggtcatcccttcggataacagttgcctcttcaacgctgtgggctacgtgatggagcacaaccgaaataaggcttctgagctcagacaggtcatagcagcaacagtcgctggtgatcctgagaaattcaatgaagtgtttcttggcaaaccaaatgaagcgtattgtgcttggattttggatcctgaaaagtggggaggagccattgagctctctattctatccgaatactacgggcgtgaaatcgcagcatatgacattcagaccactcgctg

SEQ ID NO: 6652 - DNA, 394 bp, Zea mays
  Clone ID: LIB148-041-Q1-E1-D4
agcgatagtcggagcatgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgcc

SEQ ID NO: 6653 - DNA, 381 bp, Zea mays
  Clone ID: LIB148-041-Q1-E1-D5
cacacgcttccgcccacgcgtccgcccacgcgtccgataaacatcatggggcaagcctcacggctcgtcctcctcgccgtcgtggcgctgctgtccgccggcctcctcccgcaggcgctgggtaagggtaggggatgcaggggacacggtggcgccgtcaacccgcaggtcgccggcatctgctctcgcaccccgttcccggaggtgtgcacgtccaccgccgggcggcacgcgtcgaagtacccggtcatcgacaacctggccgtgctgaacatgcaggtggacgcgttcgccaagcgcaccgcgcaggcgcgcaagcacgtcgcgacgtcggcccgcaccatcccgccgcagcagacgcatgcgctcacgttctgcgac

SEQ ID NO: 6654 - DNA, 407 bp, Zea mays
  Clone ID: LIB148-041-Q1-E1-D6
ggctagttcgtggatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaagtgcggtgcgtggacagccccagcgggtgcaagcccgacgcggcggcgctggtggtgacggcgaaacgactgtgcccgccca

SEQ ID NO: 6655 - DNA, 270 bp, Zea mays
  Clone ID: LIB148-041-Q1-E1-D7
cccacgcgtccgacaacaaacaatgccatgatgaaatacatagtagaggagacctcttgtcagtcacccatacgagcattgattttcactgatgcccctgtatatttcgtatcacttattatgtagatgtacatgtgatggattttgcattgtggaactgttaaaatgaaccgacatgagatgccaaatctttgcaccaaacagtatgatgtattgctgatctgatttttttgcatcaaatgtatatctaatataccatattttttgctt

SEQ ID NO: 6656 - DNA, 404 bp, Zea mays
  Clone ID: LIB148-041-Q1-E1-D8
ggctaattcgtggaaggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaagtgcggtgcgtggacagccccagcggggtgcaagcccgacccggcggcgctggtggtgacggcgaaacgactgtgccca

SEQ ID NO: 6657 - DNA, 396 bp, Zea mays
  Clone ID: LIB148-041-Q1-E1-D9
ctcagccatccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacat

SEQ ID NO: 6658 - DNA, 354 bp, Zea mays
  Clone ID: LIB148-041-Q1-E1-E10
atccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcg

SEQ ID NO: 6659 - DNA, 194 bp, Zea mays
  Clone ID: LIB148-041-Q1-E1-E11
gaaaatcgcccgctcctgttctgcatcggataagctccttctgtgattgcaggctcacgcttcaccggtctgactgcactctcagagatagtacagtggcctttgtcagcacctgtgaagatgtcaatcgtctctgaatgatcaggacggtcctactcgcctagaacaggtacttgcactacgtgacgctcacc

SEQ ID NO: 6660 - DNA, 390 bp, Zea mays
  Clone ID: LIB148-041-Q1-E1-C6
ctcgggctaggctagctagctaggttaccactctggtacaacatggctggtgatggcatggaggtatctgccagcgggggtggcggcggcaacaagcagccgcagatcagccttttggggctgttcctcgcctgcatggtcgccggcggcgtgcagtacggatgggcgctgcagctctcccttctcaccccctacgtccagacactggggattcctcatgctcttacatcagtcatgtggctctgtggacctattgctggcttacttgtacaaccctgcgtcggcctctatagtgacaaatgcacttctaagcttgggagacggaggccattcatctttacaggatgcatcatcatctgtatatctgtgatagtcatcggtttctcctca

SEQ ID NO: 6661 - DNA, 387 bp, Zea mays
  Clone ID: LIB148-041-Q1-E1-B10
caccacgcgtccgccagcgagcgcgctcgggagatgccctgcaggcacaggttccactccaattgcatcgttccgtggctcgagatgcacagctcctgccctgtctgccggttccagctgccggccaccgacgacaagggctcatgcagcagcggcgacggtggttttgtcagtgtcgatgcggatggtgaaggcaatgacaacggcggcggtgatggtagggcaagtattccaggcaatgcggagccagccgaagccgaagagaacggcagccggttgccgccatccttgcagtggctcaacagcctgttctcgccatcggcgcagtcctccggtagcggcagcggcagttcgcatcattgggaagaatgagcaataatgcaatat

SEQ ID NO: 6662 - DNA, 387 bp, Zea mays
  Clone ID: LIB148-041-Q1-E1-B3
aaatggctctcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaact

SEQ ID NO: 6663 - DNA, 416 bp, Zea mays
  Clone ID: LIB148-041-Q1-E1-B5
tcgtttgatcaatacaactctctaaagtgagtcatattatcatactatgtagttcctaatattacttggtactcatcacaggaagaaaaacatgaaattgttgaacgttacaaggccaaactcaggtctattgattgtaagcactttgacttcgaaaagggcacttgtccatttggaagcagctgtttttacaagcatgcctactatgatggccgtttggaagacgctttattgaatcatcatgatgccgacgatgcaagcgcagctattgccaaacttatgaagttgtcgtacatactgactcggctacatgtgtaatgaaactcaaacgtatccttgatcaaacatgctgacttcgattgagattctttgaccgagcatgcaaacttagatttcgcattgtaatggataatatt

SEQ ID NO: 6664 - DNA, 378 bp, Zea mays
  Clone ID: LIB148-041-Q1-E1-B6
ctccccttcccctgctcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaagagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctg

SEQ ID NO: 6665 - DNA, 405 bp, Zea mays
  Clone ID: LIB148-041-Q1-E1-B7
cggacgcgtgggcggacgcgtgggggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaaaggtgtggcgatcaatttcgtgcgcaaagatgacatccgtatactga

SEQ ID NO: 6666 - DNA, 407 bp, Zea mays
  Clone ID: LIB148-041-Q1-E1-B8
gcgatcttcatccaaccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaagcataatatataaacggccaaatcacatgtattttg

SEQ ID NO: 6667 - DNA, 401 bp, Zea mays
  Clone ID: LIB148-041-Q1-E1-B9
ggtcggccacgcgtccgcgctcgtttctcattcagcgcccgtacagccaccactcaaccgagccatatcgaaagttctcaacatcgcttcgtgcagcctgcatcgatcgacgagggctgcacgaacgatggggtccgcctccgcctcagtgatgacgaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggctggagtcgtgcagaccgacccccgctgcctctgcatggtcctggacggcaccgccacgtccttcggcatcgccatcaaccaga

SEQ ID NO: 6668 - DNA, 405 bp, Zea mays
  Clone ID: LIB148-041-Q1-E1-C1
ctctagaataaggctaaggcaaactgttcttggcctggatgcaaatggttaatctatggttccaagactaccagatcagattggtttaaggttgtcacttttatagatgagcattcttgcccacctaggagagacaataggttagtaacctccaacataattgcgaagcattatttcagtgagattaaggacaatccaacatgaaaagttgagttgataaagaaagctgttctaacaacatgtgtgagagttttaacaactccatcatggatgctaggtactatccagtcatttccatgtgtgaagccattagaaagaaggttatggtgaggatacaagagaataaggccaaggctgagaagtggacaggaacaatctgtcctaatatcttcaagaaattaaaaa

SEQ ID NO: 6669 - DNA, 389 bp, Zea mays
  unsure at all n locations
  Clone ID: LIB148-041-Q1-E1-C10
taaactgcatcatcatcaagaccatggctatatgcacgaacgccaagggcagcaccaagggttgcctcaaggagcttgcatgcttcaaaaccctccttcgactgacccatctctctagttataatttttctcccgtccttgcattgccaattacatgctatccattggtaacgcacaacagtaaaatgacatacatccgacagctatattatgttcgacggtgtaacaccctgaatttgacggtataaaattttttctctaaataccaaccaaattcacgtgttaactcttgtctctctctctctcacttttccttttgattanaagtaagtgaattacgcgaaggtttaattatttattttgtcaaaacttaggtgaatcatgaaatg

SEQ ID NO: 6670 - DNA, 412 bp, Zea mays
  Clone ID: LIB148-041-Q1-E1-C11
gcgggtcgacccaagcctctacacagattcgtaggataagggctcccctaatttaagccctacattgaaaattggttttggtcatcatgcgtgtgatgacaaaaattgtggcaatgcagattatgttgatgatcttgatgacatttcccaagaagatacctgtggtagttctgatcctggcaatggaattgcggaagataaatttgaggtcaatggatctgctcaaataaagcgtccagaatttcaaaagggtgtcttacgtacaaactgtatacattgtttggatcgcacaaatgttgctcaatatgcctatggcctagctgctttaggacaccagttacatgcacttggttctgtagaatcgccagaagttcatctagactctcctttgtctcgacatttgatgcatttt

SEQ ID NO: 6671 - DNA, 372 bp, Zea mays
  Clone ID: LIB148-041-Q1-E1-C12
tggcattttggtgcttagagaaattgatgcgtagattgcgaggaaatttcagatgcacagatcaatctgtgggagttgccaaccaacttcaacaccttgcgtctattattcaggttcttgaccccaagctacatgaccacctagaaactcttggtggaggtgactacctttttgcgttccgtatgttcatggtgctttttaggcgtgaagtatcatttggagactccttatacctctgggagatgatgtgggctctggaatacgaccctgacattttcttcgcagcgtgtgaagaacaaggtgcagtagataaaaacaaagtttctaaatccaaactgaaaggactgcgccattttgggcaagtgggataat

SEQ ID NO: 6672 - DNA, 399 bp, Zea mays
  Clone ID: LIB148-041-Q1-E1-C2
cacacgcgtctgcgctttcctcttggaccatgtgatgtgagtgagttcacggcattgctagttttcctcttctttattagtctttatttcggcacgtccattcaccctttttctttagcatctggccagccaaacagagcaagggtccatggctatcgttttcaaggtcccctactgggctataaatccacgacagcgaggctgtggtgcctttggctcatgtgaatgatcaaacgggaaatgtcaatttggttgttgctagttgctggtccttttcatgtgacatctgccttcgtctagatgcgatgtttgtccttggttcacatcgcttctgttggaacaattatcctctcgaccttgagcttcagctaatgatttaggtctgagttcagattttga

SEQ ID NO: 6673 - DNA, 365 bp, Zea mays
  Clone ID: LIB148-041-Q1-E1-C3
cgggtcgaccacgcgtctagataacatcgtaggagaaagcgcctcattgaaataaaaaagcagtacacagtgattgatgcaaactttatctctaagatcccaatgttgtctgagaacaaacaacactgagagagggtgctccaaacgtctaattcagcacattaccaatatataaaagtagttccgttggctttgcgatatcatcatttagcaacctttaagatgataccatagatattatatggattcctaaggttggaaatttgtgtcgtccgagtcacctagaatacttgcttcttcctgtctgacaatgaacttgattttgtatcgatctgacatatatatgcctgaccaaatgtcattaa

SEQ ID NO: 6674 - DNA, 412 bp, Zea mays
  Clone ID: LIB148-041-Q1-E1-C4
gcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaaggacaagtggtgcaagccgccgc

SEQ ID NO: 6675 - DNA, 389 bp, Zea mays
  Clone ID: LIB148-041-Q1-E1-C5
atggatgatgcgcaaattgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccattcggagcagttgtcgtctgtaatgacgaagtagtagtcagctgccataacatggttctgaagcacactgaccctactgcgcatgctgaagtaactgcaattagagaggcttgcaaaaagcttgggaaaattgagctctcagactgcgaaatttacgcgtcctgcgagccatgcccaatgtgctttggtgcagttcatctctcccgaatcaagaggctggtttatggggc

SEQ ID NO: 6676 - DNA, 333 bp, Zea mays
  Clone ID: LIB148-041-Q1-E1-B1
ggcccaggcggcaccaccccaaccttcatggacgtccggggttttgggcctggcttcaaaatcaagtgcaatagcccggtgaattgctcggggaagcccttggtggtgcacatcacggacatgagctatgagccaaatcgcggggtaccactttcaatttaccaggcacggcgttcggcgccatggacaagaagggcgatgacgagatgctgcgcatagcgggcatcatcgacatgcagttccgaagggttaagtgcaagtacgactccaaggtcaccttccaccttgaaaaagggtgcggccccagatacctggcactgctggtcaagtacg

SEQ ID NO: 6677 - DNA, 290 bp, Zea mays
  Clone ID: LIB148-040-Q1-E1-H1
acgtcgtagaactatgatgtgcccttgcttgattcgttattgggtctctagccaagaagatgaagaacaacaacaacaacaaaaatatatatatggtgctgcgtatgcccattgtaacagttgatgagatctgtgactccccgtgccgtgtcccgtgagttgctgatgatttcatcccccccccccccccccccaacacacacacactttttttaatctttccccttattatggggtcccaaattgatgcggagatctcgagcgactctgcaaatttcagatgagtggac

SEQ ID NO: 6678 - DNA, 215 bp, Zea mays
  Clone ID: LIB148-040-Q1-E1-H10
ggtcgaccctctaaattgagtcatattacgccatcctccccacgctgctctccgtcaccgacaaaaaactcggcttcttcaataacacaagggccaacaacgggcaaatgtacttcggcgctccgggagccccctgcgtggccaagctcgtcaaggtcgtcgcagcgcggccgtactctgtgtccatcatggagatcagcgagcccattttgccg

SEQ ID NO: 6679 - DNA, 180 bp, Zea mays
  unsure at all n locations
  Clone ID: LIB148-040-Q1-E1-H11
gaagagagaaacgcgagcaaccagcgatcgccccatggccgccatggctcgttccgtctccctcgtcgtggcgcccctgctcctcctctcnctcctcgtctccgccgcggccagcgcgcggaccgtgggcgacaccgtgcaggacgcgtgcagcaagacccagttccccaagatctgcgt

SEQ ID NO: 6680 - DNA, 407 bp, Zea mays
  Clone ID: LIB148-040-Q1-E1-H2
attactctatacagacgtcgtagtatcgtcttcagataatgttgacgtagatgtgatagttgatggcaaatttgaacatggctacataataactgttattatgggatcaaaatccactaaagcaatcctctataactgcactgaagaacctgctctaccaacttcggagctagctgttgcaagtaacaacaatgatttgaagggtggacgtcgccgaagacgacgtaagaagaagctaagtacaacagaccccaggcaccccaaaccaaacaggagtggctataatttcttcttccaggatcaacatagaatgcttaagccacaatgtcctggacaagacagattgatcagtaaaatgattggtgaacgatggaacaatctaagtcctgaagataaagctgtatatc

SEQ ID NO: 6681 - DNA, 380 bp, Zea mays
  Clone ID: LIB148-040-Q1-E1-H3
aaagacgatgaccgggacaaggtggtgctcgcgtcggacgacgacctcgcggcggcggtggaacacgccaggctcgccggatggaagggtctgaagctgttcctggactactccggcaccaccgggcgcaggaaagcggtggccaccccacgtggcgccatggcggtgggcatgtccagccgggacgcgtgggcggcggcgtacagcggggtcgccgccggggctgccctcgtcactggcatcggcgtcatggcgtacctgcgaagatctgcctagctagtgtggtggcgcggcggcgcggcgcgcatattcgccaatgcaagagcaaggggttcctgtcctgccttcgaatcaccacagaggtgctagtatgtgtggat

SEQ ID NO: 6682 - DNA, 353 bp, Zea mays
  Clone ID: LIB148-041-Q1-E1-A10
gagaggatggccggagtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcatcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtg

SEQ ID NO: 6683 - DNA, 365 bp, Zea mays
  Clone ID: LIB148-041-Q1-E1-A11
cggtagccacgatgacaactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaatgtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatc

SEQ ID NO: 6684 - DNA, 380 bp, Zea mays
  Clone ID: LIB148-041-Q1-E1-A12
accgaaggcctcgtgccttctcttcctccctggcatggaggaagtagctgtttcgcctatgatcgttgccgccgtagtgctggacaacaatggcgctgacgcggtctcctgcactgccatccctagcgtatcaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactctcgtctcctccagtagcccttccagtcgcaagaagcgcggggcgttcagcctcttcagggcgatgttcctgtccttcggccggagcgacgacagcatgaagaaga

SEQ ID NO: 6685 - DNA, 372 bp, Zea mays
  unsure at all n locations
  Clone ID: LIB148-041-Q1-E1-A2
tgcagcaacatccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccangaggagtgcgacaaggcgtacgtggtg

SEQ ID NO: 6686 - DNA, 284 bp, Zea mays
  Clone ID: LIB148-041-Q1-E1-A3
ccggcgctaataacccgccgcagcaagggattgggaccaacaacatcgcctgcaccgttctacgtacgcggcctctagtaaacgtggccctggacgcagaagcgccggctccgtatctatcagcggctccttggcggtcgcaccctacagcgtccgggacgccatggtccccatcttctggtactccattcactgaacccccggacaatgatccggtccggtcggaatacacaccgcagggggatatagcttgcagcgctgcactgcgctgctgctctcgcgca

SEQ ID NO: 6687 - DNA, 375 bp, Zea mays
  unsure at all n locations
  Clone ID: LIB148-041-Q1-E1-A4
gacaatccgcccgtgggatctcgcgcacgccaggattggagagctgcggcctccctccgccccaaccagccatgggttcccgcgttgattgcggcgcttagacgcggaggangagagagacacggggagggggggaggccgaggcctangaggcgtancgctgtgcanggcgcgagcgcgttcgttcggcatggaacagaacgccggctcgttcctcgccgtgcgtcgcctctccggtggcgccatccaccaccatcgtcaccactcttccccggctgaggtcgtgggcgtgtccactgcgtggctcggtaaggggctttcatgcgtctgcgcgcagaggaaggagagcgacgtgcgcctgtccttcgatttgag

SEQ ID NO: 6688 - DNA, 388 bp, Zea mays
  unsure at all n locations
  Clone ID: LIB148-041-Q1-E1-A5
tcgatacacgcctctaatcaccatcatcatactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacngcgccggccatgaaggtctgccangaggagtgcgac

SEQ ID NO: 6689 - DNA, 280 bp, Zea mays
  Clone ID: LIB148-041-Q1-E1-A6
gtgagtcgtattaatcaagaacagccagctcgcgaaaataatgaagagccgcagcatggcatcatcggccgcgctcttggtgctagccctcgcgctagtggcaggcagcgccccacaggtagcggcggcaaagaagaagagagcggcggagagcggcgaggcggcggaggcgaagaagatctaggacgacttctgctcgacgctgtgcgagggcaataaggggacggacctggtcgtgtgcaaggagtcctgcacgctctctcagcagtcgaagctggtg

SEQ ID NO: 6690 - DNA, 396 bp, Zea mays
  unsure at all n locations
  Clone ID: LIB148-041-Q1-E1-A8
acggacactcgggcgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgngcgatcgcgacatcggcgaagtgtttgtgcccat

SEQ ID NO: 6691 - DNA, 356 bp, Zea mays
  Clone ID: LIB148-041-Q1-E1-A9
tacacacgcgttctgctaacgcgtccgctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagc

SEQ ID NO: 6692 - DNA, 74 bp, Zea mays
  Clone ID: LIB148-040-Q1-E1-E9
ctaaagtgagtcgtactacacgcatgttccagccggccatcacctggcttctcctgctcattgtgaccaccgat

SEQ ID NO: 6693 - DNA, 393 bp, Zea mays
  Clone ID: LIB148-040-Q1-E1-F1
gttggtcgatacaatactctacagtgagtcgtactactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaacacaatgagcatgaacg

SEQ ID NO: 6694 - DNA, 208 bp, Zea mays
  Clone ID: LIB148-040-Q1-E1-F10
acaagactctatagtgagtcttgtgagctccgacgccggcgccggcgcagcgctcctcgttccctccgaccgccactcgtggcacgactgcctcgccgaggcggacgcctgcttctccgacctcgaggagcgccaggtcgtgcgcgtccagggcaccgatcgggcccgccgaaccatcgtccgtgtcgtcggcaagttcttcccggct

SEQ ID NO: 6695 - DNA, 370 bp, Zea mays
  Clone ID: LIB148-040-Q1-E1-F2
aagactctaggatgagtcgtaatattgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttccc

SEQ ID NO: 6696 - DNA, 364 bp, Zea mays
  Clone ID: LIB148-040-Q1-E1-F3
tccaagcctctaaacagagtcctaacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaagga

SEQ ID NO: 6697 - DNA, 390 bp, Zea mays
  Clone ID: LIB148-040-Q1-E1-F4
caagcctctacacagacgtcgtattacgcgtccgcccacgcgtccgcctctcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagaga

SEQ ID NO: 6698 - DNA, 350 bp, Zea mays
  Clone ID: LIB148-040-Q1-E1-F5
tacaagcatctacactcattcttgccacgctgctctccccgtcctgctcgtccccgcgctaccgccgcctccgcgcggcgctgttcctggccatgggcctgtcgggcgtcgtcccggcgctgcacgcgctgtggctcaactggggccacgccgcctgctacctggcgctcggcctcgaggtcgccatgggtctcgcctacgccacgggcgcatggttctacgtcagccgcgtgccggagaagtggaggcccggggtgttcgacgtcgtgggccacagccaccagatcttccacgtgctcgtgctcgtcggcgccgtcacgcactacgtcgccgtcgccgtgctcatccac

SEQ ID NO: 6699 - DNA, 397 bp, Zea mays
  Clone ID: LIB148-040-Q1-E1-G1
acgatacaagcccctaggatgagtcgtatcatccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgc

SEQ ID NO: 6700 - DNA, 209 bp, Zea mays
  Clone ID: LIB148-040-Q1-E1-G10
aacactctaaactgagtcgtattagcaagtggacgacgggcagcatacgcaggaaggcgtgtcgacggagcgcgcgttcgaggcagacccgatcccatccttgtcggagacgatcacggcacgggcgatagcggccagcttcatcctgggcgtcgccctctgcgccgtcgccatgaagatcagcctcaactcgggcttcctcccgtcgc

SEQ ID NO: 6701 - DNA, 376 bp, Zea mays
  Clone ID: LIB148-040-Q1-E1-G2
aatactctatactaacgtcgtattatgggaccccgatccgccaccgcgcgaccgatcgtcccggatgcacgggccgtacccgacggctgctgctgctgctgcttcttcttcgggcgacatggcggcgaacggcatgaacgtggctctgcaccggcaggtctcggggggctcgatgaagcagaacgcggagctccggcgccaggcgtcgctcgagtccccgcggacggggcgggccaccagccggttcctgttcgggcggcagtcgtccatggacccgaaccggacgcgcggccggagccagagccccgtgcgcgcgccggacgacctgggcgtgccggacaacctggacgcgaccatgcagctgctcttcttcgcg

SEQ ID NO: 6702 - DNA, 411 bp, Zea mays
  unsure at all n locations
  Clone ID: LIB148-040-Q1-E1-G4
caagcgtctaaacaattcccctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaagagttgagcccttccccgccagcatccaccgccgcggcgtcncctgcggctganggaacggctgctgatgactccgccggtgctgctg

SEQ ID NO: 6703 - DNA, 363 bp, Zea mays
  Clone ID: LIB148-040-Q1-E1-G5
ggtcgacacacgcatctacccacgacgtctgggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccgg

SEQ ID NO: 6704 - DNA, 423 bp, Zea mays
  Clone ID: LIB148-040-Q1-E1-G6
aacccacgaatccacatcaaataaacaggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcaccacctacaagaccacactcagcatctaat

SEQ ID NO: 6705 - DNA, 393 bp, Zea mays
  Clone ID: LIB148-040-Q1-E1-G7
tcgcgggtcgatacacgcctctacactaatccgccatcactctccaacacgaagatggcgttcatcagcaatatcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggc

SEQ ID NO: 6706 - DNA, 371 bp, Zea mays
  Clone ID: LIB148-040-Q1-E1-E8
ctaggatgagtcgtattaagagagagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagataggaattggcaagtcgggcaagcctctatgg

SEQ ID NO: 6707 - DNA, 206 bp, Zea mays
  unsure at all n locations
  Clone ID: LIB148-040-Q1-E1-C9
gcctctacactgacgtctgccacgcgtccgcccacgcgtccggcggggctccctccagtccccggagttggtggccccaaggatngaggtcccggtgccgctgccgacgcgggagcgcggcatgacgctggccgagcagctcgccgcgtcgtgcaacctccgcgacctactcaagctccgggacgacggcgtcagtggcagtgaag

SEQ ID NO: 6708 - DNA, 207 bp, Zea mays
  Clone ID: LIB148-040-Q1-E1-D10
tacaacaccctagagcgagtcgtctcactagtggcggccaccgccccacaggtagcggaggcaaagaagaaaagagcggcggagagcggcgaagcggcggaggcgaagaagatccagaacgacttctgctcgacgctgtgcgagggcaaaaaggggacggacctggtcgtgtgcaaggagtcctgcgcgctctcccagcagtccaac

SEQ ID NO: 6709 - DNA, 200 bp, Zea mays
  Clone ID: LIB148-040-Q1-E1-D11
tctatattgactcctcatacaccccgccttcacgcctccctcaccaaataaggtcccgcccttttccgacattcacaggggggacaggaaatcagcggccatggcctcgattccggcgacgaccttcgccgttatcttatccgtcctcttctgtgccgcggctggcaccgccgtcgacaacgacctccccgactacgtca

SEQ ID NO: 6710 - DNA, 216 bp, Zea mays
  Clone ID: LIB148-040-Q1-E1-D12
gcggggccatccaagcgtccgaaacaccttggcgcgagtgatggacgcccgtctcggcctcggcttcttccccttcccctgggcggcggctttcgcccggcgggcctcggcgaagttctcggaaaatttcaacaaaacttcgtgccccaacgccgaaaaaatcaccttgggcgtcgtcaaaaaccggttcaaggcggaccccggcaccgccgccgg

SEQ ID NO: 6711 - DNA, 395 bp, Zea mays
  Clone ID: LIB148-040-Q1-E1-D2
tacccacacttctggcacccgccaccggccggatcgacagcaccgatcaccctgaccgtctgcgcgcggcggctctcacacaccggcgacacgcagggcgcgcataggcgagggcctcccccccggcgagggatggtgtggtcggctgggatggcaacaatgcgaggcgcctccgccgccgcgctactggtgctggcgctcgccgccgccgtggcgcgcgcggaggacccctaccacttcttcgagtggaaggtgacgtacgggacgaggaccatcatggggacggcgcagaaggtgatcctcatcaacgacatgttcccgggccctaccatcaactgctcatccaacaacaacatcctcgtcaacgtgttcaacatgctcgaccagccgctcct

SEQ ID NO: 6712 - DNA, 306 bp, Zea mays
  Clone ID: LIB148-040-Q1-E1-D3
aaataaatcacctcaatgataaccagaaaacgcagcagggtagtacatgatcgccgcgacaaacagtggcgcgtcgaagcacgtaccaccaccaccacgcgcacacctcctccgccgccgcggccgactccatacatacacacgcccgccgacacctcacacagagacacacacgacacgagctggactcacgcacgccagaccagacgaatcatattttggagcaggaaccacgtatccagcgcggatctagcagaagaggtagccgaaggcggcggcggcgagggaggccgcggcgaggggtac

SEQ ID NO: 6713 - DNA, 370 bp, Zea mays
  Clone ID: LIB148-040-Q1-E1-D4
taaccaaagacgtcatatgctccttaaattttaagaggacatctggtccttagattgtaaaatctcatggcgtatgtttagagggtatcagatggggtggttcaagcagacctgacttcacatgtaaaagtaccaaagtcgtcctgggtgtcgtgcacgccactggagatgaaccttacatcccatcttcccatccatttgttttaagagatgctggtggtaaagttaattgtgatggatccaagaagacagagaacatgtgattgacctaaggcagtttcagctccagagaaggtccattactcatggaaatgctaagagcaagagtgaaaagttccctaccctcacattaaggtggtacggttggtgt

SEQ ID NO: 6714 - DNA, 368 bp, Zea mays
  Clone ID: LIB148-040-Q1-E1-D5
tacacacacgtctgccaacgcgtccgagcctgtacattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcg

SEQ ID NO: 6715 - DNA, 308 bp, Zea mays
  Clone ID: LIB148-040-Q1-E1-D6
tacaggaacacatagcaagctagccagccagccagcagccagcttgctcgccgcgcccgtccttcctcctcgcctccgttccgttccgttccgtcccgcccgccggcggcgccgcaatcaaggaaggagatgaagaagattgcctgcgccgtcctcgtcgccgcctcggcgggcaacgtggcgctcgccgcggaggctcccggtcccgggcccaacagcggctcctccgccgtcgcgcccgccgtcggcgccgccctcggggccgccgtcgcctccgtcttcgcctactacattcagtgagccgggcg

SEQ ID NO: 6716 - DNA, 387 bp, Zea mays
  Clone ID: LIB148-040-Q1-E1-D7
gactcgcaggacgacacaagcctctacactgactcctattatgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaaaccaagctcgctgtgctgctgtgct

SEQ ID NO: 6717 - DNA, 366 bp, Zea mays
  Clone ID: LIB148-040-Q1-E1-E1
ctctagcgggatccgatccatcttgggcgggcgccgcgcgtcgagggccagccaaagcttgccatggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgc

SEQ ID NO: 6718 - DNA, 202 bp, Zea mays
  Clone ID: LIB148-040-Q1-E1-E10
tacaacactctatagtgatgtcgtattattggggacatgaagggccatgggatgacccctgatgtcaccacctacaacaccctgctgaacgcttgggtgcttgccggtgatctggaaagtgcccccaaggtgtttgatgaaatggctggggaggggaccgaccggaactcggtctcgtacaatgtcatgatcaaggggtacg

SEQ ID NO: 6719 - DNA, 209 bp, Zea mays
  Clone ID: LIB148-040-Q1-E1-E11
acaacactctaaagtgactcgtatgaccacacgcacaccaccgggttgtcgggcctgggcgtcaccgtgttctccacccggtacaagaacccgcggcccgccaccggcggctgctgccccaggaacttgaggttgctctcgaacttggtctccggcaggtccgtgtcgatccagttgtccctgaggtacccggcgctccacagcgggtc

SEQ ID NO: 6720 - DNA, 212 bp, Zea mays
  Clone ID: LIB148-040-Q1-E1-E12
tacaagcctctaaacagacgtcctataaaatcaagatgccatattagctgcatgcctatatattgcttgtagacaagaagatcggcctagaactgtgaaagaaatatgttcagttgctaatggggccacaaagaaagaaattggcagagcaaaagaatttatagtgaaacaactggaagttgagatggggcaatctatggagatgggaacca

SEQ ID NO: 6721 - DNA, 368 bp, Zea mays
  Clone ID: LIB148-040-Q1-E1-E2
tccaacactctagactgagtcctatgactgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaagcggcggcgggctggaccccgacggcgacccagaggttgggctgaa

SEQ ID NO: 6722 - DNA, 353 bp, Zea mays
  Clone ID: LIB148-040-Q1-E1-E3
agcgtcaagtctgacatctactccctcggcgtgctcctgctgcaggtggtcaccgcgcggccacccatggggctcacgcatcacgtcgagaaggccatcgacgcgggcacctttgagcagatgctcgacatcaccgtcaaggactggcccgtcgaggaggcgctcggctacgccaagctcgcgctcaagtgcacggagatgcggcggagggaccggccggacctcgccacagtcatactgccggagctcaaccggttaaggaacctcggccacgcgtacgaggcacgcatgagcgccgccagggccaacggtggaagtggagagagtggtgcccagatcagcggggactcgac

SEQ ID NO: 6723 - DNA, 391 bp, Zea mays
  Clone ID: LIB148-040-Q1-E1-E4
tacccacgcgtccgagagcaccctgtgctgctgaccgaagccccactcaacccaaaggctaacagggagaagatgacccaaatcatgtttgagactttcaatgttcctgccatgtatgtcgccatccaggctgtgctttccctgtacgccagtggacgtacaactggtattgtattggactctggtgatggtgtcagccacacagtgccaatctatgaaggttatgcccttcctcatgccatcctgcgccttgaccttgctgggcgtgacctgactgacagcctgatgaagatcctcactgagagaggttactccttcaccacctctgctgaacgcgaaattgtaagagacatcaaggaaaagcttgcatatgtggctcttgaatacgacc

SEQ ID NO: 6724 - DNA, 279 bp, Zea mays
  Clone ID: LIB148-040-Q1-E1-E5
acaagcctctagagtgattcttaatgctttcgagtagcacctccaggtcctgggttcgatccccctcgggggcgaatttatggcttggttaaaaaaatcccctcgttgtgccccacccgctcccgggttacgtcctgcgcgccaccctccggctgggccgttgcagagtgggcggtgacggcccgctagtgatggggggccaaggtttggggattttctcggccgggaccatgagggcggtctttccctccccggccgagttttatataaacaattttt

SEQ ID NO: 6725 - DNA, 412 bp, Zea mays
  Clone ID: LIB148-040-Q1-E1-C8
ctcgccggtcgatacaagcctctacactgacgtcctgatactcttcccttccctgagcaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccataaggagaagaaagataagaagaagaagaaagagaagaagcacggcgagggccatgaccatggtgatggtgacggcggccacagcagcagcagcagcgacagcgactgatctcgcc

SEQ ID NO: 6726 - DNA, 421 bp, Zea mays
  Clone ID: LIB148-040-Q1-E1-E6
ctcgccggtcgacacacgcatctaccatgcgtccgcgtaaggggagtgaatcctggaaaaaggtcatcgccattacagaagaagccgagtggaccctcaccgacgctaatcaagaagggcggaggtgaaggaaggaagactccaaatggtaaaacaggaaccaagaagtaagcaatccagatgaaacttggttttgctgtgaccaacttcaccttggttagggacagataaacatgttgatactatcgggtgatacattgatatttgccacacgaatacgtcagtcctcttaagggaggaggtcgctagatcttcgggcatctgctgtaaatcactcgttgatttgttgtagtacgaacagaaaacggaccacaaaaaactcgaggatgggaggaagatcatcatcacaaggacgtttttg

SEQ ID NO: 6727 - DNA, 372 bp, Zea mays
  Clone ID: LIB148-040-Q1-E1-E7
ctcgcgggccgacccacgcatctaggcccggtcaattgcccggccggaccttcgcccatgatcacagggagaacatcctttgcttcccatggccatgaagaagaaccaagactcccagttggtcatgggccggtacaggctgggccaactcctcggcagcggcaacttcgctaaggtgtacaaggcccataaggtggccaccggcgaggctgtggccgtcaaggtgctggacaaggatgctgtgcaccgctccggcatggcggagaaggtgaagaccgaggtcgacgtgatgcggcgcgtgcgccacccgaacgtcgtccgcctccacgagatgatggccacgcggtccaagatctacttcgtcatggaata

SEQ ID NO: 6728 - DNA, 376 bp, Zea mays
  unsure at all n locations
  Clone ID: LIB148-040-Q1-E1-A6
ctcgcgggtcgacacacgcctctacagtcactcgggatatggaatgagctcaccccaccccagagcatcaagaagctggtaatcaagaactacaaaggcgtaaagtttccaaaatggataaaaggtcccaagctaggagactccttccccagccttgtgtttttggatcttgaaaactgcatgtcatgtactaaactgccttcacttggcctcctgagtcaactccagtccctgcaaatctcaaatgcagactcagtcatcaccatcggttcagaattccttgggaccactgtactttcatcagccactccattcnccaagcttgaggttttaaagctcagaaacatgaagaaacttgaagagtggtctttaactg

SEQ ID NO: 6729 - DNA, 341 bp, Zea mays
  Clone ID: LIB148-040-Q1-E1-A8
tcgtcggtcgatacaagcctctagactaactcctattagcgtggccatgccgggacatggggaaaggcacttggtgcagaggtctatgactgcaacaacatggtggagcaagagctgcctggaggcgggctcctcctgtaccaaagcttctgtgctgctgaagacgctgttgctaactcgcccaaatctgttttccactgctttgacgggcaaaacgttgagaatgctcctcctcctatgaagaaggactacaaactggctaatcttctatgctgggaggaggaagcggattccatggaggagaaagcgggagtgcttgatgagtaagacagggttctggg

SEQ ID NO: 6730 - DNA, 374 bp, Zea mays
  Clone ID: LIB148-040-Q1-E1-B1
gggtcggtccaagcctctacagtgactccactaagcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttc

SEQ ID NO: 6731 - DNA, 212 bp, Zea mays
  Clone ID: LIB148-040-Q1-E1-B11
ttacaaccctctagagtgactcgtcttaggccagccaaagcttgccatggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcga

SEQ ID NO: 6732 - DNA, 211 bp, Zea mays
  unsure at all n locations
  Clone ID: LIB148-040-Q1-E1-B12
atacaagactctaaagtgagtcgtcatacagctgaagctcgcacacccggacaacgcgctggtgaaccgaatgtcctcggcggcaaaaagcttcaacagagcctgcaaagcaagggcgttaaccccgtttgcgaaaattacaatttgttttcccctaggatgagtcgggaataacatcgtgatctactctgaagcanagcagctagtgcat

SEQ ID NO: 6733 - DNA, 382 bp, Zea mays
  Clone ID: LIB148-040-Q1-E1-B2
ctctacaggttctcgacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgctggcccggagccccgacccggggtgcgcggagatcgaggagttccgcgaccgcgcccgcgtcccgctcacctccaacaacggcatcaagcagcagggcgtccgctacgccaaccccatcgccttcttccgcaaggacccgctcaaggagtgcggcgccctcctcgagaagtacgatctcaaggacgcctccgagacgccatgat

SEQ ID NO: 6734 - DNA, 403 bp, Zea mays
  Clone ID: LIB148-040-Q1-E1-B7
gatacacgaatctacactgtgtcacatcagcacctccgacctgacgctgtacgtcaagctcaccgcctccgtgcgcgccgagaaccccaacgagatgatcaccatcaggtacggcgagggctcccacaccgtggtctcctaccgcggcacgccgctgtgctccgggaagctcccggccttcttccagggctacaagaacgtcaccgtcatggacatctccatggagggccgccacggcttcgggtcggggctccagcaggcgctagaggagagcgagaaggccggggacatcccgctcgacatcttcgtcagcgtccccgtggagctgcagctcggctccgtcgacctccgccagatttaagtccacgttcactgcgcgcgcgtcctccatagcatcctccgc

SEQ ID NO: 6735 - DNA, 435 bp, Zea mays
  Clone ID: LIB148-040-Q1-E1-B8
tacaaccatctacactgacgtcctaatataacttacagaaggatccatggcccaaggtctcccagagcgcaaaggatcttgtcacgaggatgcttgacccagatccttgtacacggttgacggcaaagcaagtccttggttagtagccttaagttcaatcttataagtttactgaaaaccaaatagaacgggcaggctgcatccgttcctagaaaaaaaaacaaggtttttcttgaagagcctgttattgccatcattgaagaaaaaaaaccgaaatggtttaatcatgctgcgtatttaaccataagcactttatcgtggaaaaaaacagagcacccttggctcaagaatgctgataaggcttcaaatgtgtcactcggaaaggttgttcggtccaggctgaaacaattgtcctctaagaacaagcttaagaag

SEQ ID NO: 6736 - DNA, 200 bp, Zea mays
  Clone ID: LIB148-040-Q1-E1-B9
tctaaactgagtcgtatcatctctgcctgcctgagctcaccgcacctcgcctcctcaccgcgtttcctccgttaatccggtagataatggccgatgccgaggatatccagcccctcgtcggcaacaacggaactggcatggtcaatgctgggttcgctggcgacgacgccccgagggccgtcttccccagcatcgtgggg

SEQ ID NO: 6737 - DNA, 185 bp, Zea mays
  Clone ID: LIB148-040-Q1-E1-C12
actatcaagcacctcctcttcccccgccgggcaacaactcagccgccgcaaccgcaacatcagcaatgggcgcctgcccaacaaaccccaagacgcttaaggggcaggccccacctgaggccgccgtctccacaccaaaggttgcccccgaggccactccaatctccgttgaggttgcggctgat

SEQ ID NO: 6738 - DNA, 296 bp, Zea mays
  Clone ID: LIB148-040-Q1-E1-C2
tacaagcctctacagttagtcctatgacggcctccgcgcgtcgagggcaatctcaagcttgccatgggagccgtcacggtccaagatggtccatcatgaccaccgcggcacgaatgcgtcgtgtccagtgacctccgcagccgttcctgccgccaaggccgatgacgcccggcgccagcgcccgcggatgcacgtgcacgtccgcgagcatgacaagtgcccgctctccacggggcaccagcacctgcaccaccatcaccatcagctgccgcggtcggcagcgttaccaaccctgc

SEQ ID NO: 6739 - DNA, 387 bp, Zea mays
  Clone ID: LIB148-040-Q1-E1-A5
attatcagttctttctctaccaactgatccgtgctctgaaatacatccacacagctaacgtttatcaccgggacctgaagccaaagaatatattagcaaattctaactgcaaactgaaaatttgtgattttggactagcacgagttgcattcaatgataccccaacaacgatcttctggacagattatgttgcaacaagatggtacagagctccagagctctgtggatccttcttttcaaagtatacaccggccattgacatttggagcattggatgcatctttgctgaggtgttaacagggaaacctttgtttcctggtaaaaatgttgtccatcagttagacttaatgactgaccttctaagcacgccatcgatggatacgattt

SEQ ID NO: 6740 - DNA, 357 bp, Zea mays
  Clone ID: LIB148-040-Q1-E1-C3
gacccacgcctctagagagaggcataggacgtaagaagtggtctaattcctggatccagttaggcgacttcatcgtcgctctcttcattaccagatttccttgtcatcgtcaagatccaagcatagacttaatttagttatagacggattggtaagcctcgtgaaaattcacgtggaccggggtatcatccttgccgatcgcaacgcaagaggcatcgatccgtaagtcatcttacggcattgcatgaagaagcggaagacaagcgtgaagaagagatcagtgaaacccatatggcaacatgaacctaagctgatcctcgcagatgccacccaaccacagaatcttgaagtgttcga

SEQ ID NO: 6741 - DNA, 354 bp, Zea mays
  Clone ID: LIB148-040-Q1-E1-C4
aagatcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagcc

SEQ ID NO: 6742 - DNA, 397 bp, Zea mays
  Clone ID: LIB148-040-Q1-E1-C5
cacgcctctagatttactcctcatcatctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttccgcacccgcaagctcgagcgcgccatccacggggtcaccgacgcgaccggcacta

SEQ ID NO: 6743 - DNA, 424 bp, Zea mays
  Clone ID: LIB148-040-Q1-E1-C7
acaagaatctaggctaagtctctccagattggtatatcgatcgattgatcggtggcggagggaggggaggagggcggcagatggcggcgtgccggggcttcttcgagtgcctgctcaggctgctcaacttcatcctcaccgtcgccggcctcgccatggtcggctacgggatctacctgctcgtcgagtggatgaagatatctgaggacggcagcagcggggggttgacggcggaggtgctggtctccggccggccgttgttgggggctgtcgctctcggtgacagcttcctcgacatgctacccaaagcatggtttatttatttgttcattggtgttggtgctactgtcttcctcgtgtctctgtttggctgcattggaacagggacaagaaacacctgccgtttgtgtttccaagccctcct

SEQ ID NO: 6744 - DNA, 407 bp, Zea mays
  Clone ID: LIB148-039-Q1-E1-H1
gcgggtcgatccaagcctctaaacagacgcctggtacgcgctttgatagcagatgagagtatcttaatttatggccagcagaaactgaacacctcattgtcaaagccccggcatctcacattgtgtagcatggaaaacagcttggatggtccaatttcgctgaagcagcagatgggtttaaggtcgctgatgctcttcaaaagcccaaatgtcagagcaatagatcttctcatggagtcagcttcatgcttgcgtgtattagatttgagcaagacagcagtggaggccatcccgaaatccattggtaacttggtacatttaaggtacctcaatcttgatggggctcaagtcagagacataccttcttccattggatttctcataaacttgcagacctttgaaccttc

SEQ ID NO: 6745 - DNA, 399 bp, Zea mays
  Clone ID: LIB148-039-Q1-E1-H10
acgtcgtgagtaaacagacaaaggcgacagcatgttaaggctcaaagaaatgaagcaagtggctactcaaatgagagcaaaggtagcgagggcaagaatgatgttgtctatcaatcagcaacacccgtcatggattcgaactcatccaatcacaggaatgtgccaagatctgatgtgaaaaacagcggcgtagtttcacactctagagcctggaagccgaaaaccaattcccatcctcaggacagctcagacggcatgattgctgttgacgggcaagtggattcccatggtggtaggcttgagatgaatacgtccaaaggatctgatacaattacccatctagtgaccagtagtgaaccgacgaaaaggaatgattgccaataagtttcacacaacaaa

SEQ ID NO: 6746 - DNA, 323 bp, Zea mays
  Clone ID: LIB148-039-Q1-E1-H12
atcgccggagcccgggcctccccaccgctcgcgccggcggtcgccgatcatggccaccacccccgccgaggatccggagcctgggctacctcctcccaaggctctctgcgagcagccgcggcggcggcgcccgtgcgtcctccttagcttctcggcagcgcgcgaccgcttcctccggggccggttcctctcggcgggcctgcgccccttctccgtccgcctcccctcgccggccggcaccagcaccgtcgtccacctctgggcgccgccgcggtccgcgcggcggcccgtgctcctcctccacggcttcggcgcgtcggcga

SEQ ID NO: 6747 - DNA, 389 bp, Zea mays
  Clone ID: LIB148-039-Q1-E1-H2
ttcgggatccaaacacccgcttaccgaatggtcgttttcttccgcctctcttcaattttaagccccatgagctgaagaacgtgccggcggatttcatggtgaaattggtccctgagcatgcacggaagcaatgtgccttcgtagggtggtgatctctggataagaggatgacgactcgatgattagctgaggaccaagttaatgtctgttagaaactgccggagatcgacattgccagatgtggtgtggtataagataggcaatatgtgtgattattttttgttcgaggttatcaccccccttgccccagaaaagatgagaagatgtcgatgtaacaagccctctgcgcttctgtaagtagatgagtgttgctgcatgccccctgggta

SEQ ID NO: 6748 - DNA, 421 bp, Zea mays
  Clone ID: LIB148-039-Q1-E1-H3
caacactctaaagtgagtcgtagtaattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgaaggggtggcgg

SEQ ID NO: 6749 - DNA, 393 bp, Zea mays
  Clone ID: LIB148-039-Q1-E1-H4
agatcaagcacgctccacctcacccgccggacagcagctgctggtcgccatgctagcagtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtg

SEQ ID NO: 6750 - DNA, 444 bp, Zea mays
  Clone ID: LIB148-039-Q1-E1-H5
ctcgcgggtcgatacaagcctctaaagtgagtccatactgtcacggggtgggagggggtgctggcgccaacatcagcgcccttcgcgcccacgatggcacccgtcacggccgcctcctcgcagccgccgacctccctcttggcggcctcggcctccccactgacactggcctctattacacggagatcaagctcgggacgccacccaagcactactacgtccaggtcgacaccggcagcgacatcctctgggtcaactgcatcacctgcgagcaatgcccccacaagagcgggctcgggttagacttgacgctttacgaccccaaggcatcctcgaccgggagcatggtgatgtgcgatcaggcattctgtgcagccacctttggcggaaagctgccgaagtgcggcgccaatgtgccctgcgaatatagtgtcaactacggtg

SEQ ID NO: 6751 - DNA, 399 bp, Zea mays
  Clone ID: LIB148-039-Q1-E1-H7
ttacaaccctctaatctgagtcggatgaaaccagaacatgcccagcagggcgctgacgttcagccagctgggcgccgcgaccgacgggttcagcgagcagaacctgctgggagaaggcggcttcgggcgggtgtacaaggggctcctccaggacaccagagaggtcatcgccgtgaagcagctggacaggaacgggttccagggcaaccgcgagttcctcgtggaggtgctgatgctcagcctcctgcaccacccgaacctcgtcaagctgctgggctacagcaccgactccaaccagcggatcctggtgtacgagtacatgcccaggggctcgctggatgaccacctcctggacctgcccccgagctggaagcccctgccgtggcacacgccgatgcg

SEQ ID NO: 6752 - DNA, 387 bp, Zea mays
  unsure at all n locations
  Clone ID: LIB148-039-Q1-E1-H8
ctacctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggangangaagccgtggagaagaccgtcgtcgangangagaagcagcggcagccgccaatgcagagganaaggtcgccaccgccgccgagaccacgacga

SEQ ID NO: 6753 - DNA, 403 bp, Zea mays
  Clone ID: LIB148-039-Q1-E1-H9
tcgtgggtcgatacacgcctctaaactcagctccatgactttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaggaaccacgagggccggccgatggagtccatcctcggcgcctgcagcaacgggtacggcaacgttgtgcagacgctcgaggaggcgcggaagatcgtcgccacgcgggcggcggcgggcacccaggcccaggccgacgacatgaacacg

SEQ ID NO: 6754 - DNA, 395 bp, Zea mays
  Clone ID: LIB148-040-Q1-E1-A1
acaagcctctatcgtgattcgatacatggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcgggcccgggacctccaaagtgaacatcaccgacc

SEQ ID NO: 6755 - DNA, 202 bp, Zea mays
  Clone ID: LIB148-040-Q1-E1-A12
ctctaaatggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgta

SEQ ID NO: 6756 - DNA, 336 bp, Zea mays
  Clone ID: LIB148-040-Q1-E1-A2
gtccgtccaagcctctagactacgtcctcataccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaagtgaggctggagtgcaagcactttgggaccgggaaacttcaacgctccat

SEQ ID NO: 6757 - DNA, 424 bp, Zea mays
  Clone ID: LIB148-040-Q1-E1-A4
gtcgatccaagcctctacagtgagtcatactagacgggaaggacagcgaagacctgagcagcacaggcgacaaggcttgtgtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagttgctagtactggggccgagtcaagggacgatgccgctactatggaacgcgagccgctggtagcagcagcaacagcagcacaaggaag

SEQ ID NO: 6758 - DNA, 402 bp, Zea mays
  Clone ID: LIB148-039-Q1-E1-G8
cacgcgtccaacgacatcctcgtcagaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaaggacgtcaatgttacggccccggggacagcccaaacacga

SEQ ID NO: 6759 - DNA, 403 bp, Zea mays
  Clone ID: LIB148-066-Q2-E1-H5
agtggatgcggtcgccggagaggaagctgctggcgtcgggcaaccagcccaagccgaacgcgatcgtggccaaggacggtagcgggcagttcatgagcatccagcaggccgtggacgccgtgcccaagggccatcaggggaggtacgtcatctacgtgaaggccggcctctacgacgagatcgtcatggtccccaatgacaaggtcaacatcttcatgtacggcgacgggcctaagcaaagccgcgtgaccggccgcaagagcttcgccgacggtatcaccaccatgaagaccgccaccttctccgtcgaggcgtccgggttcatccgccagaacatggggttccacaacacggccggtgcggagcggcaccaagcggtggcgctccgggtgcaaggggacct

SEQ ID NO: 6760 - DNA, 423 bp, Zea mays
  Clone ID: LIB148-066-Q2-E1-H6
cctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtgacgtggcgttcagctcaggcgctgagcgagtctatacgtacgtcgtcaccggctggccacgcatgcgataaccatctgatatggacggaactatata

SEQ ID NO: 6761 - DNA, 406 bp, Zea mays
  Clone ID: LIB148-066-Q2-E1-H7
cacacgagccgctgcacgcttaataacattgtagattggtacgggagggcgaggaaatggaataagacggctattccaatcctaatcgggacaaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttctgacgaccccttcctctaactagtaactcggcaacacacgcaagacgaaccttggtaaataacaagggtttacaaggtcctgtccttccattct

SEQ ID NO: 6762 - DNA, 409 bp, Zea mays
  Clone ID: LIB148-066-Q2-E1-H8
acgcatccgattctaaatcgcggttcactcactattgcttggtatgtttatgcaaatatgggtttcggaaatcctctggcaactgttacagaaggagtgctccagcacatccaaagctcgctgtttccttcccatttaacgaagctcccgtaaagctccacttaggccggattgtcatcaatggctatatttatgacagggatcgtgccagctacactgggactgtagaaggcataaggccacagacagtcgcgatcggttcaaggctccagtcgtccgcacagggctacgccgatcgatgtcacattacactgtcaaccgatcgtatagacgactggtcattctacggtagttaccaagttactaattacccgcatgagtcttcaactgtcgatgatggactcgccga

SEQ ID NO: 6763 - DNA, 316 bp, Zea mays
  Clone ID: LIB148-066-Q2-E1-H4
gtccgagcacatacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacctgccgctgcccatctgcgcctcgctgctcaaacagttggactcggacgacgacgacgatcagtaatagcacatcgacgacgacgatcgatatgtaatagcacgtcgtcgacgaccgaccgc

SEQ ID NO: 6764 - DNA, 358 bp, Zea mays
  Clone ID: LIB148-039-Q1-E1-F3
gggtcggcccaagcctctagactgagtcatactacaatgcagaggaaaaggtcgccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatg

SEQ ID NO: 6765 - DNA, 417 bp, Zea mays
  Clone ID: LIB148-039-Q1-E1-F4
taagtacagtgacgagaagatgacctcctatagctccaggaccaacgcatcggtaggcgttcaaaccatctcgtagattcagccattcccgttaccattcctacgctagtcataatcatgcatgcgctgtgatccctcccaacttgcagaagaaatggttctgctgtgtctcgcccagtcccacacagtcttgaggaagctaatgagccgtgcagtgctgcagcagtttctgtgatggttatgtgtagctcttcgaattcaatcctatactgcttgccagtgacaggggctctatgtatagccattgcaaatgagaaaattactctgatgggtgtctgcttatagcgttcttagctgtgtataccatcagttcaagctgatgtctgcttgtaattttcttttctgggcccttctcta

SEQ ID NO: 6766 - DNA, 422 bp, Zea mays
  Clone ID: LIB148-039-Q1-E1-F5
tcgcgggtcgacacaagcctctagactaaggcgtctgacttcgggctgtccaaggacgggcccgggatgaaccagctgcacgtgagcaccgccgtgaagggcagcttcgggtacctggacccggagtacttccggtgccagcagctgacggacaagtccgacgtgtactccttcggtgtggtgctgctggaggcgctgtgcgcgcggccccccatcgacccgcagctgccccgggagcaggtcagcctggcggagtggggcatgcagtggaagcgcaagggcctcatcgagaagatcatggaccccaagctcgccggcaccgtcaacccggagtcgctcgccaagttcgccgagaccgccgagaagtgcctcgccgagttcggcagcgaccgcatctccatgggcgacgtgctgtggaacct

SEQ ID NO: 6767 - DNA, 428 bp, Zea mays
  unsure at all n locations
  Clone ID: LIB148-039-Q1-E1-F6
gatacaagcctctacattgagtcgtataaacctacttaaaggtgcttcttggaaatagcagtcgaagcagcagtaccaatgcatcaagtacagtcaccgattcactgctaccctcactagttttaaatttatcatcaccagaagtagaagacgcatcaaagttttcagctcctgctgtggtggaaaataattggtttaaacgatcactgccttcaaaaacttggaaattaagaactgttgattccacccttagtcatgaagagagggagcgtacgaggaggagagctgctgtgagatcagcttttgtccagcatctccttgtcaccaccatttttgaagactagcagatcaagcacagctcatgcataggaatcttgtgggcgggccttttgcncactcatttatctggatggataatgcactaatta

SEQ ID NO: 6768 - DNA, 297 bp, Zea mays
  Clone ID: LIB148-039-Q1-E1-F7
tgagtcgtattaaaatacgtaaaggtgcgtcttgggaatagcagtcgaagcagcagtacgaatgcatcaagtacagtcaccgattcactgctagcctcactaggtgggaatttagcatcaccagaagtacaagaggcagcaaagttttcagctcctgctgtggtggaaactaattggttgagacgatcactgccttgagaagcgtggagattaagaactgctgagtcgagccttagtcatgaggagagggagcgtaggaggaggagagctgctgggagatcagcgtatgtcgagcat

SEQ ID NO: 6769 - DNA, 417 bp, Zea mays
  Clone ID: LIB148-039-Q1-E1-F8
tcgtcggtcgatacaacccactacactgcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctg

SEQ ID NO: 6770 - DNA, 404 bp, Zea mays
  Clone ID: LIB148-039-Q1-E1-F9
tcgtgggtcgatacacgcctctaggctcacgctcatacgacgaccccagcggcggcgatgggcggcaaggacctgacagaggagcagatcgcctcgatgcgggaggccttcacgctgttcgacacggacggggacggccgcatcgctcccacggagctgggcgtcctcatgcgctccctcggcgggaacccaacccaggcgcagctccgggacatcgccgcgcaggagaagctcacggcgcccttcgacttcccgcgcttcctcggcctcatgcgcgcccacctcaggcccgagcccttcgaccgcccgctccgcgacgccttccgcgtcctcgacaaggacggctccggcaccgtcgccgtcgccgacctccgccacgtcctcacctccatcggagagaagct

SEQ ID NO: 6771 - DNA, 428 bp, Zea mays
  Clone ID: LIB148-039-Q1-E1-G1
tcgtgggtcgttacaaccctctagactgagtcgtactaagaccatccgccgcgcgctccacctgcgcgtgaacgtgaagatgatcaccggcgaccagctggccatcggcaaggagacggcgcggcgcctgcgcatgggcagcaacatgtacccgtccaccaccctgctgggcgacaacaagaccggcgagatgggccgcctgaacatcgacgagctgatcgagaaggccgacgggttcgcgggggtgttcccggagcacaagtacgagatcgtgaagcggctgcaggaccggaagcacatctgcggcatgaccggggacggcgtgaacgacgcgccggcgctgaagaacgcggacatcggcatcgcggtggacgacgcgactgacgcggcccggagcgcgtcggacatcgtgctgaccgagcccgggc

SEQ ID NO: 6772 - DNA, 290 bp, Zea mays
  Clone ID: LIB148-039-Q1-E1-G10
gagtcgtattaaacagacaaaggtgacagcatgttgaggctcagagaagtgaagcaagtggctacgcaaatgatagcataggtagcgagggcaataatgatgttgtcgatcaatcatcaacagccgtcatggattcgaactcatccaatcacaggcatgtgctacgatctgatgtgaaaaacagcggcgtattttcacactctagagcctggaagccgaaaaccaattcccatcctcaggacatctcagacggcaagattgctgttgacgggcatgtggattcccatggt

SEQ ID NO: 6773 - DNA, 389 bp, Zea mays
  Clone ID: LIB148-039-Q1-E1-G12
ggccggtcattacaactccctaaagtgacgtcgtattacgcgtccgacctcctcctcacccgccggccaacaactcagccgctgcaaccgccacatcagccatgggcgcttgcgcaaccaatcccaagacgcttgaggggcaggccccagctgaggccgccgtctccacacccaaggttgcacccgaggccactctaatctccgttgaggttgcggctgaagaataggtatcttacaatgtggtggtggaggaaccggctgcggcggccgacgttgagcaatagtaggctaatgaggtgttctctccagaagcggccgtccccgagcccgatcacaacgacgacgaaaccgtcgagaaaaccatcttctaggaggacaatccaaccgga

SEQ ID NO: 6774 - DNA, 116 bp, Zea mays
  Clone ID: LIB148-039-Q1-E1-G2
tgttgatcgcgcatcactgaaggggagcagtggaatacgccggtttcagatctgccgtcgtcatccatggcatgggaacgccgtggtctcattggggggcataaccgtgttggcgt

SEQ ID NO: 6775 - DNA, 410 bp, Zea mays
  Clone ID: LIB148-039-Q1-E1-G3
gggtcgacccaagcctctagagaaactcgtattattcttcctcctcctcgtcctctcaagttctgtctcttgtctctgtcatcctcgctcggcttccccggttcttgagaggggaaagaggaggcggatgagatggatcgggagggatgagaggttcccagtgtgggaagccgcgctcggcgctggagtctccgccgacatcgccgctgggctcatcgaggtttaccgttcgatgcctgatcccgactacagcttcgtcaagctgccacgtaatctccaggaactccaaatcctcattggccatcttgagaactatactagcgactacaccctagacgtgttcgtcggctagtgcaccgtgtagatcttcatgcagagcttcatgatcactagaacgatattcatgtcaa

SEQ ID NO: 6776 - DNA, 391 bp, Zea mays
  Clone ID: LIB148-039-Q1-E1-G4
agtcgtagtactgcagccagcgtgggcgcgcggccccggcgagcgcggcccggcgcaggcacagcggcctcgacgccgatcctctctggcgcgtggcgccgaccatggcccagcccgacgcggctgcggcggtccggtggcctggcccccacgcctagcatggggcccggcgcggccttagccagcgcggggcgcggctgcccagccacggcacggtggcacgggcgcgtaggcgacggccccgtccctgacggcgcgcgggcgcagccccggtgtggcgggcacggcctccagcgggcgcggccttagccgcggaggcgagcgcgcggcctcggcccgatggcgggcgcgaccccgtgggcgctaggccccatgcgcgacggtgcgggcg

SEQ ID NO: 6777 - DNA, 424 bp, Zea mays
  Clone ID: LIB148-039-Q1-E1-G5
tcgtgggtcgatacaaccctctaaattgaatcataatatccaaaggatctgatacaattacccatctagtgaccagtagtgaaccgacgaaaaggagtgatggcaaagaggtctcacacagcaaacatgagaacctggcacgggaagatggtaaccagaagggtgagactgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgggcatggaagaacgaaccgaagggcctcctgcttctggacaagc

SEQ ID NO: 6778 - DNA, 403 bp, Zea mays
  Clone ID: LIB148-039-Q1-E1-G6
aggcgccgccgattgttcatcccgcatcacggctggggaacagtggaagacgccggtttcagatctgccgtcgtcatccatggcgtgggcgctccgtggtctcattggcgcccgtatccgtggtggcctcggtgcgctgccccgcccatctacgccgccctgaaacaatggtgctgatctgtgtcgctcagcccatatgtgccgccctgctatttaatctgcacattatccttcaccacttgccaaaggaatctcatccacgaagtgctactgtgatattgttgcccgtgtttttttttctttctgcctggaatcctctcggacggcatacccacgtaaacgaagtgtaacttgcctcgaagaatatctcaagtgtcaaaggattgattattattctttgttt

SEQ ID NO: 6779 - DNA, 392 bp, Zea mays
  Clone ID: LIB148-039-Q1-E1-G7
gctctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatggagaagatctggcatcacaccttctacaacgagctccgtgtggctcccgag

SEQ ID NO: 6780 - DNA, 255 bp, Zea mays
  Clone ID: LIB148-039-Q1-E1-F2
ctctacgctgtacatccccatccaggcaacttcccaacccgtcaaaaatgtcaccaatgttgatttcacgggcattacttttaacgcgtccaaccatggaaaaagcctggcttaatgtaactgaatccctttgcgacaaatgcccctttctgaagctggagtaaaaacaaacaggccggcaactatcgcctttcctaacatttgccccgccgcattggcaatcggaacgcccattgtcccggcccattaaccgcg

SEQ ID NO: 6781 - DNA, 348 bp, Zea mays
  Clone ID: LIB148-039-Q1-E1-E10
accacgcgtccgggcggcggaagccaggaggctagcgccgcggaggcggaggaggaagtggtgagactgtcaccggagctggcgatgcacggcgccatcgacccggtgacgctgccgtcgtcgacgtcgaagcggcgcctgtccatcagcgtgagcaagaagctgagcatgaacatcccggacaagctgcggctgagccggcgggagcacaaggaccaccaccacaaggtggagtcggaggacacgctgtggaagaagggcatcatcctcggggagaagtgcaggatcccgggcgagagggatgcggagaccggcgagcccgtcgaccccgccgacgagatcgccgcc

SEQ ID NO: 6782 - DNA, 381 bp, Zea mays
  Clone ID: LIB148-039-Q1-E1-E11
cagagacgaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgatatactgcaagactggccttcttgtcgctgagcagggcgttgtcgggcagagcgggcaggctatctccatcatcggtggacctctcgccgcggtggtctcgaccccattccgcttggttaccacgaacatctatgggatggcggtga

SEQ ID NO: 6783 - DNA, 373 bp, Zea mays
  Clone ID: LIB148-039-Q1-E1-E12
ggtcgttacaattctctagagtgagtcatattacggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaaggggtcgacgttccacaggatcatcccggggttcatgattc

SEQ ID NO: 6784 - DNA, 417 bp, Zea mays
  Clone ID: LIB148-039-Q1-E1-E2
ctctacactacgccctggtacacttcggctggcgcaccgtctccgacggcgacggcatcaccgtcttcggctccaccaacgtgtggctggaccacctctccctctccaactgccaggacggcctcatcgacgtcatcgccaagtccaccggcgtcaccatctccaactgccacctcaccaaccacaacgatgtcatgctcttcagctccagcgacaagcatcccgaggaccagatcatgcagatcactgtcgccttcaaccacttcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgccca

SEQ ID NO: 6785 - DNA, 417 bp, Zea mays
  Clone ID: LIB148-039-Q1-E1-E3
ctctagaataattagtgcaagcctcttctttggcatgggtgcatctggcgtgatacctgttcttcacaagctggtcctcttctggcaccaaccggaggcattgcacacgaccggatacgaaattctgatggggctcttctacgggctgggagcattggtatatgcggcacgggtacctgagcgctggatgcctgggaagtttgacatcgccgggcacagccaccagctgttccacgtcttggttgttgccggagcctacacacactaccacgcagggcttgtgtacctcaagtggagagacctgcaaggctgctgaaaggtgctgcatcgttgaggatgtggatagattgtagattccgtgaattcaggctgaaggtcatggtctgttgtaaattgtaacagtaatcatgaaacaat

SEQ ID NO: 6786 - DNA, 413 bp, Zea mays
  Clone ID: LIB148-039-Q1-E1-E4
taagttcatgcatgccagcgccacagcctctcctgctgtcgctgctggtcgccgttgctaccggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaagtgcgctgcgtggacagccctagcgggtgcaagcccagcgcggcgacactggtggtgacggcgaccgacctgtgcccgcccaacgacca

SEQ ID NO: 6787 - DNA, 352 bp, Zea mays
  Clone ID: LIB148-039-Q1-E1-E5
gatacaagcctctaaaatgagtcgtcttgagcgaactggagacccgatgccgtctacacttccaacgtccaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatatacatgccatttttggaggcatttttttcatgagggcatgtttcgatatatggaccactaaatatacatatcatttactttcc

SEQ ID NO: 6788 - DNA, 424 bp, Zea mays
  Clone ID: LIB148-039-Q1-E1-E6
gtgggacgacacacgcctctacacagcgtcgcagtatcccggagcccagggagcggaggcgggcgggccggcgggcggccatggacgtggactgcgtctcgctgcccgacgccccggcgggcgacgtggatggcggcgccgcccggccgtggcccaaggccgtgaccaacggcggcgtccacgagctgctggagtgccccgtgtgcaccaactccatgttcccgccgatccaccagtgccccaatggacacacgctgtgttccacatgcaaggccagagtacacaaccgttgccctacctgcaggcaagagctgggcgacatcaggtgcctggcgctggagaaagtcgccgagtcgctggagctcccctgcaggtactactcgctggggtgccccgagatcatgccttactacagcaaagataa

SEQ ID NO: 6789 - DNA, 422 bp, Zea mays
  Clone ID: LIB148-039-Q1-E1-E7
acaaccctctagaatgagtcttattatggcgccggtgctggaatcgcagtctccttcttggcttgtccaacagaactgatcaagtgcaggttgcaagcccacagttccttacccgatgcagccaccgcttctggtgtggctcttcccaaaggtccgatcgacgtggcgaagcatgttgtccgggacgccggcgccaaaggtctcttcaagggcctggtcccgacgatgggacgcgaggtccctggcaacgcactgatgttcggcgtgtacgaagccacgaagcagtacctgaccggcggcccggacacgtccggcctcggcacgggctcccaagtcctggcgggcggcctcgccggctccgccttctggctgtccgtgtacccgacggacgtggtgaagagcgtgatccaggtggaccaata

SEQ ID NO: 6790 - DNA, 443 bp, Zea mays
  Clone ID: LIB148-039-Q1-E1-E8
tcgttggtcgatacaagcctctacattggttcgtcataccgacgagagttattaattaattcccgtcggccctacgtggccgacgggaattaactgggccgacgagcgttattaattaattctcgtcggttcgaccatagccgacgggaattaactgggccgacgagaattaccctatactgctacaaaaacagcactaaattaggtcactatttctgcacacataacatatatcacacataacataaatcacagataacagacacattacaaacacatgcatttagagatacaacatccacaaacacatgcatttagacataaacacatgcatttataattaaaatatccaccaacgagtacgacatagtattgaaacataacatccaccaacaagtacgacatattattgaaacataacatccaccaacgagttcgacatt

SEQ ID NO: 6791 - DNA, 397 bp, Zea mays
  Clone ID: LIB148-039-Q1-E1-E9
ctcgtgggtcgatacacgcgtctaaagagattcatgccaagaggagccattatcgccagcctcccgccccgtttctttctccttttgttgctgtttcttcattagcatgaacaaagttttctgccggtctgtcggcagccgctttctcctattcatcaagactgtaatgtctattgttgctacctaatgcttctcacttgtcattttggacacatgttcgacctattcaattttaatgagatgcctgatgaggctacttgcaaaaatacatgtggtgttctcaatgaataatatcaaatgttgagctctcaaaaaaaaaaaaaaatataaaaaaaaaaaaaaaaacaaaggggggaagcactaaaagatccaaacttaacatattgctgcatgcgac

SEQ ID NO: 6792 - DNA, 369 bp, Zea mays
  Clone ID: LIB148-039-Q1-E1-F1
gcgggtcgatacacgcgtctaaagtcactcgtgttatctccccctgccccacgatgcacgcagcatccatcatcgcccagcgctagcgctccgcgcggcctgcgctcaccacgccgcagctaggtgtcccgggcaacgccacctcccaactgcaagccggtgtacctccgcagcgtgcaaccattgctgacagcccgcagatgccgcggttcgttaccctgcacgaccaggcctagcccatgctcgcggtctgcctgccagcgcagcggcacgaccagctaacagtatcgtcgtcatgctcgtgtcctagtcgctcgttcagtgcgtcgtgcacgcagcatgtcatcgtatctcgcctcatctcgccgt

SEQ ID NO: 6793 - DNA, 396 bp, Zea mays
  Clone ID: LIB148-039-Q1-E1-F10
tcgtgggtcgatacaagcctctacactgacgtcgtattagatctccgttgccgggctggtcctggcactggcgtcgctgctgataatcgcgtgcgcaaccggcaagcagggcaaccgggggaggaagcgggagcggcacgcgtcgcgcaggcacagcatcgtggtgccggaacgtcagtgtggcgcagccgcgggcgtggtgtcggcggacgtgtaccagccgtcgaacgggccggcgccgtcgccgtcgccgagcgggacgtcgagctcgtacgacctgtcgggggccaacaagtcgtggttcacgtacgacgagctggcgggcatcacgggcgggttctcggcggcgaacgtgatcggcgaaggcgggttcgggaaggtgtacatgggccccct

SEQ ID NO: 6794 - DNA, 381 bp, Zea mays
  Clone ID: LIB148-039-Q1-E1-C11
ctctagaataagtcgtatgtaccagcgccggatcatcgagcggtcggggctgggcgaggacacgtacctcccggaggcggtgctcaacatcccgcccaacccgtccatggccagcgcgcgggaggaggccgagatggtcatgttcggcgcgctggacgagctgttcgccaagaccggggtgcggcccaaggagatcggcgtgctggtggtgaactgcagcctcttcaacccgacgccgtcgctgtccgccatggtcgtcaaccactacaggctccggggcaacgtcgcgagctacaacctcggcggcatgggctgcagcgcggggatcatcgccgtggacctcgccagggacctgcttcagtgccaccggggcaacctacc

SEQ ID NO: 6795 - DNA, 350 bp, Zea mays
  Clone ID: LIB148-039-Q1-E1-C12
agagtgagtcgtattagaagtagcaggtgagatcatcggttgatccatcttgcgaataatcctgcgtggccgtcgtgcttcctcgtctcgatcccgactacgctccgttcggctccgaggaagcacatcaagtcgcgatggagatgaagaaggtcgcctgcgccgtcatcgccgccgcggcctccgcgatcgtggtcctcgccgtcgaggccacggtgcccgccccgacgagcgcctcgtcggccgcgttcccggccgtcggcgcggtgctgggcgccgccgtgagctccttcttcggctacttgctgcactacactgagatgaggatcggagggagaggcagggggctg

SEQ ID NO: 6796 - DNA, 402 bp, Zea mays
  Clone ID: LIB148-039-Q1-E1-C2
ataaaatcccaggaaggtggtcggcgtctcactatcaaccaccgcgcggctccggtttaatttctcgtcaaccggcaagcgcaattctgtgcctcgatcgatcggtcgtaaggcaagtgagcaagctatatatatatatatatatatatatatataggagattcttcgagcgagctagtagcgagatgggttccgccgtcctcttttactgcatctgcatcgccgccgtcgtcgcattgtcgtcgtccatggtcgccgtcaggtccgccgcctcgggggaaacccccaagttcatctcggcgagcgcccttgagtgctccgctaacgtaacggaaatagcaaaggcgcgcaagctgatcgatgtccatggccacaggctgtgcccggtgcggttcgaccaca

SEQ ID NO: 6797 - DNA, 397 bp, Zea mays
  Clone ID: LIB148-039-Q1-E1-C4
agtatcaaggctctcctctcggacgtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcatggtgatgtccatctcgattctggatgagcgtgaacctgaggaggtgcatgctgtggatgccttccgccagcttcttgtacttgaagagctgctaccatcgcagcatgatgactaccacatgatgctaagatttctcaaggcaagaaagtttgatat

SEQ ID NO: 6798 - DNA, 410 bp, Zea mays
  Clone ID: LIB148-039-Q1-E1-C5
cgcactgccatgcgcgcggggtgatgcaccgggacatcaagtgcgccaacctgctggtgaacaacagcggcgagctcaaggtggcggacttcgggctggcgaacctcttcgcgccggcgccggcggcgccgctcaccagccgggtggtcacgctctggtaccgcccgccggagctgctcctgggcgccacggcgtacgagccctccgtcgacctctggagcgccggctgcgtcttcgcggagatgcacgcgcgccggcccgtcctgcatggccgcaccgaggtcgagcagatccacaggatcttcaagctctgtggctcgccgcccgaagacttctggcgccgcttggggctctcccacggcgccgtcttccgcccgcagcaaccttacccgagccgcctccgggacaac

SEQ ID NO: 6799 - DNA, 412 bp, Zea mays
  Clone ID: LIB148-039-Q1-E1-C6
tcgtaggacgatacaagcctctacagtgacgtcgtattagaaggcctcgtgccttctcttcctccctggcatggatgaagtagctgtttcgcctatgatcgttggcgccgtactgctggacaacaatggcgctgacgcggtctcctgcactgccatccactagcgtaacaataagcctacaggagaaagaacatatcaatggggatgttcccacgatcatctcggccgcaagcaaagatgaggaggcgttgttcagtgtccgagaatctaccaacgaccatggccatcgcttgacgatggaatgctccactcccgtttcctcgagtagcccttctactcgcaacaaccgcggggcgttcagcctcttcagggcgatgttcctgtccttcggtcggagcgacgacagcatgat

SEQ ID NO: 6800 - DNA, 425 bp, Zea mays
  Clone ID: LIB148-039-Q1-E1-C7
tcgttggtcgatacaagcctctacactcagtcgtatcataccttcatatacctagcagtgtctctgcatagaaagataaaaggtatgaggaggcgcagtgcgtggtgggattatttgtgaggagatattggagttattatatatatatatataggtagacgatagatagacagctagatctatataaccatggtggatgggttccgatggatcataccgggctctttcgtcctgtacttggtcttcttcttcctgtccgcagccctgtcggaggccaatatcggcgacttcgatgaatactggcagcagcgcaagctcatggtcgacgccgcggctgaggccacgtacaagcatgacccggtcgaggtcgccaaccaacttaaccgtgcagtccacagatccgtcgagaaggaggacattggcac

SEQ ID NO: 6801 - DNA, 402 bp, Zea mays
  unsure at all n locations
  Clone ID: LIB148-039-Q1-E1-C8
ccaggactaggactcgcgggtcgatacacgcctctatgatgagtcatatcacgggcatgtggagcgtccgctccaacatctgggagaggcagtacctcggcgagcagctgtacgtgagcgtcatcccgccggagcggtcgctcagggacgagtacaacatgccggagaccagcctccgctgcggcaaggtcgtcggcctgccgatgccaccgtcctaccgcgccgtctagagcgtcgaccgatcgcgcacggtgctgtacacaactaaaggagagcgagaggggactttttctcgcgtttccttctctagccagccttgtctgtcccctcctcgtttattctctctctctcttttttttcgttcgcttccgaggaataatagccaaaanaaaaataaacaat

SEQ ID NO: 6802 - DNA, 406 bp, Zea mays
  Clone ID: LIB148-039-Q1-E1-C9
tcgcgggtcgacacacgcctctacagtgcgtcgatctagagggcgagcgatggcggggcccctgtgcgggcaagcggcggcatccccggggccctgaggcggcgacactcccaaggctagcgagcaagcggcgctctccgacatgcgagtagctacggcaccgcacaaggcacgaggtttgagcagcgtcatggaaggcgcgaggtgtgtgcagcgatgatcgcgcgtgacatcctccgatccagcgcagttccggcggcctgagtgacgacctccatctgttcttgtgtcatcaacgacgtcctccgatgactacctcctctaattcgtgttgtctttcgattattatgttttatgcctaccacatgcactatttacgctaaaaactataacgattttatgcttg

SEQ ID NO: 6803 - DNA, 395 bp, Zea mays
  Clone ID: LIB148-039-Q1-E1-D1
tacacacacgtctgcaattcgttcctttcacaccggagaccggcgagcagagccgcgcacagcagaacgcggaagcaagaggaggcgatcgactactcgaccagccctctccgctcttgtctccgatggcggctcgcgtcctcgcggccctcgcccttgccctcgccctcgccctcgtcgccgtacccgctcccacgcgggcgtccaacgacgagggggacgcgctctacgcgctgcggcagcggctgtcggaccccaacggcgtgctgcagagctgggatcccacgctcgtcaccccctgcacctggttccacatctcctgcgaccaggtcggccgcgtcgtccgcctggacttgggcaactccaacgtctccggctccatcggccctgagctc

SEQ ID NO: 6804 - DNA, 339 bp, Zea mays
  Clone ID: LIB148-039-Q1-E1-D10
acggacgcttgggcgacgggcagggagccctggtgtggaacaagaacgagtgccagcgttcctacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcg

SEQ ID NO: 6805 - DNA, 367 bp, Zea mays
  Clone ID: LIB148-039-Q1-E1-D12
tgacacagacgtcctggtagggcatgggcgaagctaagctcaacagcgtgaccgtcctgctggtggacctccgcctcctgagcagtggcgttcaggacgctgccgccatgccaggcacgttgaactacgacgcgattgtcgccgacgagccaaacggaaagaacaaggacctgtgccgcctcgtcgccaacgccaatagatacacccgcgggtgcgagcccatagaacgctgcatgggcgcgcgctgatcagtaagcatatacatatagcacatcgatttcttaatattgcatgcacgtgtatataagtgctcattgtcttgctgttgtaagtgccagcacaagcatatgtacggcgtttatgtata

SEQ ID NO: 6806 - DNA, 411 bp, Zea mays
  Clone ID: LIB148-039-Q1-E1-D2
ctctacacatggctcctactacatcgtgcccgacctcctcttcttcggcgcctcctgcacgcgcctcaccgatcgctccgacgccgtcgaggtctccgccatcaaagccgccatggacgccatcggggtccccatgttcggcctcgtccgcgtcagctacggcggcttcgtcgcctaccggatggccgccatgttcccggaggcggtccaccgggtcgccctggtctgcgctggggtctgcctcaaggatatagacctggcggagggcctcttccccgtggcctggatcggggatgccgccgcgctgctcgtgccgcatcgcccggaagaagtgcgccgcctactccgcctcagcttcgcgcgcacgcacctcatcatgccctcctgcttcctatgcgactacatcaaggt

SEQ ID NO: 6807 - DNA, 153 bp, Zea mays
  Clone ID: LIB148-039-Q1-E1-D3
taaagacacttgggccaatcagaagctcgctctctaactgactcatggggagagttcttttgttggacggagagttcaaaatccaaaaatcttggtgtatgtacagttgtctatgaggaatactaacacgtcttgcagtgcttctgcctctcc

SEQ ID NO: 6808 - DNA, 399 bp, Zea mays
  unsure at all n locations
  Clone ID: LIB148-039-Q1-E1-D4
aacacgcttccgctcggcgacagcgacggggaaggcttgagcctcgtcctgtacttcagggtgtccgaatgctacgacaaggaggtttccgaacatttcaaggagtctatgatgaggtttttcgaggacgaaaccgagaaggtgaaagggttcacgtcagaatccactgtgagctacagagatcggctgaagatcatggccggcctggtcaacccggacgacctccagctgggctctacggagaggaagctcgtccaggcgtacaacgagaagccagtcctctcgcggccccagcacagcttctacgagggagaggactaccttgaggtggaccttgacatccaccggttcagctacattgctaggaangggctggactcgttcaaggcacgcctcaag

SEQ ID NO: 6809 - DNA, 434 bp, Zea mays
  Clone ID: LIB148-039-Q1-E1-D5
ctcgtgggtcgatacaagcctctaaactgagtcgtatcacggcgcggcccaacccgcaggggtcgtaccactacggccagatcaacatcacccgcaccatcaagctcgccatgggccgcggcaaggtcgacggcaaggagaggttcggcttcaacggcgtgtcgcacgtggacccggaaacccccgtgaagctcgccgagtacttcaacgccagcgacggcgtgttcaagtacaacctcatcggggacgtgccgccctccaacacggcccccaccaagatggcacccaacgtcatcagcgccgagttccgcacgttcattgaggtggtcttcgagaaccccgagaagagcatcgacaccatccacatcgacggctacgccttcttcgccgtcggcatggggcccggcaaatggacggcagcgtcgcggagtacg

SEQ ID NO: 6810 - DNA, 388 bp, Zea mays
  Clone ID: LIB148-039-Q1-E1-D6
acaaccctctaaactgagtcgtattatggggaggtgatgatgctttcagcaccttcttcagtgagagttgagctgggaagcacgtctcccgtgctgttattgttgacctgtgatccctgtgtcagcgatgacgtgaggactggcacctagcgccagcgcttccatcctgaacaactcatcagtagcaaggttgatgcagcctacaacttcgctcgtggtcaccacatgattggcaaggagattgttgagctgtgcattgactgcatcaggacacttgcatataactgcactcgtctccaaggcatcctcgtcatcatcgctagttctggaagagttggctcttggcttggatctctccacctgtattgcttgtcagtggactatggca

SEQ ID NO: 6811 - DNA, 355 bp, Zea mays
  Clone ID: LIB148-066-Q2-E1-G1
cacgccgcgccggtcgtcgcgttctgcgacgcgtacgccttcggcgtgacggacatgaacctgtcgagcacctacggcaagctcgccatggtgctcgtgggctccagcgtggggcgcaacgacggcggcgtcgtcgccggcctcgtggcctgtgggatcgtgatggggaccatgtccaacgccaacaacctgatgcaggacctcaagacggggtacctgacgctgacctcgccgcacaccgtgttcatcagccaggccatcggcacggcgctcgggtgcgtcgtcaacccggtcatgttctgggccttctacagggtggtgcagaacggcgacaccgacgtcttcgacgcgccct

SEQ ID NO: 6812 - DNA, 404 bp, Zea mays
  Clone ID: LIB148-066-Q2-E1-G10
cgtccgagttcacgctaggtagattaaaagttatctcaggtgcttcactaggaaaaaatgaagtaccttagttaagttttgtaacaaggatatttgatcagtgcatgtcaaaggagggtatcaaaccaacgtgtcatatgactgtctagcttatgaatgttgctcctgttttatcacccctgaaggccaagcacacaatcatcctttattgatggctcacactggaaacttgagccagcgtgatcacacaatcgatataccaatgagtgatggtatgaccgcatcaacatctcaccaggatgatcatagtggctcggatgagctgcatcgcagcagaggtccttcgaatgaagtttcaccaagcccagatacatcttccggtacaaacgatgtatccaactctc

SEQ ID NO: 6813 - DNA, 354 bp, Zea mays
  Clone ID: LIB148-066-Q2-E1-G11
acgacgcgcaccaggggaggaagcagttccagcaggaggtggaggtgctcagctgcatccgccaccccaacatggtgctcctcctcggtgcgtgccccgagtacggctgcctcgtgtacgagtacatggagcacggcagcctcgaggaccggctgttccgtcggggcggcacgccgccgatcccgtgggcgcagcggttccggatcgcggcggagatcgcgacggcgctgctgttcctgcaccagacaaagccggagccgctggtgcaccgggacctgaagccggccaacatcctgctggaccgcaactacgtgagcaagatcagcgacgtcgggctggcgcgtctggtgccgc

SEQ ID NO: 6814 - DNA, 342 bp, Zea mays
  unsure at all n locations
  Clone ID: LIB148-066-Q2-E1-G12
agccaaaagtnnctgctgctgttcttcgacccgtcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcct

SEQ ID NO: 6815 - DNA, 304 bp, Zea mays
  Clone ID: LIB148-066-Q2-E1-G2
cagacacgtgggcgagtcgctgacgttccgggtgatgaccagcgaccaccgcaaggccacctcatggcacgttctccccgctgactggaagttcggcgtcacgtaccaggcatccaagaacttcgaagtagccactttccctcctcttcttcatcctgcatatgcccacaagcaaccatgcaaatgataacatgcatcatgcatgcatattcattctttcgctcatgcactccaatatggtgccggagttaaaaaaatgtagatcaatgtgcaaactcaaatgacatcttaaccagttgtgatc

SEQ ID NO: 6816 - DNA, 395 bp, Zea mays
  Clone ID: LIB148-066-Q2-E1-G3
aacagccaaccccatcttcatcgacatgaagtactgccccaacaagttgtgtactgccaacggcgcctccaaggtcaccgtcaaggacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattacatgccatccattggtaacgcacaacagttaaacgacagaca

SEQ ID NO: 6817 - DNA, 449 bp, Zea mays
  Clone ID: LIB148-066-Q2-E1-G4
acgcgtccgaatttctcctagaaggtcgagaggagaagaaggcgagacgtgcagtccgtcgggctccgatcgagaacagggaagcaagaggctgctagagatcgagctcatcaaccaatcaagtcgtacgtcgtcagcatcacgcgaccggatggcgcgcgccgcgtccagctatgtatccaggagggggctctccgcagcgatgacggtggcggaggactccgtgaagaaggtggaggacaaggcggtgaagctgggaactgtggccaaggacatcgccagcgccatggccaccacgacggaggagaagacggcgttctgggaacctgaccccgagaccggatactaccgtccggtcaccggcacgaaggaggtggacgccgccgacctgcgcgccgagatgctcaagcgggggattctgcaggacgactgatgcatgcaacatgcac

SEQ ID NO: 6818 - DNA, 287 bp, Zea mays
  Clone ID: LIB148-066-Q2-E1-G5
gtcgtcatcgtcgtgggccttcatttcgcctagaaggtcgagaggagaagaaggcgagacgtgcagtccgtcgggctccgatcgagaacagggaagcaagaggctgctagagatcgagctcatcagccaatcaagtcgtacgtcgtcagcatcacgcgaccggatggcgcgcgccgcgtccagctatgtatccaggagggggctctccgcagcgatgacggtggaggaggactccgtgaagaacgtggaggacaaggcggtgaagctgggaactgtggccaaggaca

SEQ ID NO: 6819 - DNA, 428 bp, Zea mays
  Clone ID: LIB148-066-Q2-E1-G6
accacgcgtccgcccacgcgtccgccatgaccttaggtcacggtttggtatcatacctcaggaacctgttctctttgaagggaccattaggagcaacattgatccgcttgagcagtattccgatgatgaaatctggcaggcattgggccgctgtcagttgaaagaagccgtagcttcaaaacccgaaaagcttgatgcttcagtcgtcgacaatggtgagaactggagtgttggacaacgtcaactgctatgcctgggccgggtgatgctaaagcacagcagaatactgttcatggacgaggccactgcttccgttgattcccagaccgatgctgtgattcagaagatcatccgggaagactttgcagcttgtaccattatcagcattgcgcacagaatacctacggtgatggactgcgacagggtcc

SEQ ID NO: 6820 - DNA, 317 bp, Zea mays
  Clone ID: LIB148-066-Q2-E1-G7
gacgccgccaccaacgctgccaccgtcgtccccggacgaccccgcggagccatcgtccatggggcgggagatggacgacgaggacctggtggaggagctcctgctcaccgtcaacgcggcgcgcgccttcgcggagttccggcgcacgcagcgcaaggagtgcgccaacctcctccgctggctgcagctcgtcctcccgctcctggaggagctccgcgacgccgcgccccggctcaccgacgacgcctaccgccggctcgcccttctcggccgcgcgctcgccgccgcgcgacgcctgctacgaacctgccacgacg

SEQ ID NO: 6821 - DNA, 425 bp, Zea mays
  Clone ID: LIB148-066-Q2-E1-G8
accacgcgtccggcagcctgcggctgcagcggcaggcgtgctgcgagccgtcggtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagc

SEQ ID NO: 6822 - DNA, 388 bp, Zea mays
  unsure at all n locations
  Clone ID: LIB148-066-Q2-E1-G9
accacgcgtccgcttgtcaaccaatcacaaagatggagtttgagtttgaaaggagaagagtgacaaaagaagacattagggagctgatattccgtgagatattggaatatcatccacaactgctcaaagactatatcaatggcacggagaggacaacctttctgtacccaagtgctgtcgaccaatttaggaagcaatttgctcatcttgaagaaaatagtggaaacggacctgtgattccaatggaaagaaaacatacttctcttcctaggtctactattgttcactcatctccaattcctgtcaaggaacaaccccgtatcggcccatgtanggaaaggccttcatctgatgagtcctacaggaatcctcgggagacagaacaata

SEQ ID NO: 6823 - DNA, 329 bp, Zea mays
  Clone ID: LIB148-066-Q2-E1-H1
aatttcagcaaggatatggagtacaccccctgcacagcaagttcctttgtatcccacatctcgctgctcgaggaagttcttggctggaggttttgtctttacggagacttcctggtcatctcttttgtcaactgcacttgaggatcaacccacacttagtgactgccttgcctggtcccatgctgtcagacattagagttgcccagtgattacactattacagtgcagctgtagcacatttatttgagcatggtggatctgtttctctggcaacattccagtaatctttgtcttggtgctaatcagccagcagaagtttacatcaagac

SEQ ID NO: 6824 - DNA, 171 bp, Zea mays
  Clone ID: LIB148-066-Q2-E1-H10
acccacgcgtccgccacgcgtccgggagtggaccggccggttaacggatctctcggtgctaattcgtgatcttgaccggtggaagcagatggggtttgcatgtttgtttcattcttgcattgattgttcgttgttaactagtgtatgatgaatcggtcgttaacgcttatt

SEQ ID NO: 6825 - DNA, 240 bp, Zea mays
  Clone ID: LIB148-066-Q2-E1-H11
atcgaaaggagaaccagcagcctccaataagagccagccagagaaactaatagaactctcgccgccgccatccgagcgaacaagccatccgaccccgtccccaaggcaatccgccgccgacgtaccaccatcaccgcacgagcgagatggacatgaacacgatcctcttcgtcgtcctcatcgtcatcgccgcctccgccaccgcagtggtgggctcaccgacgccgccgcctcgggccc

SEQ ID NO: 6826 - DNA, 333 bp, Zea mays
  Clone ID: LIB148-066-Q2-E1-H12
aggacgagtgggcggagatggagatccccgaggagtatatcgagtccctgccgaagaacggaaggtccattcttggagactccatgtacaagatcataaccgacgacgtcttcgaccccaacgagctcctgcagtccgtggacctgtcgacggagcacaagatcgtggacctcaaggaccggatcgaggcctccgtcgtcatctggcaccggaagatcagcaacaagctctcgtggggccccgccggcgtcagcctggagaagcgggaggagttcgaggagcgggcgcagaccgccctgctcatcctcaagcacaggttccccgggatccctc

SEQ ID NO: 6827 - DNA, 386 bp, Zea mays
  Clone ID: LIB148-066-Q2-E1-H2
cacacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggagaaaacaaaaaaaattggggggggcctttaagggtttctgtttttttttaccctttcttgaggtttcaaaattttccattgggggcccttatttttaatcccggggccttgttttaaccctgggttaccgggaaaaacccgggttttaccaattttaccttttttgaacgtattccctttttcgcaaggtgggtaattttccattgggccccattttttccccttttcaaaaa

SEQ ID NO: 6828 - DNA, 349 bp, Zea mays
  Clone ID: LIB148-066-Q2-E1-H3
ggagtctgaagtacgcaactggtgctttcagatatttcaggctcttgcttacatgcatcagaggggctactttcatcgtgacctcaaacctgagaatctgttagttagcaaagatgtcataaagctagcagactttggtcttgcaagggaagtttcatcattgccgccatatacagaatatgtctcaactcgctggtatcgggcaccagaagtattgctccagtcatctgcttatgattctgcagttgatatgtgggcaatgggtgccataatggctgagttgttgacactccatcctctctttcctggaaccagtgaagctgatgagattcacaagatatgcaatgtc

SEQ ID NO: 6829 - DNA, 359 bp, Zea mays
  Clone ID: LIB148-066-Q2-E1-F9
acccacgcgtccgcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcaactcctcctcggctggctgggcgacaagctcgggcgcaagaaggtctatggcatgacgctcatgctcatggtcctctgttcc

SEQ ID NO: 6830 - DNA, 350 bp, Zea mays
  Clone ID: LIB148-066-Q2-E1-E3
gcgtccgaagagaaccagcagcctccaataagagccagccagagaaactaataaaactctcaccgccgccatccgagagaacaagccaaccgaccccgtccccaaggcaatccgtcgccgacgtaccagcgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgggcccgccct

SEQ ID NO: 6831 - DNA, 426 bp, Zea mays
  Clone ID: LIB148-066-Q2-E1-E4
ggtcgacataccgggtccagcacgcgtccgcatcgcatgcacctcgtttccctcggcggtggatcagtggcggcttggtcgagatgggcgatgcggttgatgacatcatctgtgcaacggatgcggcggtcgccgtcgaggatgcggccagtgggaagcccgcaatgctctctagcttaggggggcagggtgaggaagagcatgaggagaaggacaatgaggacaagtcaggcgagagcgaggtgatcaacccgccagaagacgctggcggggaggccacctcacccctggaagggttgaagcctcgcctttccaaggggaatcaaagccatggacctaatgctgtcaaatcaaagagcccaacgagtggagacgaaggtcagacgaggaaaaaggctcccaattcttctcttcctaaagcaccca

SEQ ID NO: 6832 - DNA, 417 bp, Zea mays
  unsure at all n locations
  Clone ID: LIB148-066-Q2-E1-E5
aaaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtntgtgnccatcgacgacctcctggccggcgccgacaagggtggc

SEQ ID NO: 6833 - DNA, 267 bp, Zea mays
  Clone ID: LIB148-066-Q2-E1-E6
actttctactcctcatctttccattttcttactaagcaaaacaacttcgtttggacagcatctctatggcataccctttcccgtaggtcacgggggggtccacatttttcctcaataaattatcgctcttctcccagactcttcatctacgcaatggattccaactccggattaaacctactcatcccttcttacattacccaaacaaaccagatcaaaggctgctccctctgctaataactcattctactcttccccatcccttac

SEQ ID NO: 6834 - DNA, 311 bp, Zea mays
  Clone ID: LIB148-066-Q2-E1-E7
attctccatcatgctcgccacgacgacactggctacatttttcgtgattggttcgtgcaccaccccgctcaccttcgaggtcggcaaaggctccaagcctggccacctggtcctcacccccaacattgccaccatctccgaagtggagatcaaggagcacggtggcgatgacttctcctttgagctcaaggagggcccggccggcacctggacgcttgacaccaaggccccgctcaagtaccccctctgcatccgctttgccgtcaagtctggcggctaccgcatcgccgatgacgtcatccctgaaaatt

SEQ ID NO: 6835 - DNA, 443 bp, Zea mays
  Clone ID: LIB148-066-Q2-E1-E8
aggacgcgtgggctcctccctcctccccaccccaccccaccccatcccacctcggatctgctgcctccaccgtttcaatccacatgcgagcggaaatcgagcgggcgaattgaatcccgtcccgttcgggctcggccagcgagcgagcggcgtccggccggctgggcattggttcgtgctcgctcgatcgatcagaaaatggcgcatcgtgtgaacaacgagtacgactacctcttcaagatcgtgctcatcggcgactccggcgtcggcaagtccaacatcctctcgcgattcacgcgcaacgagttctgcctcgagtccaagtccaccatcggcgtcgagttcgctacccgcaacctgcagatagacgggaagactgtcaaggcacagatatgggacacggcagggcaggagaggtaccgcgccatcaccagcggctacta

SEQ ID NO: 6836 - DNA, 385 bp, Zea mays
  Clone ID: LIB148-066-Q2-E1-E9
acgagcacgagctcagggccgtctctgtcggccaccaagtcctcgcccaacctctgcggcacgcccagcccaggtagccctggtgcgcactctagtaacgccttggagtcatggaagatttgcaacccaggagataaccctctgcttgtgaagacaaggctcaggcactgggctcaagtagtggcttgttcagtgaagcactcgagctgatcctcgtcagtgttttattcacgctcttcttccatacataatacccgtacaagtggttgcgatggcgatgaattagtcgtgtccgagtgaaactagatcaattgaccttgttgctcgatctaatgtcgtcccaggtcacattgttgtggacagatttaattagcgtcgggttggc

SEQ ID NO: 6837 - DNA, 272 bp, Zea mays
  Clone ID: LIB148-066-Q2-E1-F1
gggtcgagcacgcgtccggcaagatcgtggatgggggttccacgacctctcctgatgtcgctggtggccgccaggccagcagtggctgccgatatctcaaaatccggccatgcaaaacccctgacatctggagggtgcctggtacaggacaaggacagaaagttcacagccggggcatggaaaccagccaatccaacattctacggaggacgggacggatcagggaccacggcgaggacgtgagggtaaaaggacacgcgcgcacaagggta

SEQ ID NO: 6838 - DNA, 387 bp, Zea mays
  unsure at all n locations
  Clone ID: LIB148-066-Q2-E1-F10
aggacgcgtgggttcggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaggtgggcatgaccagccgctacgcgtccgctgaggatctgcaccagatggacagcgaccaggaagagggtgctganggtggcgatgacggtgacagc

SEQ ID NO: 6839 - DNA, 368 bp, Zea mays
  Clone ID: LIB148-066-Q2-E1-F12
cccacgcgtccgaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgagagcaatgtctttaaaaccatgataatgtgtggtcatccactcatccatggatacatccttgctctccct

SEQ ID NO: 6840 - DNA, 439 bp, Zea mays
  Clone ID: LIB148-066-Q2-E1-F2
caccacgcgtccgcccacgcgtccgggcggttgtaggggaggaggtggaggcggaggcggaggccggtgcatcgtctgcgaagaagaaccgtatccaggtgtccaccaacaagaagccgctctatttctacgtcaatctcgccaagaggtacatgcagaactacgacgaggttgagctctccgctctggggatggccattggtaccgtggtgaccgtcgctgagatcctcaagaacaatggcctcgccactgaaaagaagatcctcacatcaaccatcggcaccaaggatgaggcgaagggccggcttgtccgtaaagccaagatcgagatcctgctgtgcaaatcagagaacttcaacagcatcatgtcgagcaagaagtccgagcgcccgaagccgcccgccgaggaagagataaggtgtgatctatccgaacaacg

SEQ ID NO: 6841 - DNA, 378 bp, Zea mays
  Clone ID: LIB148-066-Q2-E1-F3
cggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagccctggtggtgacggtgaccgacc

SEQ ID NO: 6842 - DNA, 415 bp, Zea mays
  Clone ID: LIB148-066-Q2-E1-F4
caagaacgcgctgccgcggtacgacggcacggcgcacgaccaggtggtcaccacggccgccgagcgcgccgccgaggaccggatggtggccttcacgtacctgcgcatgggccccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccggccgggacgggacgggacggaacggaagcctacgatcgactgtacatacaggggttgggacttgggagggagctcgggttcttgttgggttttcctttgggtggagagcgagggagcgcagtcgagagccagcgagca

SEQ ID NO: 6843 - DNA, 151 bp, Zea mays
  Clone ID: LIB148-066-Q2-E1-F5
cacacgcgtccgctagctccttgatgacttgatgacatagctacgaaggaaatagctttacatctcgctgttctaggcagcagaagttttgtttgcactttgcaaaactgtatatccttctcagctgtctcattgtaacccattctttttc

SEQ ID NO: 6844 - DNA, 417 bp, Zea mays
  Clone ID: LIB148-066-Q2-E1-F6
atccgaaaggacagcactctgatcatgcagctcctgcgcgacaacttgaccctatggacttccgacaccaacgaggatggcggcgacgagatcaaggatgctgctgccccgaaagaatctgcggagggtcagtaagatggattcagtctcacgacctgctgctgctgatgttgaggagtaaccagaaccagaaccgccgtcctcgattctgatagattatcttctagtataccttgtgttgttgctgttgtcgtcgtcgcgccggtgtatgcgatgaagctgccattgctgctgttttaattaagcattctagatgttataccgcatgctttgtttcggtttctaatgtcgataaatggtggccggatgctggttttcgtgctccgagccggccaccaggaagaagacctgcctgcc

SEQ ID NO: 6845 - DNA, 325 bp, Zea mays
  Clone ID: LIB148-066-Q2-E1-F7
aaaggacatcacccggtgccgctgccggtcgccctgcaatcggtggcagacgatgtcgccaacgccggacagacgaagcgcctaactcctggtgggcgcgtagcataggacaacgagaggggggttacggccgggccgtggaaacctgtcgaatcatccttctgaggaaggcgtacccgatccggcagcagcgcggccgcatgcgggtataacgacacccgcactcacgggtaacgctttcaatcagtgacccctcaccactgtgctgttcggtgactggcgcagcctgcggatgttcctaccatgtgcgatgcttgcacagccc

SEQ ID NO: 6846 - DNA, 437 bp, Zea mays
  Clone ID: LIB148-066-Q2-E1-F8
atccgatcgtttctcattcagcgcccgtacagccaccactcaaccgagccatatcgaaagttctcaacatcgcttcgtgcagcctgcatcgatcgacgagggctgcacgaacgatggggtccgcctccgcctcagtgatgacgaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggctggagtcgtgcagaccgacccccgctgcctctgcatggtcctggacggcaccgccacgtccttcggcatcgccatcaaccagaccagggcactggagctccccggcgtctgcaaggtcaaggcgccgccgctc

SEQ ID NO: 6847 - DNA, 336 bp, Zea mays
  Clone ID: LIB148-066-Q2-E1-E2
gcgtccgaaacgacgtggacctggcgcacaacgtgacggtgcccaggttgacggtggagatggccggtggcgcgaggctagagccggaagccaagagcgtggtgatgccggatgtagtacccgggtgcgcgtgcctggcctttaggaagctgccgcggggagggcccgggatcttgggcaaagtgctcatgcaggagtacatctgggagatcgaccaccgtcaggggaagatgaggttcaggaaggcgaagtggaggacccatcatctccaaaccagctcacgctgagacgtctatcataattagaatggcatttcctccactactgtcgtgcagc

SEQ ID NO: 6848 - DNA, 435 bp, Zea mays
  Clone ID: LIB148-066-Q2-E1-D1
ggctgtccatgtcctccaccttcgtgggcaactccacctccatccaggagatgttccgccgcgtgagcgagcagttcacggccatgttcaggcgcaaggccttcctgcattggtacaccagcgagggcatggacgagatggagttcaccgaagccgagagtaacatgaacgacctcgtcgccgaataccagcagtaccaagacgccacagccgaggagtacgacgaggaagagcaggacggcgaggaggagcacgcctgatcgatgcaacgggattcagagtcttcgctgctgtggtacatcaattgggactataagttcctacaatcctatactaccttaagcatatgtattcatgcacttccgtatttccgttgctgctgctagcttgtgtgtgtgtgtgtgtaactacaatcgtgtatgttagtgttttgtg

SEQ ID NO: 6849 - DNA, 390 bp, Zea mays
  Clone ID: LIB148-066-Q2-E1-D10
ctgatgatgacggtgttcatgctggggctggccgtgccgtacgagcactggacgacgccggggcaccacatcggcttcatcgtcatgtacggcctcaccttcttcttcgccaacttcgggcccaacgcgaccacgttcatcgtgcccgcggagatcttcccggccaggctgcggtcgacgtgccacggcatctcggcggcgtcggggaagctgggcgccatcatcggctccttcgggttcctgtacctggcgcaaaaccgggacccggccaagacggaccacgggtaccccgcgggcatcggcgtgcgcaactcgctgttcctcctcgccggctgcaacctgctgggcctggcattcacgttcctggtgccggagtccaagggcaaatcc

SEQ ID NO: 6850 - DNA, 335 bp, Zea mays
  Clone ID: LIB148-066-Q2-E1-D11
acaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactac

SEQ ID NO: 6851 - DNA, 302 bp, Zea mays
  Clone ID: LIB148-066-Q2-E1-D12
atcaactcccacgaggttgggtcgagtcgcatgaaccaggagggcgccgctcagggtgaaattatcgtcgagaggcgagtgcacatctgtggctccatcgatcagtcggtcctagagaacgtgcacacagtgcacatcgataaatgatatacatcgacaagcaagtgatggagatggatttcgacgtcggcatttactgtagctgcatcgccgtcgtcctcacaatgtggacgggaaggaacgacgtcgaggccgccgcgccgatggaaacttcaaggtcagcacgactagcgcccttgagt

SEQ ID NO: 6852 - DNA, 444 bp, Zea mays
  Clone ID: LIB148-066-Q2-E1-D2
gacaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcagcgggccatcacgttcaaggacaccggcaccgccaagatcatgctgcagctcgccgtccaggacttcgactcgtgcgaccgccccttcacccaggccggcgtccccaaacccatggggaagtttgacaaggagctcaaccagatggccaacaactgcatggctcttgcaaacatgata

SEQ ID NO: 6853 - DNA, 377 bp, Zea mays
  Clone ID: LIB148-066-Q2-E1-D3
gactccaccctccttccaagggccacgatgagggcgcctctcctctcctcgctcctcgtcctcgccgtcgtcgccaccgtgcctctactagtcccggcggtgtgcatctcgcggcacgacaagtccgagagcaaggctgacgaagaagctgctgctactaccgttgccgccgacgagcatggctctgtcaagaccatgtccctcgacgcatacgggccactggagatggccgccaagaagcccaaggagcaggtcctgaacgcgcaagctacgccggcgacgaccgctggcgctgacacatatgaccagaaacccgttggtgaaaaacaggctgaaacggccacggcctccgctgccgatgaacaacccgacaaata

SEQ ID NO: 6854 - DNA, 440 bp, Zea mays
  unsure at all n locations
  Clone ID: LIB148-066-Q2-E1-D4
cggacgcgtgggcgcgagcgcagaaggcacacacgtacagccatggcgaactcgtcgtccggcctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttcccctggtcccctgatactgcacgcacccggagcaagatgctgtacgccagctccaaggacaggttcagganggagctggacggcatccagtgcgagatccaggccaccgaccccagcgagatgagcctcgacat

SEQ ID NO: 6855 - DNA, 400 bp, Zea mays
  Clone ID: LIB148-066-Q2-E1-D5
catcgcggtcgcgggggtagggccgggtgagcacgagcgctgcccgctcgctgaaccatggcgggctccgcggtggccgtcgtcctcctgtcggccgtcgcgctgctctgcctgtaccacctccttttcctctccctgtccgtcccggacccggcagcagcagcagccgtcccccgccgcgccggtggccaccatggcagcaacgttccgtccgggtcaggaaccgccaacgtcgtcctccgcttcggcctgtccgggcagccgctccgcctccacgaccccgcctccgccgccggcctcccggacatcgacaccttccgcggcaagctcgagcggctgcttcctcccgacgaccacgaccccggctggtcccgccgcttcgacgccgagctcgggcccg

SEQ ID NO: 6856 - DNA, 442 bp, Zea mays
  unsure at all n locations
  Clone ID: LIB148-066-Q2-E1-D6
cacctcgtctcaccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccangtggtgctggtggccagcccg

SEQ ID NO: 6857 - DNA, 407 bp, Zea mays
  Clone ID: LIB148-066-Q2-E1-D7
attcgccggtccacccacgcaaccgattggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggtgtgctccggcaagcccgtggtggtgcacatcacggacatgaactatgagcctatcgcggcgtaccacttcgatttagcaggcacggcgttcggccccatggcc

SEQ ID NO: 6858 - DNA, 455 bp, Zea mays
  Clone ID: LIB148-066-Q2-E1-D8
aaccgacgaaacaaaagaagctattttgacaccacacacacacacacagaggagagaagataagagaacgaggggcagggcagccagcgccgctagctgaagcaaggcagggcaagagaatccgtacgtcgaggacttcgacaagctccaccgcgcgctcggggacgccttcttcggcgcactgggaggccaggacgacgccaccgccgcggcggacggcgccggcgccggcgccggcgccgaggaggacgagcaggagatgcgggaggcgttcaaggtcttcgacgtcgatggcgacggcttcatctccgccgctgagctgcaggaggtgctcaagaagctcggcctccccgaggccagcagcatggccaacgtccgggagatgatctgcaacgtcgaccgcgacagcgacggccgcgtcgacttcaacgagttcaagtgcatgatgcagggga

SEQ ID NO: 6859 - DNA, 368 bp, Zea mays
  Clone ID: LIB148-066-Q2-E1-D9
gggccgagccccgcgtccaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttc

SEQ ID NO: 6860 - DNA, 394 bp, Zea mays
  Clone ID: LIB148-066-Q2-E1-E1
cgacggcgtggacctggcgcacaacgtgacggtgcccaggttgacggtggagatggccggtggcgcgaggctagagccggaagccaagagcgtggtgatgccggaggtagtgcccggggtggcgtgcctggcctttaggaagctgccgcggggagggcccgggatcttgggcaacgtgctcatgcaggagtacatctgggagatcgaccacggaaaggggaagatgaggttcaggaaggacaagtgcaacacccatcatctccacaacagcaaaggcggagaggtctataataataataatggcaattcctcctctactgtcgtgcatcgcgtcaattaattcgttctctcttctctatctccacaaaatttaaggaccagaccatgcatgcac

SEQ ID NO: 6861 - DNA, 393 bp, Zea mays
  Clone ID: LIB148-066-Q2-E1-E10
aagaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacg

SEQ ID NO: 6862 - DNA, 396 bp, Zea mays
  Clone ID: LIB148-066-Q2-E1-E12
cagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagtgatgtggtgtccacttctagtgaaactactgtctgccgttt

SEQ ID NO: 6863 - DNA, 450 bp, Zea mays
  Clone ID: LIB148-066-Q2-E1-C9
gggtcgagcacgcgtccatcaccatccgcctcactaccgagggaggcaccaagtccgtctacgacgatgtcatccctgccaactggaaggccaacaccgcctacaccgccaaataattaactttagtgctgacaatactttaagccggcctatgctagctatactagaattggttggatcccaagcaatgcattacacatgcatgcattggaccgtgatatctatttgctaccactaccctattacgacagtgatgctggcgccaacaatgatggtgtcatcctccttctccatcttcttcatctccatatatagctagagtgagacttcgctgttgtttaaaagagaagagttaagaaatggattgacaagttaaaaaaaaaaaaaaaaaaaaaaaaagaaaaaaaaaaaaaaaagaaaaggaaaagaaaaaaaaggaaaggagaacag

SEQ ID NO: 6864 - DNA, 384 bp, Zea mays
  Clone ID: LIB148-039-Q1-E1-A6
tcgcgggtcgacgcacgcgaccggacacactcgtggtagactattaggttgtgccgcagtgctcctgctaccgcagctccacttgttcgacttgtagacaggcgtcgctacgtgcgtggctgccgcgacgcggttctagtcgccagtccccagcacactcgaaaccttcgcctccgatgcgcgtctgcggcaaaggggatggctgcggaagcgacgcacggcgggtgaggcgtcagcaatctgaggcgaagcccttcgtcgtcctcttcgtgtgcctcgggaagatgtgcgcggatcctgcagctgaagctgtggttcggaccctcgtacgtaaacatgggcgtgactccggatttctcatagagtctgctggtaccatcgggt

SEQ ID NO: 6865 - DNA, 390 bp, Zea mays
  Clone ID: LIB148-039-Q1-E1-A7
acacgacatcacgatgacgttcgagggcaaggtcgggacggtaatggtgaacggcaaggcgtacagcttcgagaagatgcactggcactcgccgtccgaccacaccatcaacggccagaggttcccgctggagctgcacctggtccacaggagcgccgacggcgcgctggccgtcatcgggatcctctaccagctgggcgccccggactccttctactaccagctgaagcggcagctgggcgacatggccaaggaccggtgcagcttcggcgaggaggagtcgcacgagggcgtcgccctcatccacctgcgctcgctgcagaagcgcaccggcagctacttccggtacacgggctccctcaccgtgccgccctgcaccgagaacgtcgt

SEQ ID NO: 6866 - DNA, 395 bp, Zea mays
  Clone ID: LIB148-039-Q1-E1-A8
ggtcgacgcacgcgactaacatgagatcatcgaagacgttcgagggcaaggtcgggacggtaatggtgaacggcaaggcgtacagcttcgagaagatgcactggcactcgccgtccgaccacaccatcaacggccagaggttcccgctggagctgcacctggtccacaggagcgccgacggcgcgctggccgtcatcgggatcctctaccagctgggcgccccggactccttctactaccagctgaagcggcagctgggcgacatggccaaggaccggtgcagcttcggcgaggaggagtcgcacgagggcgtcgccctcatccacctgcgctcgctgcagaagcgcaccggcagctacttccggtacacgggctccctcaccgtgccgccctgc

SEQ ID NO: 6867 - DNA, 387 bp, Zea mays
  Clone ID: LIB148-039-Q1-E1-A9
cggtcgatacacgagactacagtgagaccaagtatgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatat

SEQ ID NO: 6868 - DNA, 391 bp, Zea mays
  Clone ID: LIB148-039-Q1-E1-B1
ctctaaactgacgtcctggtaagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacagga

SEQ ID NO: 6869 - DNA, 358 bp, Zea mays
  Clone ID: LIB148-039-Q1-E1-B10
gtaggacaatacaacactctaaagtgagtcgtaatatcaactcctgctccaccaggggcacgagctacttcatcattggttctgccaagtcgttttactaagactgcgccactgtttctgtaaagcaaatggacgagatgatgaccttgcctgtggcaccagctcaccttgacattcatgacactccaatcaaggttgccccaaggaaaggaggcttctccttcagaacatgtaccaccaccggggaacggcatcaaatcttcctcggaacgatgggcacgccttccacctacgcctacacccaaactgctaacgaggttgtacccactgtctaccagagatggaacatcttcatgcc

SEQ ID NO: 6870 - DNA, 416 bp, Zea mays
  Clone ID: LIB148-039-Q1-E1-B2
agatcaagtcctcctcattgcaaaggtggaagtgtttcagcatgctttgcaaaatactgagggaaatgaccttgcgaaggttctgtggctgaagagtcgaacttcggaagtatggcttgagcgccgcacaaactacgctagaagcctggctgttatgagcatggttgggtatttgcttggtttaggagatcggcatccaagcaaccttatgttagatcgctatagtggaaaaatattacacatcgacttcggagattgctttgaggcttcaatgaatcgagaaaagttccctgaaaaagtaccattccgtttgactcgaatgcttgtgaaagctatggaagttagcggtattgagggtacattccgaacaacttgtgaaaatgtgatgcaagtccttcgcacaaacagagacagcg

SEQ ID NO: 6871 - DNA, 231 bp, Zea mays
  Clone ID: LIB148-039-Q1-E1-B3
gcgctgttcttgtcagtgtccctctggatgcgcaccaccggcgtcggcgccggcgttgacctcagtgtctcatgtgaagttactccagatccagatgtatgcctaccctcgctgcaggctgataccgagtctgttatgccacaggatttgtcggaggccgcactcctttcggtgacgattgcaagcggagcagcgggtgactacgttcggcacgacactgatgtagtgagg

SEQ ID NO: 6872 - DNA, 357 bp, Zea mays
  Clone ID: LIB148-039-Q1-E1-B5
ctcgccggtcgatacaagcctctacactgacgtcctggtaaatgcagcccaaatcgggcggtaaactccgtccaaggctaaatacaggcgagagaccgatagcgaacaagtaccgcgagggagctcgggttcttgttgggttttcctttgggtggagagcgagggagcgcagtcgagagccagcgagcagtctctcgtgcagtgcagtgcagtgcagtgcagctccggcgtagatgagattgtattgtgaccaagccgggagggaaagcagggaggggaggacaaagatgttttgtcacgtttcatgctccggccatcgccggagtttgtccggggaatatatcgatttcctattag

SEQ ID NO: 6873 - DNA, 397 bp, Zea mays
  Clone ID: LIB148-039-Q1-E1-B6
acgataagacggcatacacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacct

SEQ ID NO: 6874 - DNA, 386 bp, Zea mays
  unsure at all n locations
  Clone ID: LIB148-039-Q1-E1-B8
tcgttggtcgatacaaccctctaaaatgagtcatgatacagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaaggggtcgacgttccacaggatcatcncggggttcatga

SEQ ID NO: 6875 - DNA, 402 bp, Zea mays
  Clone ID: LIB148-039-Q1-E1-B9
gtcgatacaagcctctacagtgacgtcgtgactacgcgtccgggcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatg

SEQ ID NO: 6876 - DNA, 273 bp, Zea mays
  Clone ID: LIB148-039-Q1-E1-C1
aagcctctgaggtgacgtcgtattacctcgtcgtcgtctcactcaccccgccttcacgcctccctcaccaaataaagtcgcgcccttttccgacattcacaggggggacaggaaatcagcgggcatggcctcgattccggcgacgaccttcgccgtcatcttatccgtcctcttctgtgccgcggctggcagcgccgttcacaatgagctccccgactacgtcatccatgggcacgtctatttccaacactggcgctcccggttcgtgaccaa

SEQ ID NO: 6877 - DNA, 417 bp, Zea mays
  unsure at all n locations
  Clone ID: LIB148-038-Q1-E1-H12
accacgcgtccggtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacaggggatgtaatgacaaccccttcccctggaatgcatgttgatgatgttgctggttccaacttcgttttcagtaataacaacaaagcgaagaccctcctacctaccctatttgcttgagcggctcttgtccgcgccacaagataccaattgttgcgctgggaatattcagttacgatgacccgctttagttcagtttttttgtttttggggttggttcgatcatttggctgtancgtgaatcgcatggacaacagactccaat

SEQ ID NO: 6878 - DNA, 402 bp, Zea mays
  Clone ID: LIB148-038-Q1-E1-H2
cgaattcgaaagcatcaggcaccatgaactaaccagagaatcttgacacagtttgtacgacgacggtgatgctgttgatgccgagatttcagaatctttaattctctacactgttctgagttactttatgcactgtttcatccatatcaaattaaatcctgtgttgttcagataataatagaaatcaatacagttatttgtatccttagaatttgctccaaaatcttttttttcaacattgataattgtatgtatactaaataaactcgttcggggaaggaatgactgccctcccggtattatgctaagaagagaccgaaaaacaatggtcccgggcgagaaacttcccgaaccctgacccctatcattaacgagccgacgtcaaccgttcactctgcaacg

SEQ ID NO: 6879 - DNA, 321 bp, Zea mays
  Clone ID: LIB148-038-Q1-E1-H3
gattttgcttccctcgctcgctctctcattcgtttgtgcagctgattacgctaggtctatttacgcaactgtcgtgtgtcgaattttaacagcgacggccatgcaccaaacccccaccccacacatcattttctttcttcctttcttttgattcgacgacgcctgtgattcatgcatgctctcgatcgaagcaaagctgttgtatgttgttatggtgtactgtttttttattatttataaagttttgataaaaaacatgtaaacaaaacaatcacatacatcattcaaggatacaaggaactacagtatttgttatgtcct

SEQ ID NO: 6880 - DNA, 433 bp, Zea mays
  Clone ID: LIB148-038-Q1-E1-H4
gtcgatgcacgcctctagagtgagtcgtcctatccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccagaggaactggatcgagatcgagaacgt

SEQ ID NO: 6881 - DNA, 413 bp, Zea mays
  Clone ID: LIB148-038-Q1-E1-H5
atcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcaatccaacctggtgctgtacggcaggatccagtgcaagggcaagtgcaccgagcagaagggcatcacggcgccggccatgaaggtctgccaggaggagtgcgacaaggcgtacgtggtgaaggcggccgaagtcacca

SEQ ID NO: 6882 - DNA, 414 bp, Zea mays
  Clone ID: LIB148-038-Q1-E1-H6
atcgatgcgctcgtcggggccggcgggcaaagccaccagtggtcagagatctagctatggcgccggcgcttctgctgctgcgacttctggcattgattgcgacggcaagggaggcctgcgcggcgagggcgttcgccgcggcgtccaacgcgacggcgcatggggcgacggtggtggccgggaagctgaacgtgcacctggtgccgcactcgcatgacgacgtcgggtggctcaagaccgtcgaccagtactatgtcggatccaacaacagcatccagggcgcgtgcgtgatgaacaccctcgactccgtggtcgacgcgctcgccagggaccccgcccgcaagttcgtcgtcgtcgagcaggcttttttccaaaggtggtgggcagagaaaatcgcaaacattcaggcagtag

SEQ ID NO: 6883 - DNA, 408 bp, Zea mays
  Clone ID: LIB148-038-Q1-E1-H7
cggaggcgctacggacgctggggtccacctctgccgacgaggtgcagcgcatgatggccgagatcgacaccgacggcgacggctgcatcgacttcaacgagttcatcaccttctgcaacgccaacccggggctcatgaaggacgtcgcaaaggtcttctgatccattacatcttcgtccatacgatacaatcgatgatgaacctgcttatatacacacacatgtaccattcagctccaacatatgatttcgatcagcttgcctgcctcgcctggcttaatgctgtccttcgccttcctataagcactaagctattattaggattttgttttatttaacttttttttgtctccaatctaatatatgtggacgttcttttttattcattttccccctattttggttcgat

SEQ ID NO: 6884 - DNA, 416 bp, Zea mays
  Clone ID: LIB148-038-Q1-E1-H8
tacacacacgtctgccagccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttgg

SEQ ID NO: 6885 - DNA, 412 bp, Zea mays
  Clone ID: LIB148-038-Q1-E1-H9
agtggttgtggccaatccttctcctatctcgtcccggagtcccgggggaaattttgccccagaaacactagcgcgtcggatcacaagcaagggcgaaaattttctgtggctccagcggctgaaggacgctgcggcacccatgtcggccatcgaccgatcaataaataaacatggacagaatcgaattggcaagcaggacgacactggtggccgcgctctacccaagttcggcgagtgggacgtgaacaacccggcgtccgcggacgggttcacggtcatcttcagcaaggccagggacgagaagaaagctcccccgacccaaggccacatcaggaacaacaggtcggtgtcggctgacagcaaggactccagggccgagaagatgacctcctacaacgccaggaccaacgcg

SEQ ID NO: 6886 - DNA, 387 bp, Zea mays
  Clone ID: LIB148-039-Q1-E1-A10
ggtcgatacaagcctctagaatggatcatatcagaagcatcagccatgtcgaactcggcgtcgggaatggccgtttgtgacgaatgcaaactcaagttcctggaactcaaggcgaagaggagcttccgtttcatcgtgttcaagatcaacgagaacgtgcagcaggtggtggtggacaggcttgggggaccaggtgaaagctacgatgcgttcagggcctgctttcccgccaacgagtgccgctacgcggtgtttgattttgactttgtcactgatgagaactgccagaagagcaagatcttcttcatctcttgggccccagatgcatcgagggtgagaagcaagatgttgtacgcaagctccaaggaccggttcacagaggagctc

SEQ ID NO: 6887 - DNA, 379 bp, Zea mays
  Clone ID: LIB148-039-Q1-E1-A12
tcgtgggtcgatacaagcctctaaactgagtcctactagcatagattcgttccacgcctacctcctgccctcgcccgtgctctcagatctcgcgcgcgccccgcaaagggtaactttgagccatgggcacagttgtggatgctccagcagttgtggctgaagaggtcactgagaacatgttgggtggtaagaaagttacagctgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatc

SEQ ID NO: 6888 - DNA, 426 bp, Zea mays
  Clone ID: LIB148-039-Q1-E1-A2
tcgatacaacactctagagtgagtcctattatggccgcgaacgtggcgccgtactacccctccacggacatctcactcgtgtccgtcgggaacgagatcatggacacggccgacaaggccctcatctccaacctggtgcccgccatgcgcgcgctcaaggcagcgctggtggcggcggggtacccgaagatccgcgtctcgacgccgcactccctgggcatcctgtccgtctccgagccgccgtccgccagccggttccgcgacggcttcgaccgcgccgtgttcgcgccgatgctggcgttccaccggcagagcaggtcgccgttcatggtgaacccgtacccgtactttgggtacaacggcgtgacgctcccctacgcgctggcgcggcccaacccgggcgtgccggaccccggcacgggcatc

SEQ ID NO: 6889 - DNA, 353 bp, Zea mays
  Clone ID: LIB148-039-Q1-E1-A3
cgtcggtcgatgcatccgtagaaacttgggctatctaccagtgcgtgtgctcatccgtgcacgccgggaatggggtcttccgcccgtgcgctcatcggcctcctggtcgccgccgcctcgctcgccgtcgggctctcggatggcggcaggagtgggatggcggcgccagtgtaccggtacgcggcggggagccccaacgggccggagtactgggggaagctgagccccgcgtacaagctgtgcggggaggggaagcagcagtccccgatcgacatcgtcaccaagcatgccgtccccggcgccaacctcgacactctcaaccgcacctacggcgccatcaatgccacgctcat

SEQ ID NO: 6890 - DNA, 394 bp, Zea mays
  Clone ID: LIB148-039-Q1-E1-A4
aggcatccgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaacgcggccggctgcg

SEQ ID NO: 6891 - DNA, 434 bp, Zea mays
  Clone ID: LIB148-038-Q1-E1-H11
tcgcgggtcgatacacgcctctaaatagattcgtatgatattgggatttaattaagcattgccgcaaaggatgttggtgcctttttggtttctctgttctattgcccacacttgataatttatctcatcaaccttgtgagaaggcttctcttttgaagaataatgaacaaccatgaggtgggcaattgaactcttgtatagctggtgaaaaagtcatgtcacgtcggtaggctatagtattaggcatgcggacaaaaatggtttctcatttaaggatctagacaatggtaccttgtgctcaaaagatgaaatccaagaccatggtgacatccattctaatgatgatgttaagaagaatgtgtgtggcaaacaagatttagatcaagattgttcaatggatatatccagtgacagaaagatgaatatacaatatg

SEQ ID NO: 6892 - DNA, 433 bp, Zea mays
  Clone ID: LIB148-038-Q1-E1-F7
tcgtaggtcgttacaacactctagactgagtcgtactcacctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcacgcacttcggcaccggcaagctcgagcgcgccatcgacggggtcaccgacgcgaccggcacctacacgatcgagctcaaggacagccacgaggaggacatc

SEQ ID NO: 6893 - DNA, 409 bp, Zea mays
  Clone ID: LIB148-038-Q1-E1-F8
gttcgacatcaagtccggcacgtccatggccgcgccgcacctgagcgggatcgccgcgctgatcaagcacgcgcacccgacctggtcgcccgcggtcatcaaatcggccctgatgacgacggcggagcctaacgacaacctccggaagccgatccaggacgtcaacggcaggccggcgaacttggtcgccattggcgccggccacgtgaacccgaagaaggccatggaccctggcctcgtgtacaacatgacggccatgggctacgtgccgtacctgtgcgggctcaactacacggacgacaaggtgagcacgatcatctacccggagccgccggtgtcgtgcgccaagctgtcaaggctcgaacaggacgacctcaactacccgtccatcagcgtcatcctcaaccag

SEQ ID NO: 6894 - DNA, 414 bp, Zea mays
  unsure at all n locations
  Clone ID: LIB148-038-Q1-E1-G1
cattgccgggggaaaagaaaacaaccgccccgcccccgcccccgcccctacgagcacgacggcctccggatgagggtcctgccgcgtcttttaccgtcagctggatgtcaaatcacaacgcgccctgtgacatccccaagccggcctccgtcgacgagttcctcgccaagaatggcaagaagaagaagtccttcatgtcgggcctcttccgcaagaaagggaggggcgcggacaagaagctgctctcgcggcgggacatcgtcttcgatttggaaggcagaagcggcgacaggatggacctcttggagacgtccgccgctgtccgcaagagcttctcagatcggcactgcacgacgcggatcgagaacctgacgctgagctgcctggattctcncaggagacccaatgtcgaca

SEQ ID NO: 6895 - DNA, 397 bp, Zea mays
  Clone ID: LIB148-038-Q1-E1-G10
acccacgcgtccgcttgctcctcgatccatcaattgcaagaggagcaagataccaccaccgtagcaccacacgcaggtacgaagaaggcgacgaacatggcgaggctggccttggtagcggcggtggttctgtgccttctattagcgacagggccgcagggggccgtcagcgccgaggggatggtgtcatttgacaatttgatcagctgcaaggtactgggcaactgcgataagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggccttagcgtgtggtg

SEQ ID NO: 6896 - DNA, 409 bp, Zea mays
  Clone ID: LIB148-038-Q1-E1-G11
aaaaagcggggcacttcgtagccgcaagcattcttccttccttctccattccatcggtgaccatggattgaagacattgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgcttcgtcgt

SEQ ID NO: 6897 - DNA, 390 bp, Zea mays
  Clone ID: LIB148-038-Q1-E1-G12
agcctcctcgtcgcggtactgcccggcactgggaacgcggtggggaagaaggttgacgccgtcgtccacactctcagctaaccagtgcctgggccgcggttggccacggtgggcgaccctggtggttcaccggtgcactgcgaatctaggcgggtcttcctggggctcgatctgggtctcatggttggctaatttctcaccggagcatttgggggacgggccgtgcgcctccaatttctcgccgtcgacgtgttctccgccgcgggactacagcgtgccatgggcgggactcctgggagcttaatccgcgcgcgaggtcacgagtcacctgaagatcatcctggtacctggaatctcaagtcccaggtcaagagcaggtaccacaggatg

SEQ ID NO: 6898 - DNA, 301 bp, Zea mays
  Clone ID: LIB148-038-Q1-E1-G2
ggatgactcgcaacatccaataagaggcagccagagaaactaataaaactctcaccgccgcgatccgagagaacaagccagccgaccccgtccccaaggcaatccgtcgccgacgtaccaccgccagcgcaagagcgagatggagatgaataggatactcttcgccgtcctcgtcgtcatcgccgcctcggtcaacgcagtgctggtctccaccgaggccgccgccgcgggcgccccaactgcccccgagtcgtcgagccgatgctcccgctggcgctggcgctgcgcgcagccgctggcg

SEQ ID NO: 6899 - DNA, 299 bp, Zea mays
  Clone ID: LIB148-038-Q1-E1-G3
acaacgactacctcgacgtcgtcggccactgaaagctgccgcgcgcgcgcgcgcgccgacccgtggaccatgcgtgcatgaagaagaatgcagggggtgggcctgggcctgtaacctgttaatggatcggattctcggtgccaattcgtgatcttgaccggtctaagaagatggggacttgcgtctttgtttcattggttattatttctactagtgtgtatatggtaaagtcgtgtgctgtgaacctgcgatcatttatcctctgttcattgaattgaagcaatcccctctcccgtcac

SEQ ID NO: 6900 - DNA, 414 bp, Zea mays
  unsure at all n locations
  Clone ID: LIB148-038-Q1-E1-G4
aacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgcccagatcgaccactcccgcgaccgctgccgcgtcncgctcacccgcaacgacggcatcaagcagaacggcgtccgcta

SEQ ID NO: 6901 - DNA, 408 bp, Zea mays
  Clone ID: LIB148-038-Q1-E1-G5
cggcaaccatgcaggggaacacggtgcgcttcaagcgccaagctcgccgcttcaggaacaccatgtggtggaggaacgtcaagctcacagctgcagtgatattcatcctcaccgtaattgtgtacgtcctgctcgcctacatgtgtcgcggcttcaccataccgtcatgctttccgtaatctccatccgtcccggtgccagtgcggaccaccagccctagctctagctgcgtcacaacttggttttccgggttctgtaacagcagcagcggtgctgcagttctttctctcttgtacgagggaaacaacagctcattctgaagttctgcaacaaccagatctgattttttttaaaaaaaaagatggtagtcaaatgggaaagctttcccacctgattttttatcattaa

SEQ ID NO: 6902 - DNA, 178 bp, Zea mays
  Clone ID: LIB148-038-Q1-E1-G6
gtcgaggccatgatcgatgcacggaggaggatgctgccgctgctctggcctaatcactagtataaagcatgcggagacagccggcccctctggcctcgctgctcccccttcctccccgtccccacccatatgccctgactacgaacctcggcgccctgcgcaatctgagttcacccac

SEQ ID NO: 6903 - DNA, 410 bp, Zea mays
  Clone ID: LIB148-038-Q1-E1-G7
ggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaatgccatcggcaagtccatcggcttggcaaaggagctggcgt

SEQ ID NO: 6904 - DNA, 419 bp, Zea mays
  Clone ID: LIB148-038-Q1-E1-G8
tcgcgggtcgacacacgcctctagtgcgcgtccgcacagctgccaccgagatcctgtcggcacccgcctccgcgcgctcccgctgccgcacgggaccaacctgttcgcctgttcatccactcagcgacattcacgcccgcatctcgccgtgggcagcaccgcactcaccaccgccgtcgcagtgaggtcacgagtcagctgaagagcaagttggtacctggaatctcaagtcccaggtcaagaacaggtaccgcaggatgaggcgcatggaggatgctgtggcgagttcgtgagaggtctaggccatcgtctcccagtcaactttgggttgctggaccgttgtctccttataatgaaattatttatttattttgtatagaactcctgttatatagtaaagatgtgacattcgatccaaa

SEQ ID NO: 6905 - DNA, 381 bp, Zea mays
  Clone ID: LIB148-038-Q1-E1-G9
cccacgcgtccgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggta

SEQ ID NO: 6906 - DNA, 411 bp, Zea mays
  Clone ID: LIB148-038-Q1-E1-H1
cggacgcgtgggaaaaaaaatttctcctggtgccggctggccgctcggagtcaaggtctgggcggaaggtgaagacgaattgctgccagtggggaggagcaccagcgcgagggcctgtgcctcattgcggaaagccggggacggagttatgcagggacggcgcacgtagacttatcagaagcagcgacggctgggcagctcttcgcgaggttacgagtcacctgatgatcatcctggtacctggaatctcaagtcccaggtcaagatcaggtaccgcaggatgaggcgcgtggaggatgctgtgatgagttcgtgagtggtctaggccgtcgtctcccagtcaactttgggttgctggaccgttgtctccttataatgtaactatttatttattttgtatagaactcatat

SEQ ID NO: 6907 - DNA, 408 bp, Zea mays
  Clone ID: LIB148-038-Q1-E1-H10
agcatctgcaagcatagaaattaattaaaagaagatcggcgccatggcggcaacgacgacggggatgcagatgatgcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgccggcgtgtccgcgctcagagggttcaagctatcatcaccgacgacccgtggccgtggatgaattaattaaggccccatgcatcatgcatg

SEQ ID NO: 6908 - DNA, 402 bp, Zea mays
  Clone ID: LIB148-038-Q1-E1-F6
ctttgcacaggggagaaaggaattgccaagtccggcaagcctctgtggtacaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaaggtggtgaaagggatggacgtcgtgcgcaagatcgaagccgagggccagctcaccggcgtgcccaaggccaaggtcgtcatagccaac

SEQ ID NO: 6909 - DNA, 396 bp, Zea mays
  Clone ID: LIB148-066-Q2-E1-B12
gggccgagcacgcgtccgagcgcgatctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtgacgtggcgttcagctcaggcgctgagcgagtctatacgtacgtcgtcaccggctggccacgcatgcgataacca

SEQ ID NO: 6910 - DNA, 73 bp, Zea mays
  Clone ID: LIB148-066-Q2-E1-B3
acgcgtccgcacacgcgtccgcccacgcgtccgaaaaaaaaaaaaaaaaaaaaaaaaaaaaaggaggaagcac

SEQ ID NO: 6911 - DNA, 434 bp, Zea mays
  Clone ID: LIB148-066-Q2-E1-B4
cggacgcgtgggcggacacgtgggcacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatccagtcacggtgttcatcacagacatgaactacgagcctatcgctccctaccacttcgac

SEQ ID NO: 6912 - DNA, 359 bp, Zea mays
  Clone ID: LIB148-066-Q2-E1-B5
atccgatcacgtcctccggccactcgtccctggcagatgctctcctgctcgaatctggacatggtgtcggccagaccgtcttcatctacgagggatacgcactcgccccacacgatctttcgtcggtacctggctggccgctagctcaggaacgatctcatgaaaattctgactgaatgcggctaatccttcagcagtacatgcttgagcagtaaaatgtcacggacatgaaggacaacctcgccatagattgcactggagctagactagaaaattgagactgccaagactagctcttcttgtgtataagagctacgacactgcatgactcgacaggtcatcactatttgtgctgaacg

SEQ ID NO: 6913 - DNA, 263 bp, Zea mays
  Clone ID: LIB148-066-Q2-E1-B6
ccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagtatggaggactgcatgaaaaggtgcaaggaaatcgctgctaaccaggggcctagggacccttacaaggataacaaacttgacatcccatgacctatttaatgccccaaaacaaccggctaacc

SEQ ID NO: 6914 - DNA, 303 bp, Zea mays
  Clone ID: LIB148-066-Q2-E1-B7
gcgtccgcacacaagtctgcccacgcgtccgaaaaaaaaaaaaatacataaaatcaatacctcccatcactctcctactataaaaactcacgtccgcctccatgaaagttttctccttttctatgtgttggggtgggttcccctctccacatctgtttttacgacttcatgacccaggtccaacgtgatctctgctaaccactgtgcctatgcacccttaccccgactacagacttcacatcccactaaccacttgatgcccctatctcatctgcctatccatgcatccattgcattgcttct

SEQ ID NO: 6915 - DNA, 263 bp, Zea mays
  Clone ID: LIB148-066-Q2-E1-B8
ttgtgtcttctactacgttcctcatcatcatggcaatccttctcatctccctcatgctcttggcctcccctccttccacttctctttcattgcaaggtcctttgtgccggggtggatttcttactccacataaatatggaggacttcatcatcacgttcaatgacatcactgctaatcaggtacctttagacccttacttcgatcacacacttcacatcccatgacttatttattgctcctatatcatttgtctatccattca

SEQ ID NO: 6916 - DNA, 359 bp, Zea mays
  unsure at all n locations
  Clone ID: LIB148-066-Q2-E1-B9
gggtcgagcccgcgtccgatcaaacttatctcgtggctttgctcatgggacccacgaagaaggccaacagcagtggaggttttgcagcatcccttctttcagccatgcttctatgtcccaccttcacttcgcttcaaatctactggatatgcatcaacgccaccatcagctggggctaaaggagctgttgatcagaagaacattaggagatactacatgggtactgtacccaatgcgaggccaacagttaattactcgtacttgagaaacaatgctcctgcaagagcagttggtgcacanaggaaattggagttggattatcagctcccagagactaataaccataataaggtgacaaa

SEQ ID NO: 6917 - DNA, 413 bp, Zea mays
  Clone ID: LIB148-066-Q2-E1-C1
gggtcgagcacgcgtccgctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtga

SEQ ID NO: 6918 - DNA, 373 bp, Zea mays
  Clone ID: LIB148-066-Q2-E1-C11
gagcacgcgtccgcccacacgtccggcgagtcgctgacgttccgggtgatgaccagcgaccaccgcaaggccacctcatggcacgttctccccgctgactggaagttcggcgtcacgtaccaggcatccaagaacttctaagtagccactttccctcctcttcttcatcctgcatatgcccacaagcaaccatgcaaatgataacatgcatcatgcatgcatattcattctttcgctcatgcactccaatatggtgccggagttaaaaaaatgtaaatcaatgtgcaaactcaaatgacatcttaaccagttgtgatcaatctcaaccgctaatgcattgcacacaccgaatgaagctaccatccactgctgg

SEQ ID NO: 6919 - DNA, 368 bp, Zea mays
  Clone ID: LIB148-066-Q2-E1-C12
ctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctc

SEQ ID NO: 6920 - DNA, 391 bp, Zea mays
  Clone ID: LIB148-066-Q2-E1-C3
cggacgcgtgggctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtttcgag

SEQ ID NO: 6921 - DNA, 432 bp, Zea mays
  Clone ID: LIB148-066-Q2-E1-C4
gggtccggcccgcgtccggatttatcaaggcaagaaagtttgatatcgagaaggcaaagcaaatgtggtctgatatgctgaagtggagaaaggagttcggtgcagataccattctcgaggaattcgaattcgaagaagctgataaggtggcagaatgctaccctcaaggttaccatggggttgataaggaaggcaggcctgtctactttgaacggcttggacagatcgatgtgaatacgctaatgcaggtcactacaatggatcgctttgtcaagaaccatgtcaaggagttcgagaagaactttgctgttaagttcccagcttgctcaatcgccgcgaaccaccatattgaccagagcacaacaattcttgacgtgcaaggagtggggatgaagcagttcagtaaagctgcaagggagctcattgggatgc

SEQ ID NO: 6922 - DNA, 441 bp, Zea mays
  Clone ID: LIB148-066-Q2-E1-C5
gccacatcgacggcaagctccgctacggcttcaacggcatctcccacagggaccccgagacccccgtgaagctcgctgaatacttcaacgtcaccgacggggtgttcagctacaaccagatgggcgacgtgccccccgccgtgaacggtcccctccatgtcatccccaatgtcatcaccgccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtact

SEQ ID NO: 6923 - DNA, 445 bp, Zea mays
  Clone ID: LIB148-066-Q2-E1-C6
gatctcggccgatccggcagctcctcatcaccacagcccggggcaacgtcacccagcggatgctatgcctgatcgggtccccacggtcgatgggttcgcccgggtccgccagtggcagacgcggcgaatacttgaggatccctgacgacgtggaggtggcgtcgaacggggaggcagatgccgcggcggccatcacagtggccgtggcagcggaatgcctgaaggtgctgcggtgccactcaatccggtggtaggccaaaggctccgtgcttgggatcatccttgcacgggctcggagctgctgccgtggacttccacggaacgctcgttattacaagagttgttgcacctaatccttacggggaatcaacaacatgcagcacatcatctatcgccctaataggttctggcacagtcaccttattcccaactgttgtgttaccat

SEQ ID NO: 6924 - DNA, 425 bp, Zea mays
  Clone ID: LIB148-066-Q2-E1-C7
gcgctccccgtccttcggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagc

SEQ ID NO: 6925 - DNA, 442 bp, Zea mays
  Clone ID: LIB148-066-Q2-E1-C8
actctctcttcctctcctccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatggagaagatctggcatcacaccttctacaacgagctccgtgtggctcccgaggaacaccccgtcctcctcactgaggcgcccctgaacccaaaggctaaccg

SEQ ID NO: 6926 - DNA, 230 bp, Zea mays
  Clone ID: LIB148-066-Q2-E1-B11
agcctgacatcagaccacgcgtcatcaatgaaggcacaatctaggtgcaagagatttgcttgtcaaccatcacaattcgcctcgcggtcatataggatgacagggcatagtatcgcacacactgtgagcagacttgtcgacagaactgtaacattcggttcattgaatgaagtttgctgacaagatgggtaccaagagcatcgatgttgtccatcgttttttggacgccg

SEQ ID NO: 6927 - DNA, 273 bp, Zea mays
  Clone ID: LIB148-066-Q1-E1-H2
catttctcctagaaggtcgagaggagaagaaggcgagacgtgcagtccgtcgggctccgatcgagaacagggaagcaagaggctgctagagatcgagctcatcaaccaatcaagtcgtacgtcgtcagcatcacgcgaccggatggcgcgcgccgcgtccagctatgtatccaagagggggctctccgcaaccattaaggtggccgaggaatcccttaacaaaggggaggacaaggcggttaaactgggaactgtggccaaggacatcgccag

SEQ ID NO: 6928 - DNA, 345 bp, Zea mays
  Clone ID: LIB148-066-Q1-E1-H6
cggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtgacgtggcgttcagct

SEQ ID NO: 6929 - DNA, 213 bp, Zea mays
  Clone ID: LIB148-066-Q1-E1-H8
gttaaaaatgacggttcactcaccatagcttggcatgtaaatgcaagtgatggcaatgggaatcctactggtatcagttacaacaagagtgctcctgaacatccaaagctggatgcctcacacatcgggaacgcagcacccgtcaagctccagtttggtccttttgggatcaatggctggatgaatgacacggatggtaccagccatactggg

SEQ ID NO: 6930 - DNA, 398 bp, Zea mays
  Clone ID: LIB148-066-Q2-E1-A1
cccacgcgtccggcagagggagagattggagggaggcccctgcccaaggcaagagaaaccgcggcgcgcggagagggaggaagggcagacgcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagctcttccacccagagcagctcatctcgggg

SEQ ID NO: 6931 - DNA, 347 bp, Zea mays
  Clone ID: LIB148-066-Q2-E1-A10
agctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacc

SEQ ID NO: 6932 - DNA, 327 bp, Zea mays
  Clone ID: LIB148-066-Q2-E1-A11
ttcctactactttttcaactacgattcctcaagtatttccttttttcagtcacattgttcaatagacatacattttattaaatatgcagggcatcgtagaagagaatggttctcccttccaaaaagcaaaacaaaagaaactcgtatagtcgatcgacgaccatgcatcacatttccttttcctcgatcttctcttatttccgcagaaaaacaacgaaggaaacccaaccaaggaaacgcatgctattgcttaagcatcgccggaggagctggtcgatcgctcgctcactcacgggcctgattgttccggtcacctgtcgtcgtcct

SEQ ID NO: 6933 - DNA, 404 bp, Zea mays
  Clone ID: LIB148-066-Q2-E1-A12
atgccaaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcacggcgatgttcctgtccttcggccggagcgacgacagcattaagaagacagaccacgataccacgagccc

SEQ ID NO: 6934 - DNA, 406 bp, Zea mays
  unsure at all n locations
  Clone ID: LIB148-066-Q2-E1-A2
gcgtccgcacacgacgtccgcgatgacgcctaagtcgtcacctccaccggttgttgtgagctcaccaccaccaactgtgaagtcttctccaccaccggcaccagtcagctcaccaccagcgacacctaagttgtcacctccacctgctcctgtgaacttgccacctccagaagtaaagtcttctccaccagcgacaccagttagctcgccaccgccagcgcctaagtcatcacctccacctgctcccatgagctcgccaccacctccagaggtgaagtctcctccaccaccagctccagttagctcgcctccacctccagtcaagtcgccacctccacccggccctgtgagctcanctcccccccctgtgaagtctccaccatcaacggcaccggtcagctcacca

SEQ ID NO: 6935 - DNA, 433 bp, Zea mays
  Clone ID: LIB148-066-Q2-E1-A3
gggtcgggtccacgtccgtacacacctccatgagcaccaccacgaccacgatctcgcacacggtcccgcccacgtcgtcgaccacgtcgtccaccgggaacttgaccgggtacctgtggaatacgccgtgccacatccggagccccatctcgacgaccacctcgacgacccccacgtgcacctacaccggcacctacagggacagcgacagggagtgggtcaaggggcggatcccgatccggacgctgatccagtcggtcgtcccgtcctacatgacctgctacacgaccagcctgacgcggaccatgtccgcgatcaactgcgtcaggtaccgcttccggtcctcagacccctggacagtctcccgcaacgtctagccccacgacgacagccgcctcttcagcgcgggcatcaccgtcggcacgaccatccg

SEQ ID NO: 6936 - DNA, 435 bp, Zea mays
  Clone ID: LIB148-066-Q2-E1-A5
cccacgcgtccgcccacgcgtccgcccacgcgtccgcccacgcgtccgcacgcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgac

SEQ ID NO: 6937 - DNA, 430 bp, Zea mays
  Clone ID: LIB148-066-Q2-E1-A6
cccacgcgaccgaggacgcgtgggctagtgcacaaacaaagcaagcctcagtagacccttttgacttcggtactcagacacagcagtccacaacactcccctttgatttgagcacccaggcaaagcagccaggatcagtttctcatgttacagcagctacaatcccacctgcgcaaccacaaccatcactacaatctcttgcggctagttcaggacctaaaatttctggctcatgtgtccctgtcgacattgagtggcctcctcgaagaagctcgtcatccagcttcaatgcacgcttgtctattagcaaggataatggttctggaaggctgtctagcgatggcgttgatgatattgatccttttgctgattgggccccaatacctaacaatgttaatagcatttcagcaaccgagcattggccaagcat

SEQ ID NO: 6938 - DNA, 441 bp, Zea mays
  Clone ID: LIB148-066-Q2-E1-A7
atccgaggacgcgtgggcggacgcgtgggcggcacccggtatccctgctcctcttccttggcggccgagcggggctccctctgacgactccgcgcttcctctggtgcacggccgcttctattgccgtcgcctggggcttctgctgcgttaccatgggccaaacaacgaggaaaatgccgagagagagaggtagagacagtttggtcgtcgagtcacatggagggtgccctggtggccggggaatccttcacctgcggggtgctacatcgccgggctgctgcatcgtggtctgcctctactaccagggctgactccattgccggacagccaaaactctcggtcgagtctctgaaggccgtctgtccctgttccttccgattccaaggcgccgccgggctgtgctgctaccgtctgttgttgaggttggtgatgatccggtca

SEQ ID NO: 6939 - DNA, 448 bp, Zea mays
  Clone ID: LIB148-066-Q2-E1-A8
gaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggc

SEQ ID NO: 6940 - DNA, 345 bp, Zea mays
  Clone ID: LIB148-066-Q2-E1-A9
acccacgcgtccggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcg

SEQ ID NO: 6941 - DNA, 281 bp, Zea mays
  Clone ID: LIB148-066-Q2-E1-B1
ggtacctgcacccggacatggtgtcggcaggggctccctctgaacacggacacttcctccggagacagctttttggtggggtccttgcgccatctcatgaatgatcgctgacaatcctgacgaagtcggttgaccttcacgtcacacagtttgagcacgagtcaatagatggtggacaatgactcaggaattctttacactaggatactaaatcgcgggctgatgcatcgtggcctgcctctaacaccaatgcttactccattgccggacaaccaaaactc

SEQ ID NO: 6942 - DNA, 403 bp, Zea mays
  Clone ID: LIB148-066-Q2-E1-B10
aatcatcacttctttctcagctcacttgtgcgctccttgtatggatgcggttatggcaggatgtggctgacctcccatttccctcttctctctctccctacctggtgggatgtggccttgctcccaatctctgcatgggaagtcatgccggaggagtgtgatggtgtcacattccgtttggcccgcaagcgtgcatgagggtggcagtggtagcacgagagggaaagaagaaagagattacctaacatttggatctcactgccacatctggtgtcacatccatattgtcccgcaagcgtgcatgagggcggcagcggtggcacgagagggaaagaagaaactacctaacattttttgcctcactggcacggcatcaaaagcatttaggaatagtcaagggggt

SEQ ID NO: 6943 - DNA, 354 bp, Zea mays
  unsure at all n locations
  Clone ID: LIB148-066-Q1-E1-H12
tccgcggacgcgtaggcggagatggagattcccgaggagtatatcgagtccctgccgaagaacggaggtcattcttggagactccatgtacaagatcataaccgacgacgtcttcgaccccaacgagctcctgcagtccgtggacctgtcgacggagcacaagatcgtggacctcaaggaccggatcgaggcctccgtcgtcatctggcaccggaagatcagcaacaagctctcgtgggggcccgccggcgtcagcctggagaagcgggaggagttcgaggagcgggcgcagancgccctgctcatcctcaagcacaggttcccggcatccctcagtcggcgctcgacatcagc

SEQ ID NO: 6944 - DNA, 198 bp, Zea mays
  Clone ID: LIB148-066-Q1-E1-A10
cgcgacggtctctgctacgcctacacgattgaaggcatcgtctgagcacgctccctttgggctatctcggttcacaattcccgtccagaagacgacgattagtcagtcggcagctaggttcgcacgcgcaaggccacgattgatggcgtcttcaagtccgagatcacgacactggagattccaggcaagcgtagcatc

SEQ ID NO: 6945 - DNA, 125 bp, Zea mays
  Clone ID: LIB148-066-Q1-E1-A12
gacgggctcgtgccttctcttcctccctgaaatggaagaagtagctgtttcgcccatgatcattgtcgcggtagtgctggagcacaacggttcctatgcggtcgcctgcaatgccatacctagcg

SEQ ID NO: 6946 - DNA, 328 bp, Zea mays
  Clone ID: LIB148-066-Q1-E1-A5
gctacacgtcagcgcaggcatccgtccacacgaccacccactcatttgtagccgtaaccagcgctgggagcgtcggacgatggtacgtctacaacattcatcaccgacagacggtctatgtggagctgggtctcacgggcaggatttctgtcgtcccgcaaactcgtactttcatcataatcacccttgttgtcgaatcttcagacatcagttacactgtcactgtcaagattcaagaataagagggaatccctccataacactagcggctcacttttgccggtaatcatctctacgacggacccacactgagctactagaacattca

SEQ ID NO: 6947 - DNA, 406 bp, Zea mays
  Clone ID: LIB148-066-Q1-E1-A7
cggacgcgtgggcggacgcgtgggcggcacccggtatccctgctcctcttccttggcggccgagcggggctccctctgacgactccgcgcttcctctggtgcacggccgcttctattgccgtcgcctggggcttctgctgcgttaccatgggccaaacaacgaggaaaatgccgagagagagaggtagagacagtttggtcgtcgagtcacatggagggtgccctggtggccggggaatccttcacctgcggggtgctacatcgccgggctgctgcatcgtggtctgcctctactaccagggctgactccattgccggacagccaaaactctcggtcgagtctctgaaggccgtctgtccctgttccttccgatttccaagcgccgccgggctgtgctgctaccgt

SEQ ID NO: 6948 - DNA, 277 bp, Zea mays
  Clone ID: LIB148-066-Q1-E1-B10
atgttcatgcgtcctgtgcgcgcccatcttcttcagaggctcagtgcttccggggagatcatccacgatcacgcttagctcgcacgccatgtgctcgtaggtgacgataccgcggatcactctgtgtcaggtcatcacacaggcatctgacccatccagattattcttgcgctcatcatcatgcttcgcgacggccttcatcgcaagatggggaaggcggacagacatcgcctccgtgttggctccgacggtgcaattgggtccacacacgcgggtg

SEQ ID NO: 6949 - DNA, 408 bp, Zea mays
  Clone ID: LIB148-066-Q1-E1-B12
ggccgtccggcgcgctcacccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcccccggggtgacgtggcgttcagctcaggcgctgagcgagtctatacgtacgtcgtcaacggctgggcacgcatgccataaccatctgatatggacggaactata

SEQ ID NO: 6950 - DNA, 110 bp, Zea mays
  Clone ID: LIB148-066-Q1-E1-C11
gagtcgctgacgttccgggtgatgaccaccgaccagcgcagggcgacctcatgggatattctcgcggctgacaggaagttcggcgtcacgtaccacgcaaccaggacctt

SEQ ID NO: 6951 - DNA, 310 bp, Zea mays
  Clone ID: LIB148-066-Q1-E1-C12
gctcgtcgtagtctcactcaccccgccttcacgcctcgctcatcaaataaggtcccgcccttttccgacattcacaggggggacaggaaatcagtggccatggcctcgattccggcgacgaccttcgccgtcatcttatcgctcctcttcggtgccgcggctggcaccgccgtctataacgacctccccgactatgtcattcagcgccgcgtctattgcgacacctgccgcgccgggttcgtgaccaatgtcaccgagtacatcggcgggggccaaggttagggctggagttcaagcaacttcggcaccg

SEQ ID NO: 6952 - DNA, 226 bp, Zea mays
  Clone ID: LIB148-066-Q1-E1-D9
tcgagtcgtcttcactcatcgatgctcttgcggaccatccggtccctcgctgtcgctttatagctgcctcttcgggtacaggctgtggttccatcgctcagtcaccctgtctcaaagctcccgtcccccagctggcgtcatagagaacctggctgattcgctcacttgttcaaagatcttcgcagtctcaatcgacagtgcgccgcgccttttccttgcgcattaa

SEQ ID NO: 6953 - DNA, 394 bp, Zea mays
  Clone ID: LIB148-066-Q1-E1-E1
cgacggcgtggacctggcgcacaacgtgacggtgcccaggttgacggtggagatggccggtggcgcgaggctagagccggaagccaagagcgtggtgatgccggaggtagtgcccggggtggcgtgcctggcctttaggaagctgccgcggggagggcccgggatcttgggcaacgtgctcatgcaggagtacatctgggagatcgaccacggaaaggggaagatgaggttcaggaaggacaagtgcaacacccatcatctccacaacagcaaaggcggagaggtctataataataataatggcaattcctcctctactgtcgtgcatcgcgtcaattaattcgttctctcctctctacctctacaaaattaaaggaccagaccatgcatgcac

SEQ ID NO: 6954 - DNA, 89 bp, Zea mays
  Clone ID: LIB148-066-Q1-E1-E10
gacgatgaggccacagctgcatagcctcgtcgcgctggtcctcgtggccacggtcatacccgccgctcccggcgttgggtttgtcgtca

SEQ ID NO: 6955 - DNA, 318 bp, Zea mays
  Clone ID: LIB148-066-Q1-E1-E5
acgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacgcgcggcctcgcactcca

SEQ ID NO: 6956 - DNA, 104 bp, Zea mays
  Clone ID: LIB148-066-Q1-E1-E9
tgtgacggagtcaacccaaacttatgtctcatggctgtgctactcattttagtgcttcaaggcaactgatttttccacaccaagtgctaacgctcggcttgtgt

SEQ ID NO: 6957 - DNA, 345 bp, Zea mays
  Clone ID: LIB148-066-Q1-E1-F10
gacgcgagggttcggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaagttggcatgaccagccgctacgcgttcgctgaggatctgcaccagatggacagcga

SEQ ID NO: 6958 - DNA, 361 bp, Zea mays
  Clone ID: LIB148-066-Q1-E1-F9
cggggccgcattggacgccggggaccttgaggtgctcaccgcgctcgacaccgcgaagacgcactggtaccacttcaccgccatcgtggtcgccggcatggggttcttcaccgacgcctacgacctcttctgcatctccctcgtgactaagctcctcggtcgcatccactacaccgtggaggggtccgcaacgcccggcagcctcacgccgcacatgtccgcgtccgtcaacggcgtggtcttcgtgggcacgctgtcagggcagctcttcctcggccggcagggcgaaaagctcgggcgcaagaaggttcagggcatgccgcccatgcccagggtcctcagtttccgtcccgtcggggcc

SEQ ID NO: 6959 - DNA, 340 bp, Zea mays
  Clone ID: LIB148-066-Q1-E1-G1
tgacggacatgaacctgtcgagcacctacggcaagctcgccatggtgctcgtgggctccagcgtggggcgcaacgacggcggcgtcgtcgccggcctcgtggcctgtgggatcgtgatggggaccatgtccaacgccaacaacctgatgcaggacctcaagacggggtacctgacgctgacctcgccgcacaccgtgttcatcagccaggccatcggcacggcgctccggtgcgtccgtcaaccggtcatgttctgggcttctacagggtggtgcagaacggcgacaccgacgtcttcgacgcgccctacgcccgagtgtaccgcagcatcgccatgctg

SEQ ID NO: 6960 - DNA, 363 bp, Zea mays
  Clone ID: LIB148-066-Q1-E1-G11
ggggaggaagcagttccagcaggaggtggaggtgctcagctgcatccgccaccccaacatggtgctcctcctcggtgcgtgccccgagtacggctgcctcgtgtacgagtacatggagcacggcagcctcgaggaccggctgttccgtcggggcggcacgccgccgatcccgtgggcgcagcggttccggatcgcggcggagatcgcgacggcgctgctgttcctgcaccagacaaagccggagccgctggtgcaccgggacctgaagccggccaacatcctgctggaccgcaactacgtgagcaagatcagcgacgtcgggctggcgcgtctggtgccgccgtcggtggcggacagcgtgac

SEQ ID NO: 6961 - DNA, 308 bp, Zea mays
  unsure at all n locations
  Clone ID: LIB148-066-Q1-E1-G4
cggacgcgtgggcgagtcgctgacgttccgggtgatgaccagcgaccaccgcaaggccacctcatggcacgttctccccgctgactggaagttcggcgtcacgtaccaggcatccaagaacttctaagtagccactttccctcctcttcttcatcctgcatatgcccacaagcaaccatgcaaatgataacatgcatcatgcatgcatattcattctttcgctcatgcactccaatatggtgccggagttaaaaaaatgtaaatcaatgtgcaaactcaaatgacatcttaaccagttgtgatcanaa

SEQ ID NO: 6962 - DNA, 292 bp, Zea mays
  Clone ID: LIB148-066-Q1-E1-G8
cccacgcgtccgcccacgcgtccgccatgaccttaagtcacggtttggtatcatacctcaggaacctgttctccttgaagggaccattaggagcaacattgatccgcttgagcagtattccgatgatgaaatctggcaggcattgggccgctgtcagttgaaagaagccgtagcttcaaaacccgaaaagcttgatgcttcagtcgtcgacaatggtgaaaactggagtgttggacaacgtcaactgctatgcctggggcgggtgatgctaaagcacaacaaaatactgttc

SEQ ID NO: 6963 - DNA, 399 bp, Zea mays
  Clone ID: LIB148-066-Q1-E1-A1
cccacgcgtccggcagagggagagattggagggaggcccctgcccaaggcaagagaaaccgcggcgcgcggagagggaggaagggcagacgcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagctcttccacccagagcagctcatctcgggga

SEQ ID NO: 6964 - DNA, 284 bp, Zea mays
  Clone ID: LIB148-066-Q1-E1-G9
ggcacaagaacacattatggagctgatattccgtgagatattgggatatcatccacaactgctcaacgactatatcaatggcaccgcgaggacaacctttctgtacccaagtgctgtcgaccaatttaggaagcaatttgctcatcttgaagaacatagtgggaacggacctgtgattccaatggaaagaaaccatacttctcttcctaggtctactagtgttcactcatcctcaattcctgtcaagggacaaccccgtatcggcccatgttcggaaaggcctt

SEQ ID NO: 6965 - DNA, 280 bp, Zea mays
  Clone ID: LIB148-066-Q1-E1-H1
cagcaaggatatggagtacaccccctgcacagcaagttcctttgtatcccacatctcgctgctcgaggaagttcttggctggaggttttgtctttacggagacttcctggtcatctcttttgtcaactgcacttgaggatcaacccacacttagtgactgccttgcctggtcccatgctgtcagacattagagttgcccagtgattacactattacagtgcagctgtagcacatttatttgagcatggtggatctgtttctctggcaacattccagtaat

SEQ ID NO: 6966 - DNA, 261 bp, Zea mays
  Clone ID: LIB148-066-Q1-E1-H11
atcgagagaagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgt

SEQ ID NO: 6967 - DNA, 413 bp, Zea mays
  Clone ID: LIB148-038-Q1-E1-E2
cggacgcgtgggcaagcttgcttccggtgacgccagaggtagtcaagaagacgtgctgtttgaagagcatgagcatacaacagctgatgggtctccttccaacggtgacaagttgagcggcgtagcgaatcttaaggctgggatttctctgctcaatataagactgagggcacttgaagacgaccaggagtttctcaagcaggtgttgagttccctccaatgcggtagtgatggactgcagtgtatacaggagataagcggccatctagcagagttgcgaagagttgtaactcgctaaggaaaatggttttgccccgagtccacactgttaggtcatcgtgaggtcttctcatgcagcagactaacgagggtgcttccagtgagtgcccacaatcccatctatctgaagatgg

SEQ ID NO: 6968 - DNA, 416 bp, Zea mays
  Clone ID: LIB148-038-Q1-E1-E3
cgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttc

SEQ ID NO: 6969 - DNA, 413 bp, Zea mays
  Clone ID: LIB148-038-Q1-E1-E4
atcgcgcaccgcctccccgtgtcccctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgatttcgacttcaccaccgacgagaactgccagaagagcaagatcttgttcatctcctggtccccggacacctcgatggtcaggagcaagatgctgtacgcgagctccaaggaccggttc

SEQ ID NO: 6970 - DNA, 116 bp, Zea mays
  unsure at all n locations
  Clone ID: LIB148-038-Q1-E1-E5
gcgtatgacattactacaccctgatgtgagtcgtattaaaacnccgacatcnatcgacagatacatagggttgaagaaagtggcatcatcgtgagccggttcgcttcgcgctatcc

SEQ ID NO: 6971 - DNA, 414 bp, Zea mays
  Clone ID: LIB148-038-Q1-E1-E6
ctctagtgacagtccccggagacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcct

SEQ ID NO: 6972 - DNA, 377 bp, Zea mays
  Clone ID: LIB148-038-Q1-E1-E7
gatatccggagcttgcagcatttgccagatgtactgagaaaggctgatattcataagattcaggcagagcttgtgtcatgtcttccgtcgttacctcacctttcagatctacaaaagctgaaggatgagctgaagacctcttggaattctatggaggttcttccatctctgtcccgttggcatctcttggagttactcgcaaattgtctgccacacagatttacccatcccaatgaaacaagtttgtctgttcttcaaagcatgaaggaggatctagcaagcctgattgcaccgcaactgattagaccaattgcgcggtggccattctatgccttcttgggaggagccatgttctgcctcctggccagcatcacttg

SEQ ID NO: 6973 - DNA, 410 bp, Zea mays
  Clone ID: LIB148-038-Q1-E1-E8
cccacgcgtccgcctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacag

SEQ ID NO: 6974 - DNA, 422 bp, Zea mays
  Clone ID: LIB148-038-Q1-E1-E9
ctcgtaggtcgatacaagcctctaaagtgagtctaatacaggaaagcaagcaagaatcatcggaataatggcccgtgcatgcgtgttcctcgtcgtgctcctcctggccgccatcgcggtggcaccgttcgcgggcgccgcacgcgtggacgttgtggagggtaggtccatggcatccgccgatgcaccggaggcggcggccgatgctcccgctcctagccccgactccgcctcatccccagactcgtcatcggaggcgccctctagcagcagttcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattagtgttt

SEQ ID NO: 6975 - DNA, 415 bp, Zea mays
  Clone ID: LIB148-038-Q1-E1-F1
catcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaagga

SEQ ID NO: 6976 - DNA, 405 bp, Zea mays
  Clone ID: LIB148-038-Q1-E1-F10
aaatctgccatcctctccatcacgaagatggcgttcatcagcaatgtcgcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgag

SEQ ID NO: 6977 - DNA, 395 bp, Zea mays
  Clone ID: LIB148-038-Q1-E1-F11
actgctattaggaaacagttgcttgaggaattttcagcagatgacagctgtctgggatctcattttactgaaacaccttcacagtatccagcacaaaatgggaaactgcaccataagtctatggaggttattccattgggatttgtttttgaagatgatactctcgctgaagcatctgacagctcagtagaacctcacttgcaacatccgccatgtaacaacattcttgatgtcaatcggcttcttgattcagttttggaaacatctcagcatgttggaaggtcgtcagtgtcaacaaaccaggatctgcctttcaaggacgtagccaaccaatgtgaagcacttctgattgggaagcagcaaaagctatctgcgtgcatgagtgtctgttaaaa

SEQ ID NO: 6978 - DNA, 394 bp, Zea mays
  Clone ID: LIB148-038-Q1-E1-F12
cgaccatggagaaaaccggcctagcttgaccgcttgcaattcaaggaggctagctagatagcatgtatataagcccgtgcgcgtggtgcctttcctctcatcaccatcgcctggaaccacagaccacaaaggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctgg

SEQ ID NO: 6979 - DNA, 412 bp, Zea mays
  Clone ID: LIB148-038-Q1-E1-F2
gagctcaccgccgtcctaccttcatatacctagcagtgtctctgcatagaaagataaaaggtaggaggaggcgcagtgcgtggtgggattatttgtgaggagatattggagttattatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgatgccacgtacaagcatgacccggtcgaggtcgccaaccaacttaaccgtgcagtccacagatccgtcgagaaggaggacattggcacgaggcggga

SEQ ID NO: 6980 - DNA, 416 bp, Zea mays
  unsure at all n locations
  Clone ID: LIB148-038-Q1-E1-F3
cccacgcgtccgaataaaggcacatctcttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcangacgccagcgacacgctgatcacgct

SEQ ID NO: 6981 - DNA, 375 bp, Zea mays
  Clone ID: LIB148-038-Q1-E1-F4
caagaaacaatccttgcacccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaacgcaccggccgagtcaccgaaggcaggcagtcctgcagctcctgccaaggcacccgagtctgctgccacgagaactgcccccgctaaggcacctcaagccgcctccaaccccgccggtgccgctgccccatcgtcgtcgtcgtccaagaagtctggtccagctgccgcgccgaccaacgccgcctctacaccgtcttcttccacggac

SEQ ID NO: 6982 - DNA, 411 bp, Zea mays
  Clone ID: LIB148-038-Q1-E1-F5
ctttgcatcatccaatactatgtagagagcgcagagggccgtcacctggtccgctcgccgttgtgtccattcggggcaaacacagagacctcgggagcctgccgcacctccatcgagcggaacggaagaatggtgggagaacagagaaactccaccgccatggcccggcgccgcgcctcctctggtgcactggtaccgctgccatgtgccgtgcagtgcgttggtgggatcctgtcgtcgtggtgggaatccagcggccctgggtaattcgggtgtgcgcccacatttggcctcggtgaccagctacaggattccgccgacatctccagtgcaaatcatgtggtcattccgggtggattgatgccgggggaccctgggattgttcaccggaaaatctacacagcggcaaag

SEQ ID NO: 6983 - DNA, 384 bp, Zea mays
  Clone ID: LIB148-038-Q1-E1-E12
accacgcgtccgctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccg

SEQ ID NO: 6984 - DNA, 416 bp, Zea mays
  Clone ID: LIB148-038-Q1-E1-D1
gtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgccctgcgctgctctgctgctcccgcgcattcccgatgcgtgggcgtgctctgattgggcacggcggtggcagtggcacaccttcgtcttccttttgtttgtttt

SEQ ID NO: 6985 - DNA, 412 bp, Zea mays
  Clone ID: LIB148-038-Q1-E1-D10
agcgctttcctgttcgcaagagtgggagctggaaaggcattaccaagagattttcagtgctttataatggtaagtggctgaagaacatggaatcaacatctccaagtgcagccagcagcagcagcacgcagctatccccacgttctggttctgcagaaaagttctgctgcctatcaagggaagatgttctccggtttctcattggatgccttggtgctcttgctcccatcccgctgactcagatatcttcccttggagccatcaatccgcagtacagttacgtggaagcatctgcgcctgcgatggaagcaattcagaagatccctcaagacccatgcgccgttgctgtagtggagacgatgccagatggaactcgtagcatactaggagacatctctacttacaagctgtg

SEQ ID NO: 6986 - DNA, 413 bp, Zea mays
  Clone ID: LIB148-038-Q1-E1-D11
acccacgcgtccggcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtactttaatttgggtctgaacatgtcg

SEQ ID NO: 6987 - DNA, 410 bp, Zea mays
  Clone ID: LIB148-038-Q1-E1-D12
cacgcctcatcgaatcctcaggtctaagttttttttggttttgtgagttatccaaagttggaccgcaaagatgagtactgctaatcactatcagcacatcaagtcaaccaagcctgttgtaggcaaagcaagaaaattgaaggatctcatgataaaaagtgataataggatatgtgctgactgtggtgcacctgatcccaaatgggcatctactaatattggagtgtttctttgcttaaaatgtggagatgttcatagggcacttggacctgacatttcaaaggttttatctgtaactttggatgattggtctgacagtgatatcgactccatggttgaggttggtggaaactcatatgcaaattcaatttatgaggcttttcttccaaaagatcacccaaaacccaaac

SEQ ID NO: 6988 - DNA, 405 bp, Zea mays
  Clone ID: LIB148-038-Q1-E1-D2
ggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgcacggcggctgcatcctgaccacctcctcttatgccgcgctcaacggcgtcttgtactgcaagatccacttcgcgcagctgttcatggagaaggggagctacaaccacatgaacaagaagagcccgtcccaggaggttctgccggacgtggctgacgaggagcaaccgccggaaccagcgccaccgcaagatgagaaagaagaggacaact

SEQ ID NO: 6989 - DNA, 397 bp, Zea mays
  Clone ID: LIB148-038-Q1-E1-D3
aaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgc

SEQ ID NO: 6990 - DNA, 314 bp, Zea mays
  Clone ID: LIB148-038-Q1-E1-D4
gcccgtcccaggatacgctgccggacatggcagccgacgagcaaccgccggaaccggcgccaccgcaagacggggaaggagaggacaactaggaggaagggaccgccaccaatatatatcacacacacacacacacactcacacattctcacactcaagtctgcgtttgccatttttcttttctttttctctacgacttcgttattccctcctttcatctatctctccgtgaactcggtttgtcgtccagctggctgtaagtgtaccagatgccttcgttacgtctgatgaggctcataacaatggcgattttg

SEQ ID NO: 6991 - DNA, 413 bp, Zea mays
  Clone ID: LIB148-038-Q1-E1-D6
ctccaccggctcctgtgatttcaccatcacctccggtgaaaatcctcccaccaccggcaccagttagctcacctcccccgccaattcccgtgagctcagcacccccatttgcaaaatccccaccgccacagttcaaatcacctgcaccaccaacttcgagaagatctccacctccaccggtgaagcccccgccaccaccgccacttgtaagctctccaccactgccaccaatgacctccccacctccaccaacaccggcgagctcaccgcctcctccagtgaggtcccctcctccaccggcgccaataaactctccacccccaccggtcaaatccccaccaccacctgctccagtgagctcgccacctccaccagccatctcatcaccacctccacccgcaccatcatcaccg

SEQ ID NO: 6992 - DNA, 427 bp, Zea mays
  Clone ID: LIB148-038-Q1-E1-D7
ctcgcgggtcgatacaagcctctacagtcattctcagcatgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctacatcccgctcgacgtgctcaagttcatgatccgcgccgcgctcagagacaaggccacgggcaacaacgtccacaacaagtgatacgtttatctgggtgcttgtcgcggacggcgtttaggaac

SEQ ID NO: 6993 - DNA, 427 bp, Zea mays
  Clone ID: LIB148-038-Q1-E1-D9
ctcgcgggtcgacacaagcctctagatgtatgcggatgaggccaatccttctcctatctcgtcccggagtcccgggggaaattttgccccagaaacactagcgcgtcggatcacaagcaagggcgaaaattttctgtggctccagcggctgaaggacgctgcggcacccatgtcggacgacactggtggccgcgctctacccaagttcggcgagtgggacgtgaacaacccggcgtccgcggacgggttcacggtcatcttcagcaaggccagggacgagaagaaagctcccccgacccaaggccacatcaggaacaacaggtcggtgtcggctgacagcaaggactccagggccgagaagatgacctcctacaacgccaggaccaacgcgtcgaagaaatggttctgccgtgtctcgcccaacccc

SEQ ID NO: 6994 - DNA, 389 bp, Zea mays
  Clone ID: LIB148-038-Q1-E1-E10
acccacgcgacggatgaagcttctcctcaggagacgcatggaaatcttcatcaacatcctcgcggggtcgactatcaccctcgaggtggtctctgctgacatcaacgacaacgtcggcgtcactctacacgacaaggagggcatttctccagacaagcagctcctcaattgtgccaggatgcacctcgacgacagtcacacggtgagcaactacaacattcagctggatagcacgcgccacatgcagctgcttctcaagagccggatgcacatcatcatcaacactctggtcgactcgactaacacccttgatgtcgtctctgctgatatcaatgataatgtcggcgtcactctggacgaccaggagggcatttctgccgaccagcagc

SEQ ID NO: 6995 - DNA, 393 bp, Zea mays
  Clone ID: LIB148-038-Q1-E1-E11
agtgacggtgcgggattgcgtgcttaggaacaccaccaacggcgtccgcatcaagtcgtacgaggatgccgagtctgtgctcacggcgtcccatctcaccttcgagaacatcaggatggaggaggtggccaaccccatcatcatcgaccagtacttctgcccccagaaggtctgccccggcaagcgaagcaactcctcgcatgtctccatcaagaacgtcaccttccgcaacatctccggcacgtcgtccacgcccgaagccgtcagcctgctctgctccgagacgcagccgtgcagcggcgtctcgctcatcgatgtcaacgtcgagtacgccggcaagaacaacaagaccatggctgtgtgcagcaacgccaagggaaccgccaagggaaa

SEQ ID NO: 6996 - DNA, 414 bp, Zea mays
  Clone ID: LIB148-038-Q1-E1-C9
cccacgcgtccgaggggcacaggttgtggcccatgctgtcctacgcttgcggcgagctatgtgtgatcatgctgctctacgtggctgcctttgcatcccatgcagccacaaggctggcgcgcatctgcgggctcaggccaccatgcatcctgtgcacgaggctggaccgcgccctccatggaaacttgccatggttctccgcggacctggtctgttccgtgcatcggtccgaggtctcgtctctggctcactgcaagagccatggccggcttgcacggtccggcgatctctgcaaatcatgcctcctttcatgcacggcggtaggtgcccgtgaggaggtggtgaactctcggcctacgacatccagcagcaggttgtgttcttgctgttctgatccgttcaagaataatactg

SEQ ID NO: 6997 - DNA, 414 bp, Zea mays
  Clone ID: LIB148-038-Q1-E1-B5
agatgttataataagacagaggactggatgatcttatcaggatattgaacgatgtaaatgggaacttagatgctaagaaagcttgcgctggagcattgaaacttcacaaaaaatacctgaaaaaggtacaagcaaagaaaccttaaacgtgccatggaacacacgtccccaatggggctatcgttaccatttcaacatacacgaccattttctacacacaactttgagtgaagatttatcggacacaggtggtaatcgtctgacatgtcctgagatacacggagactgatggtgccaggctagtgggttgagtacaggatgagcgcaaccggtagtgtgtatatcacgttctttgtactcaagaattttgtacagacagaaggcggtgcggatagcatgccttgcatacataat

SEQ ID NO: 6998 - DNA, 406 bp, Zea mays
  Clone ID: LIB148-038-Q1-E1-B6
cccacgcgtccgcccacgcgtccgcccacgcgtccgagggcatcgagtacctgcacgaggtggccaacccgccggtgatctaccgcgacctcaaggcgtccaacatcctccttgacagggacttcaacgccaagctctccgacttcgggctcgccaagctgggccccatgggcgaccagagccacgtcagcaccagggtcatgggcacgtacggctactgcgcccccgagtacgccatgaccggcaagctcaccaagatgtcggacatctacagcttcggcgtcgtgctgctcgagctcatcaccggccgccgcgccatcgacgtcacgaggccgtccgaggagcaggtcctcgttcagtgggtgagctgagcttttcgtttcgtttcgttacgttttccaccagc

SEQ ID NO: 6999 - DNA, 413 bp, Zea mays
  Clone ID: LIB148-038-Q1-E1-B7
attcctcggcggaacggggaagggccccaaatctcaaaaagctcaaaatttctgaggaacgggtgctgccttcggaaaaaacttggctttcccggcccggttccccgttgtgggtttccggaaccgccttgggcttaagaaccaaggtattcttgtggaagacatatccttcgtcgtcgcagacaatttcctggcaattccccagtgggggctaatgtctggtggaactacactcctgctcatgtacatgagcaacatcgtctattttcacaagctcaccctcttcttttatggtgtgcgtcgtcggtaataactaaccaaccgggtggaggtattcttcgcgccgtggatcgcctgcctcttcctcgccatcggcgtgccgccgtccgttgccactgagcccctgccgcagt

SEQ ID NO: 7000 - DNA, 331 bp, Zea mays
  Clone ID: LIB148-038-Q1-E1-B8
acccacgcgtctgatagagatgtcaatgaggacccgatacccgataacccatgaggaattcccctattagggtacgggtatgagacaaaaattgtcccatgggtatggatatgggacaaaatctccacccattgggtaaacgggtatgggtttgggaagcaataatccgaacccgattacccatgggtatttcatacgcgtacacctgtcctgtttgtatgaatgagttgaggccgagtcggccatcaaacccggcaggctccatttcttatattggtcccaagtactgatttcttttctgatggatggatgaatggataatggttcatgg

SEQ ID NO: 7001 - DNA, 399 bp, Zea mays
  Clone ID: LIB148-038-Q1-E1-B9
atatgtcatgtttctggtgtgtccacaaagctatgcatattttccgggaatcgcattgtgctgtgtgtaggcagccctatatacacttcccgagtatttgtcagctcttgcatcatttgcttctaaagcttgaaactaatgattacaaaagaagggaaaaagaagtactagaggaagagaagcgcatgcaaacatactctccccaaatcattgagttcttaaactacaagactaacgttggaagctataaggagaacagaaatgaagacagtaaagctagacctccacaagaagttccattgaatgacagcgttccagatgagcatttgaagaaaattaaattggaggatgtttcatgccctctctgtatggagatgctgtatcaacctgctgttctta

SEQ ID NO: 7002 - DNA, 419 bp, Zea mays
  Clone ID: LIB148-038-Q1-E1-C1
cccacgcgtccgccacgcgtccgctcaagctcgccgagtacttcaacgtcaccgacggggtgttcagctacaaccagatgggcgacgtgccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctac

SEQ ID NO: 7003 - DNA, 400 bp, Zea mays
  Clone ID: LIB148-038-Q1-E1-C10
cggcgcggcacggaacgccgccggccaagaaggaggccgtggaggcaatgcctaccgtggaaatcgccggcggcaacgatgacgacgacgcggccagctgcccggtctgcctggaggactacgcgcccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagagagtggcaggcggttgccgccatc

SEQ ID NO: 7004 - DNA, 404 bp, Zea mays
  Clone ID: LIB148-038-Q1-E1-C11
gtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacac

SEQ ID NO: 7005 - DNA, 354 bp, Zea mays
  unsure at all n locations
  Clone ID: LIB148-038-Q1-E1-C12
ctcacgtacaagacgacgtcgtcgtgcggcggggacgactacgaggacggcggcggcggcggaggcggcgaatgcggtagatctaagaagtacgttgttcgtccgaaggtagggcagacagtcccgtgcggaggagagaggccggcgacgggatgctggacgcgggtggacccgtccctcttcaagctcaagagcgacaccttccgaaaagacaagaagaaatgcgcggctccaaactacgctgcctactatccgataggcgttgacctgtntgcctgccccaagaaggtccatcacatcgcgcagcacctcgacgttcggcagatcaagacgcagccaaaagatcccgtcgct

SEQ ID NO: 7006 - DNA, 401 bp, Zea mays
  Clone ID: LIB148-038-Q1-E1-C2
gatcacagctagtgaacttctgacactgactctccgtacagcaccacatccgccacgtgtcaaggccactctaacactgtggtctccaatcggttgacatagcacgcaagatctggctctggccctagcggtcctcctgctcgaggcgaccgccttggtgcctaatgataacgcatacagctgctagcaggactgctacgatcggtgagccaacgtcattcaggaggatcctgactgcacaagcatctcgaaccaggcctgagggatcatagtaataggcgcagctgcaggtgagccggattaatatagtcaggcttcatcggcgcgagatctcaagtcaacatcaccatagatactcgctgctctgtcacacacataaccacatgcatattctcttgacc

SEQ ID NO: 7007 - DNA, 410 bp, Zea mays
  Clone ID: LIB148-038-Q1-E1-C4
gcgaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttgggaagaagaaactgaagacaagcgtgaaagaagagatccgtgaaccccatatggcaagaggagctaactctgaccgtcacagatcgcagccaaccactgaagctggaggtgttcgacaaggacaccttcagcagagacgaccccatgggagacgcggatgtggacgtggcgccactgatgga

SEQ ID NO: 7008 - DNA, 413 bp, Zea mays
  Clone ID: LIB148-038-Q1-E1-C5
ggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggcacactgcaggaacggcaagggaatgatagctagcgctcttaattgatcagctgatcagatgatctgccgccacgcacacgtcgtcttgtatgggctggctgctacaatgcaaccggtagatctccctgcttagtttcttgagatcgagggctccagttcttgctttgcatcctgcaaccgttggtcacaatctttgcc

SEQ ID NO: 7009 - DNA, 409 bp, Zea mays
  Clone ID: LIB148-038-Q1-E1-C6
ctctacagtgctgctcaccaccggcgtggtgggctctagggccggcccgctgctggccgggtgcgggttcttcgaggcggtgatcaccggggtcggcggccacgccgcctccccccacaacaccatagaccccgtcctggcagcctccagcgtcgtgctcagcctgcagagcctcgtgtcgcgcgaggcggacccgctggactcgcaggtggtgacggtgacgaggttcctgggcggcggcgcgttcaacgtggtcccgggctccgtgacgatcggcggcacgttccggtgcttctcgaccgagggcttcctgcggctgaagcggcggatcgaggaggtggtcgtggcgcagtccgcggtgcaccggtgcgccgcgtccgtggacttcggcgccggtgggagcccgctg

SEQ ID NO: 7010 - DNA, 411 bp, Zea mays
  Clone ID: LIB148-038-Q1-E1-C7
cggtcacgcgggcggacgcgtgggcggacgcgtgggcgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacatatacgacagaagcgt

SEQ ID NO: 7011 - DNA, 408 bp, Zea mays
  Clone ID: LIB148-038-Q1-E1-C8
gcggccaagggctgctccggctggggcttcgggcggcagcccgtgctgagcccgctcctgtactctccgcgccaggcgcggggctcgcggttccgggcgctggcgccgaccaccatcccgcgcatgtaccacgccaccagcgcggtgctgcccgacgccaccgtgctcgtggccggcagcaacaccaactcggcctacaacttcagcggcgtcgacttccagaccgaggtgcgcgtcgagcgcttcaccccgccgtacctcgccccggagcgcgcggccaaccgccccgcgatcgacgtggccaccgtccccggggacggcatggcgtacggggccaagttcacgttccagttctcgacgcccgtgcaggccgtggccgagcccgacctaaaggtgaccatgtacgcg

SEQ ID NO: 7012 - DNA, 430 bp, Zea mays
  Clone ID: LIB148-038-Q1-E1-B4
gtccatacaacaccctacattgagtcatgctaaggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacatcctc

SEQ ID NO: 7013 - DNA, 166 bp, Zea mays
  unsure at all n locations
  Clone ID: LIB148-065-Q1-E1-F7
accacgcgtcgggccgtacgagaanctttctgcctcctccaactttctccctttcctgccaaggcaaaacaccttcgccggcgaaaacatggcgatggcgtgacgtgtcctggaggtctaactgatgtctcgcaaattacctcaagaaagtgtctctcttctcccg

SEQ ID NO: 7014 - DNA, 204 bp, Zea mays
  unsure at all n locations
  Clone ID: LIB148-065-Q1-E1-F8
caggaagacggcaggagtatgcgcacgtgaccgggtgctcggcaacggcggtgcgagccacctgcgtggaccggacgcgtcgcctctgccatatccggggcaagatgcacaagaaggtgtggatcncgggcggggacatcgtcctcgtcgggctccgcgactaccaggacgacagtgccgacgtcatcctcaagtacatgaacg

SEQ ID NO: 7015 - DNA, 431 bp, Zea mays
  unsure at all n locations
  Clone ID: LIB148-065-Q1-E1-F9
attaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggangcataactgtgaagaagaccggacaggcgctggtgatcggcatctacgacgagcccatgacccctggacagtgcaacatg

SEQ ID NO: 7016 - DNA, 73 bp, Zea mays
  Clone ID: LIB148-065-Q1-E1-G10
aaaaaaaaaataaaataaaaaaaaaaaaaaaaaaaaaaaaaaaaataaaaaaataaattatggataaaagaaa

SEQ ID NO: 7017 - DNA, 375 bp, Zea mays
  Clone ID: LIB148-065-Q1-E1-G11
accacgcgtccgcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcg

SEQ ID NO: 7018 - DNA, 277 bp, Zea mays
  unsure at all n locations
  Clone ID: LIB148-065-Q1-E1-G12
accacgcgtccgcccacgcgtccggcctagcggaaggtcggcggcggcccgcctcgctgatcgcgatggagcggcggagcagcagcggcgcggggagctgcctggggctgctggcggtccccttggtgtcaacgagcgtcatcctcgtctcctaccgcctcaacggccgcctgnaggcggacctcagggtcataatacccggcaaaggcaacggacccccggacaagggccggcgccgcacaaggaagaccagaaaggtgcccttcccggccaactt

SEQ ID NO: 7019 - DNA, 295 bp, Zea mays
  unsure at all n locations
  Clone ID: LIB148-065-Q1-E1-G2
cgtcggcccagcacaagcatcaacatatgctattccaatagataatgttatacatattatccataaaacagagacgaacttgtgtaggctcactgcagcagagaggaatgaaacgatactgaaccacgcatgagttcaacataaggtacgcaaagacaaaacacagtaatacttcttgatattggtttatgcagttcacattcgatttcatcttcgactgggaaggaatgggctgcatctctggtgctgcagcagcgtcanccacgggctacctgaacacgcgggcgagccgctc

SEQ ID NO: 7020 - DNA, 96 bp, Zea mays
  Clone ID: LIB148-065-Q1-E1-G3
gcgtcggaccagatccggccagtcgaacgagaatgtcgcgcgccacagctgaggtcctcttctacatcctcgccgtcgactgccctcagcgcggtc

SEQ ID NO: 7021 - DNA, 502 bp, Zea mays
  unsure at all n locations
  Clone ID: LIB148-065-Q1-E1-G5
ccacgcgtcgggcaattctagggttagtaacagaccagtggaaggagatgggatggcaagggaaagatccatctacagatttcaggggcggtggttttatatctttggagaatttactgtatttctctaggaactatccaaaatccttccaggagctcctccgtaagcagaatggtgatagagcattgtgggaatatccctttgctgtagctggtgtaaatattacattcatgctgattcagatgcttgaccttcaagcagctaagccaacgtcgttggttggagcagttttcctaaatctacgcttataaaatgatcgancgttcgacattctttactgcataaccttcagactgatggatcagaaatggcgttaaatgcacgccagttacatggatttcaatacggttattaaatcaacacggcgccagctcgagagggagctgttgctagaagatatcaagagaatcgaggacatgccatcgtacaggtttctcgcctg

SEQ ID NO: 7022 - DNA, 235 bp, Zea mays
  unsure at all n locations
  Clone ID: LIB148-065-Q1-E1-G6
acgggcacgaacacggacacggccaccgagctccgcacgcgcacaggcagcactacgcggcgccggggccacgggcgcggtccgcctcgccgcagagcaacgccccgcgggcgtcggccgtgcncaggttcggcgtgtgggacgagcagaccgcttcgtcggccgcgcaagggttcacggtgcagttcgagaacgtgaatgcgaaccgggaggtggccacgtccggggtgccggc

SEQ ID NO: 7023 - DNA, 450 bp, Zea mays
  Clone ID: LIB148-065-Q1-E1-G7
accacgcgtccgccgcgtgggcctgaacggagagaacgcgctgccgcgctacgacgacacggcgcacgaccaggtggtggccactgccgccgacagggccgccgacgaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgacggcgtcgcgcaggcgacccatcccctcgtgcacgaggccgccgtcgcgctcacgagcgtgccggaccgggcggcgttcgccatcgactgtgttcgatcgctagacggggtggcacgctgcgaggactacctgtatggcgagtccctatacttactcatacataagctgcgccgccgtgtcgtcggtgcgtgcaccgc

SEQ ID NO: 7024 - DNA, 233 bp, Zea mays
  unsure at all n locations
  Clone ID: LIB148-065-Q1-E1-G8
ccacgcgtcggaactccaccctcgcaggcgctgcncaggtaagtcggcggcggcgaggacaacgcgcgtcaagaggaagcgcaggagcgcggcacgtggcgcgcgggcacggccgcatcggcaagcacaggaagcagccgggaggtcgcggtaacgccggtggcatgcgacaccaccgtatcctcttcgacaagtaccaccggggcgacgtccgcaaggttggcatgcgttac

SEQ ID NO: 7025 - DNA, 247 bp, Zea mays
  Clone ID: LIB148-065-Q1-E1-H1
gcgtcggcggacgcctgggcggacgcatggggcgcacggtacttgccttcttatgtgcttctcagtttcttcgaatagtagcattctatgcagcagagcttccagcacctaagtatcattgtcgcgagggctcgcctctggctagattaccaccaccccagaatgcagctgaggtctttctgattaatttcccaacaaggagtgatttatggatgtggtgacttgatattttcatgccacatgattt

SEQ ID NO: 7026 - DNA, 339 bp, Zea mays
  Clone ID: LIB148-065-Q1-E1-H10
acgcgtccaatccaggatcaccatcaccaacaccgtcattggcgtcggcgacgactgcatctccatcggccccgggacctccaaggtgaacatcaccgacgtgacctgcggccctggccacggcatcagcatcggaagcctaaggcggtacaaggacgagaaggacgtcacggacatcaacgtcaaggattgcactcttaagaagacgatgttcggcgtccgcatcaaggcgtacaaggacgccgcctccgtgctcaccgtctccaagatccactacgagaatatcaggatggaggactcagccaaccccatcttcatcgacatgaattactgccccaa

SEQ ID NO: 7027 - DNA, 416 bp, Zea mays
  Clone ID: LIB148-065-Q1-E1-H12
cacgcgtccgaacaaaataaactatggggcaagccttcccacggcttgtcctcctcgccctcgtggcgttgttgtctgccggcctcttcccgcaggcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgaccatttggccgtgctgaacatgcaggtggccgcgttcgccaagcgcacagcgcaggcgcggaagcacgtcgcggtggcggcccgcactattccaccgccgcaggcacaggccctcagaacctgcgacacgatgtacatgaacacgcaggacgccatcggcgcggcgcagcgagccatcgcg

SEQ ID NO: 7028 - DNA, 248 bp, Zea mays
  unsure at all n locations
  Clone ID: LIB148-065-Q1-E1-H2
ccgaagaaggccataggaccctggcctcgtgntacaacatgacggccatgggctacgtgccgtacctgtgcgggctcaactacacggacgacagcgtgagcagcatcatctacccggagccgccggtgtcgtgcgccaagctgtcaaggctcgaacaggacgacctcaactacccgtccatcaccgtcatcctcaaccagccgcgcttcagcgcgaaggccaaccgctccgtcacgaacgtcggcgcg

SEQ ID NO: 7029 - DNA, 165 bp, Zea mays
  Clone ID: LIB148-065-Q1-E1-H3
gcgtcgggccccatgtggtcgtcgatacgggcacaggttgcgatggctgtggtgttggtgttcttggtgagcggcgcatggtgcggtcctcgcaaagtcgcgccacgcagagagcatcacggccacctatggcaacgactggctggacgctaaagcgacatggta

SEQ ID NO: 7030 - DNA, 79 bp, Zea mays
  unsure at all n locations
  Clone ID: LIB148-065-Q1-E1-H4
cggcccacgcgtccggtccgaacaagacaagttcgtgttgccttanaaaatcaagtggcacggaaaaagattcctgaac

SEQ ID NO: 7031 - DNA, 325 bp, Zea mays
  unsure at all n locations
  Clone ID: LIB148-065-Q1-E1-H5
gacaagaccatcgacgggcgcggagcgcaggggcacatcgtgggcgcgcagatcacgctgcagaacgtgcgcaacgtgatcctccacaacctgcacgtccacgacgccgcggcgcacggcggcggcgcgatccgggactcgcagcacgactggggcgtgcgcggngagagcgacngcgacggcgtctccgtgatggngtcagcnatgtctggatcgacgacctgtcgatgagcagctgcgcggacgggctggtggacgcggtggacggctcgaccgccatcagcgtctccaacggccacttcacgaggcacgagcacgttatgct

SEQ ID NO: 7032 - DNA, 488 bp, Zea mays
  unsure at all n locations
  Clone ID: LIB148-065-Q1-E1-F5
ccacgcctcggacggggcaagcctcacggatcgtcctcctcgccgtcgtggcgctgctgtccgccggactcctctcgcaggcacggggtaanggtaggggaggcaggggacacggtggcgccgtcaatccgcaagtcgccggcatctgctctcgcagcccgttcccggaggtgtgcacgtccatcgccgggcggcacgcgtccaagtacccaggcatcgataacctgaccgtgctgaacatgcacgtgcgcgcgttcgccaagcgcatcgcgcaggcgcggaagcacgtcgcgaggtcggcacgcaccagcccgcggcagcatacgcaggcgctcacgttctgcgacaccatgtacatgagcacgcaggacaccagctacgcggcgcagcgggccatcacgttcacggacaccggcatcgccaagatcatgctgcagctcgccgtcgacgacttcgactcgtgcgaccgccccttcacccaggccggc

SEQ ID NO: 7033 - DNA, 371 bp, Zea mays
  Clone ID: LIB148-065-Q1-E1-H6
gcccacgcgtccgaagatgacgatcaagctctgaaatcactctcgagcattgagatgaatgagcatcagtcaaaggaagcatcagtgtctcttatacttgatagcttggaagatctgtcagagtcagaattgtcgactattagaaaacagctgattgaggaattttcagcagatgacatttgtcggggatctcattttactgaaacaccttcgaaatctggagcacaaaatggaaaactgcaccacaaatctatggaggttattccattcggatttggttgtggagatggggctctcggtgaagcatctgacagcttagtagaacctcacttgcgacatctgcgatgtaacagcgtttctgatgttgaccg

SEQ ID NO: 7034 - DNA, 397 bp, Zea mays
  unsure at all n locations
  Clone ID: LIB148-065-Q1-E1-H7
accacgcgtcggcgcgagcgccgcccttttttttttttttttatataattataaaggctagtttgacaacttcattttctcaagtgaatcctatttttcaggagaaaatgaattaaattcccttgaaaaaataaaacctcttagaaaaaataaggttgtgaaactagccctattaataaatttatgcacgaatgcaacatcggtttcagcatgttcctctttacagaatactactgcttccgtgtatacagagaaactacatttcacggagtagtaaataaacagggattaattagcgccgtgtgcatgcatgcatacngcgttgggctggccgacatgatcataacaattaattaattaattaaggcgaagacagcaagcgtggaggatcgatgcg

SEQ ID NO: 7035 - DNA, 423 bp, Zea mays
  unsure at all n locations
  Clone ID: LIB148-065-Q1-E1-D2
tccggaagaccaccgtcggccgggcgcgcagtgcaatcagttcgcgcagatcacgctgcaaactgcagaacgtgatcctgcaaacctgcacatccacgactccaagggcactcgggcggcatgatccgcgactcgaagcggcactacgggctgcgcacgcggagcgacggcgacggcgtctccgtgctgtcgtccagcaacgtgtggatcgaccacctgtccatgtccagctgctccgacgggctgatcgacgtggggaacgggtcgacgggcatcaccgtgtccaacagccacttcaccgaccacgaccacgttatgctgttcggggccagcaaggacagcccgcaggacgcggtgatgcaggtcacggtggcgttcaggcacttcggccgcgggctggtgcancggatgccgcgctgccgc

SEQ ID NO: 7036 - DNA, 285 bp, Zea mays
  Clone ID: LIB148-065-Q1-E1-D4
ctttctcgcacctcaacctttctccttttcttgccacggcaaaacaccttcgccggcgaaagcatggccatggcgtaccgtgtcctggaggtcacgctggtgtcggcaaatgacctcaagaaagtgtcgctcttctcgcggactcgcatctacgccgtggcttccatctccggattcgacctccgcatcgcttcgcacagcgaccaagcagaccacagcaacggctgcaacccctgctggaacgccgtggtacacttccccatcccggctggcgctgacacccgc

SEQ ID NO: 7037 - DNA, 425 bp, Zea mays
  Clone ID: LIB148-065-Q1-E1-D5
ggattccggatcgaccacgcgtcgggcaatctgctggcagacacggacctaagccagtacaaggatcatggtaattggatcgagattctacgcgtggacaaccttgtcagcagcggcaagggaaagcgcgacgggcaggggccagccgtgtggagcaagaactcctgcgtcaagaagtacgactgcaagatccttcccaactcgctggtgatggacttcgtgaacaacggggaggtgtccgggatcacgctgctcaactccaggttcttccacatgaacatgtacaagtgcaaggacatgctgatcaaggacgtcaatgtgagggcgcgcgggggaagcccaacagcgacggcatccacatgggcgactcgtccggggtcacgatcggcaagcacgtcatcggcgtcggcgatgactgcatctcc

SEQ ID NO: 7038 - DNA, 417 bp, Zea mays
  Clone ID: LIB148-065-Q1-E1-D9
cgggtcggccacgcgtccggacaaccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaaattgggttccgacggatgtaaaacac

SEQ ID NO: 7039 - DNA, 305 bp, Zea mays
  unsure at all n locations
  Clone ID: LIB148-065-Q1-E1-E1
cgcgtcggccggatgcgccgccagagcaaggccgtcgcgcgcgtccgcctcgtcctcgacgagaagaaggtctcgcaattcaanggccaacgatgacgtctgagataatccatgacggtggcgcggcgaactcctatcataaaacctatgcttcctgccaacggagtgactccatggcctgtcctgggacacctgtgagatgacgtgatagagcgagtagtacaactggcccagcgagccatgcagagacgctcgacttgccacaggccggggcatattacgcgatgcccagcagcagatgtact

SEQ ID NO: 7040 - DNA, 344 bp, Zea mays
  Clone ID: LIB148-065-Q1-E1-E12
gatcacctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggaaatggccaacatccataaggacttccacgaaccaagggaactcgcgccgacaggcctgttcctcggacctaccaagtacatggtcatccaaggcgaacctggtgccgtcatccgtggcaagaagggatcaggaggc

SEQ ID NO: 7041 - DNA, 241 bp, Zea mays
  unsure at all n locations
  Clone ID: LIB148-065-Q1-E1-E3
gcgtcggcacacgtgtgccttttggagacgcgatgtcgtccggcaacaagatcagcgtggccttgctgagcgtggccctagtgggcctgctcctctgccagctgcgcaggagcgcctccgcccaacagaaagacatccacgtcctcggcagcgtcgacggctccagcgacngcagcaccccgagtccgaagccgcgtcgtctacgcngacatgaagctggctgatacggaatcggatgcgc

SEQ ID NO: 7042 - DNA, 372 bp, Zea mays
  unsure at all n locations
  Clone ID: LIB148-065-Q1-E1-E4
ctgggtgggccactggcaatggatcgtctgcggcagtgccaccaagctgggttttcttctgtttgtaacgtgttccgtagactgggacaaggaggcagtgaangcaacgtacagagtgttagggtcatctctcccgttagcatgaaaaaaatgccagtgttacatggaaatcncatttgaaggcagttgaacagaacccagcagagaaagcgtgggaaaaaaactttctatagtttgggacatctcaagatcatagatagctaccgggaaggcaagaagaaccacgaccagtatttttggattcatctgtactgttaaattttgtagcactgcaatgggttttcaggaaattatagtagcttggattgactc

SEQ ID NO: 7043 - DNA, 206 bp, Zea mays
  Clone ID: LIB148-065-Q1-E1-E5
accacgcctcggacctactataacaattgtagatttgcttgctggtcactctgataaaactagtgcattgcatgcgatcaaatgtaacgctcgatgctgcggtgctaccatgcacgtaccatattcgcgtaagtcagatgacaaatcaagtctatatcctgcagactgggcttaccactaactacctagtacctcctagcttgcta

SEQ ID NO: 7044 - DNA, 114 bp, Zea mays
  Clone ID: LIB148-065-Q1-E1-E6
gcgctgctcatctcaatcctcgagaaacgcatgcccacgcgatcgagagatagcgtcatcgccgactgcaacgacgatcgctacatcctcgatgctcactcccggacaactatc

SEQ ID NO: 7045 - DNA, 369 bp, Zea mays
  unsure at all n locations
  Clone ID: LIB148-065-Q1-E1-E7
accacgcgtcgggcgcaaagccaatcaataatcagcagccacatcaatccattcgctttcctctcncgctccacttccatgggcaaggttcggtccttcttcgcgcgctcccgcagcggcaagcgcggcagcgcccggagagcaggctcgtcctcgccgcactcctccgcggccagcgcgccgccgtccccgtccccactcccgaggaggtcacggtcgtcgtcgtcaaccacaaccagggacgagacggagcgcgtgttccgcaagttcgacgcnaacggcgacgggcagatctcgcggtccgagctggcggcgctgttcgagggcgtggggcacgccgtgaccgacgacgaggtgtcgcgcatgatg

SEQ ID NO: 7046 - DNA, 420 bp, Zea mays
  Clone ID: LIB148-065-Q1-E1-E9
acgaacagacacatagagagactggacctcccgtcacaatcaaagagggaagaacctcctatacagcgaccaccatcgattgctcgtcccagctcatcagcagcgacatttctgtacctcactcacgcgacagacacgctagtcctggcccacgtactgtgctcagttccaatgtcgctccctcgaggcagaccatcgttatcagtgactcacctctataaagtcactgtcatcaccttcatggacacctagatcgacgtcaagcccgcatgtctgatcgttcagggactgtttggtgacatcattccaaatatcgacagaaacttccgagcactttgcacaggggagaaaggaattgccaagtccggcaagcctctgtggtacaaggggtcgacgttccacaggattatcccggggttc

SEQ ID NO: 7047 - DNA, 246 bp, Zea mays
  unsure at all n locations
  Clone ID: LIB148-065-Q1-E1-F1
cgcgtcgggccctcgacttctatttcaacgtcaaccggcaggtgtcggagcccaggatgtcgtttcgcacgagcacgagctcagggccgtctctgtcgggcagcaactcctcgcccaacctctgcngcacgcccagcccaggtagccctggtgcgcactcgagtaacgccttggagtcatggaagatttgcaacccaggagataaccctctgctgtgtgaagacaaggctcaggcactgggctcaa

SEQ ID NO: 7048 - DNA, 402 bp, Zea mays
  Clone ID: LIB148-065-Q1-E1-F10
accaagcgtccgcccacgcgtccgcccacgcgtccgcccacgcgtccgatccgatccatcttgggcgggcgccgcgcgtcgagggccagccaaagcttgccatggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgccaaagcgacctcaacatcaagggagcacgctcct

SEQ ID NO: 7049 - DNA, 423 bp, Zea mays
  Clone ID: LIB148-065-Q1-E1-F11
aactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgacca

SEQ ID NO: 7050 - DNA, 401 bp, Zea mays
  Clone ID: LIB148-065-Q1-E1-F12
acggagcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgaca

SEQ ID NO: 7051 - DNA, 373 bp, Zea mays
  Clone ID: LIB148-065-Q1-E1-D11
accaaacgtccgcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgccgtggactgcgcggctccgagaagtcgaggtcgtcgcgacatatcccaggaaccttcggacttggaacgaagctgtccataatatggaaagcatgattgggacgaaggtcgaatcaattctgaagctatgcgcaaggaagcttcggctcagtagcagaaaaaggaaccgacctaaaaaggaaaaggctattt

SEQ ID NO: 7052 - DNA, 292 bp, Zea mays
  unsure at all n locations
  Clone ID: LIB148-065-Q1-E1-F2
gtcggcctcgctcatctctgcgcacgtgatagacgcccgtctccgcctcggcttcttcctcctcctcgtggccgcggcgttcgcgccgctggtctccgcgcagctctctgcagagttctacaanacgtcgtgccccgacgccgagaagatcatcttgggcgtcgtcgagaagcggttcaaggcggnacccggcaccgccgccggcctcctccgcctcgtcttccacgactgcgtcgcaaacggctgcgaggcgtcgatcttgatcgagcccatgtcgaaccaggcctccgag

SEQ ID NO: 7053 - DNA, 246 bp, Zea mays
  Clone ID: LIB148-065-Q1-E1-F4
gcaaggcgacggagacggggatctcctgctgctcggtgctggctggagtcctgcagaccgacgcccgctgcctctgcatggtcgtggacggcacgccacgtccttcggcatcgccatcaaccagaccagggcactggagctccccggcgtctgcaaggtcaaggcgccgccgctcagccagtgcacaggcgtcccggcggcacctgcaccgacgcctcgcgacgaaccagcagcgggagcggagga

SEQ ID NO: 7054 - DNA, 313 bp, Zea mays
  unsure at all n locations
  Clone ID: LIB148-065-Q1-E1-B4
gcgtcggccggcgtcggnggtgctggatcacatgaccggcggcccccnggtaccgattccgctggggcgcaaggactcgctgtcgtcgtcgcgcaagaggccnacgtcgagctgccacacgccaacttcaccgtggaccgcctcatccagatgttcggcgccaaggggttcacggtgcaagagctggtggcgctgtccggcgcccacacgctgggcttctcccactgcaaggagttcgccgaccgcctctagaacttccgcagccagggcgggaagccggagccgttcgacgccagcatgaacccgtcctacg

SEQ ID NO: 7055 - DNA, 462 bp, Zea mays
  unsure at all n locations
  Clone ID: LIB148-065-Q1-E1-B5
ccgctcctgcgcacgccatccgatgcggtcactggccggggagggctcagaaacctttcatccaatacatacatctatctgagccctttcgcgcggtgaggcccgaccggagtccacacacacacggtgtcgatggcggccgtaataaggagccgccgccgcgtgtccgttttcttctacgtcgtcctcgccgcagctgcagctgcagccgcggcgcaggcatccaataacgtcacctcggacgaggagtactgggcggagcgcgccgaggtggctcggtcgcgcaacctcgccgcctaggtcagcgacgccgtggccgccacgaaccgcttcaacgcggacgtgctgagggccacgacgcggcnggcgctggcgaagtacgatggcccgtgcatggcgaccaaccccatcgaccggtgctggcgctgccgcgccgactgggcgacggaccggaagcggctg

SEQ ID NO: 7056 - DNA, 424 bp, Zea mays
  Clone ID: LIB148-065-Q1-E1-B6
ccacgcgtccgacaagccctccacttcaaggaaaacaagcaccgttttgggttcgctaaatcacggctgacatatggtaatattgggggaaggttcgtgacagggagaaccatttgttgaggagtcatatcagagggttgccctggaccggcttcttaagcttgcaagaatagaagacgatgacctgctgatcatgtcggacgttgatgaaatcccgagcggccacacaatcgatctcttaaggtggtgcgacggcattccagacatacttcaccttcagctcaggaattatctctactcgttccagtttttcctggacgacaagagctggagggcatcgatacacaagttacaagctggaaagacgacctacgcgcacttccggcaggcagacgagctcctcgccgattcagggtggcattgc

SEQ ID NO: 7057 - DNA, 400 bp, Zea mays
  unsure at all n locations
  Clone ID: LIB148-065-Q1-E1-B7
tgcctcacggggcaagggggctgagctcgccgcctcgtctcggcctggcctggttcgccctcgctccgacgcgtggtggacgcagccagtgcgcgacgcccccggctcctggtccgttccgcagttccgcaccccgcttcgaccaaccaggcgccgccgcgtcgcgtcgcgtcgcctccttttttttcgccgcccgcgcggacggcggcctcgtgcgccagaagaaacccacgcggcagccgagatcctcaggtctcggtcgtctgacnccagctcgacggcccagatgcagtcgcgcgcgccggccgtcgtgcgcctcagtccctcactccctcgcctcctcagcggcgagtagagcggccaagcgggccatttttaggcgggagcgcgggcggcggtg

SEQ ID NO: 7058 - DNA, 442 bp, Zea mays
  unsure at all n locations
  Clone ID: LIB148-065-Q1-E1-B8
ccacgcgtcggccgcctctccaccggcacggtcgcccggagtagcaagcgtctccgatccgatccagcgtgcgagcatatcacggcgatggaggcgagagcggccatgagctggtactgcggctcccttctggccgtggccatcgcgctgttcctgtccgtgtcgctcggcgtgcgcgccgccggcgccggcgccggcgtcgacatcagcgtgtcgtgtgcagcgacgccggacccggacgtgtgcctgcggcgcgctccacggcggacagcgactccaagaccccgcgggacctggcggagggcggcgctccgcgcggcgaccaccgctgggcgcgcggcgggcgactacgcgcggcacgagatggacgtggcgaacgacaacgacatgtggcagtgcctgaacgagttccccgggggagatgaggangcgctggacacct

SEQ ID NO: 7059 - DNA, 378 bp, Zea mays
  Clone ID: LIB148-065-Q1-E1-B9
cgggtcgaggcacgcgtccgacgcggttccctcgggcgtgcaagcggtggagagatctggggcaggccgccgtggtgccccgaggtgggtgactcatgccgatgctcccgaagcaccaggcacgcagcggtggttctcccctaagactgagtgatggcgatgctccagaggcgggcaggcaaacagcgacggcattcccgagtcaaacgagtggcggcgtcgcaccctaagctcagtggtaaccgtgattgtgcgaggcacaataggcttcggcaatgacggtggtggccatgggacacgcgggtatctccgacaggcgcgtgacgcgcagtcgtctccatccgtggtggccacatgaagcctcgttggctcccgtgt

SEQ ID NO: 7060 - DNA, 182 bp, Zea mays
  unsure at all n locations
  Clone ID: LIB148-065-Q1-E1-C1
tcgcccacgcgtccgccaccatccgacagtaagcgagtacaaaactgggtgtggaagtccaggacgactgttctcaacgggcctcttcagcagtccgggggcagaacancgcaagtaaacaggctcgactcatccangcaaagggcgcagtacccgagtcgctcacaagtaccccgcgcgct

SEQ ID NO: 7061 - DNA, 437 bp, Zea mays
  Clone ID: LIB148-065-Q1-E1-C10
ggttacctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaggatatac

SEQ ID NO: 7062 - DNA, 432 bp, Zea mays
  Clone ID: LIB148-065-Q1-E1-C11
gggtcggccacgcgtccgcactaatccaagacaaaacatggctgtgaatgtgagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctat

SEQ ID NO: 7063 - DNA, 264 bp, Zea mays
  Clone ID: LIB148-065-Q1-E1-C12
cacgaagccgcccggcgcgtgctggaacgagaacgacccgccgtccccgtccccgccgcagcccgcctcctcggccgccgaggacgccaccgcactgtcgagcgcggcgacccacgcgcggcgccgcttcggctcgggcacccgctcctcctcctcctcctcggccccgccgtcgaaccccgggatcgggagcccgcgcttctccggagaagcagaagagctcccgcgcgccacgggccgaggaggcgctcggggcagcgcgcg

SEQ ID NO: 7064 - DNA, 395 bp, Zea mays
  unsure at all n locations
  Clone ID: LIB148-065-Q1-E1-C2
gcgtcgggccgaagcgacccagccaatcgatcgttcaggaaaaatacaagcttaccaacaacagcagcagcaagcccagccgttcgacgacatggcccgcgtcagcgccggggccgtgttggcgctcctagtggcggtcgcggcggtggccgcgttcctcgcggtgccggcctcggcgagatccggggagctgagcccgatgggttgctggcgggcgaaggcggcancggcgcgggcccgcagaagtcctccggcgcggtgggcgattgcgacgtggacgaggcggaggagctcgggctgagcgggggcagcctcgggtccggcgacgcgggtccggcggacgctggcgcagcggaagccgaccaaccgggtcagtangtacgcggcgctgcgcg

SEQ ID NO: 7065 - DNA, 458 bp, Zea mays
  unsure at all n locations
  Clone ID: LIB148-065-Q1-E1-C5
accacgcgtcggccaaggttgaacataagaaggtgccgccaactcgtgccaagtcaccaaaattgacacggagaaagagctgcagtgaaaccgctcagacgccagagggaggaaatggcagtgcagtatgctgccggttgcatcgccacagcattgggaacgccagagatgttagcagcaaggcacaatgttctccaaagagcgcctcaaaggctggatcagctactagatccagggtcaccaaatccatggaagacctgaaggcttccgtgaanaaagtgggactgccaagcgccgcgaacttcgctctgcaggcgtgactcagcaggcagtcactcccatatgccatttttcattttaatttatacctcacatcggcaggaagatgggctcgtggtagttttgcattgtccttgtaagaacctggctaccagagacctgcgctgttcccgtcctgt

SEQ ID NO: 7066 - DNA, 424 bp, Zea mays
  unsure at all n locations
  Clone ID: LIB148-065-Q1-E1-C7
accacgcctcgggctcggtccttcgacatcaacaagttgggcgcctccggcaatggcaagacagacatcacgaaggctgtgcaggaggcatggncatcggcctgcggcggcactgggaagcagagaatcctcatacccaagggcgacttccttgtcggacaactcaacttcacaggcccttgcaagggcgacgtgaccatccacgtggatggcagtctgctggcgaccacggagctaagccagtacaaggaccgaggtaattggatcgagattctacgcgtggataacctggtcatcaccggcaagggaagccgttgacgggcacggcccagctgtgtggagcaagaactcctgcaccaagaggtacgactgcaaggtcctgtcggactcgctggtgatggacttcgtgaacaacggggaggtg

SEQ ID NO: 7067 - DNA, 401 bp, Zea mays
  Clone ID: LIB148-065-Q1-E1-C9
gggtcggccacgcgtccggactagacgtgcagcgattctcgatcatgcttgcgaccggctggcattttgtcccgacgctcgccgccggttggttggatccgtgccccccccgatcgatcgactgtgcgtatggtatgattgggtagctgttgccgtgttggaggtctggcgtccggcgatggcacaccacagcggcgcggcgcggcgcggcgggcgagccatggccatgaatcgatcgggtgtccagatccggtggagggaggtccggccaggcagagccgcagccagcctgcgttgcggctgcctgttcgaagtgatcgatcagccggaggatgccgcggaggtatcagattccgattcccggccccagccgcccccgtgctcgtgcaaacctgtccttc

SEQ ID NO: 7068 - DNA, 251 bp, Zea mays
  Clone ID: LIB148-065-Q1-E1-D1
cgcgtcggtcttttttttttttttcgatgagcatttaagtatttttgggcaggaaagaacacataccagagatgaggttgttggttgaatttgattcgaagtgctaatgaagagaattgtgagctccggcccggcggtgccgccctcggggttgtgcatgtagtacgtctccgagtcctgtggaccgacgaggcggtcgaaatgcgcgcgcatgtaagtgagctcgccgtccgacgggtgggacatatcgg

SEQ ID NO: 7069 - DNA, 331 bp, Zea mays
  Clone ID: LIB148-065-Q1-E1-D10
cgttcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcct

SEQ ID NO: 7070 - DNA, 392 bp, Zea mays
  unsure at all n locations
  Clone ID: LIB148-065-Q1-E1-B2
gtgacggcggcgcggaggctcaccaaggaggaggtcaagacggccgcgacgcccgaggcgcggagggcgctgaacctctgcaagacctacgacctggacgccgccgacaacctcngccgcctgcaagcgcgccatcggcttccgcgacgccgtcaccatccgcgccacgatgagcatggtggcgcaggacacgcagaactgcgaggaggagttcaggaaggccgtctccgaagaacccatgggggagcacagcangtcgctcatcnagatgtccgagatctgccgcacgctctccaacatggtcgcctacgaacatgtccattgatttgtttgtttccttttcccgacgccctactacgttcggtagagtcgtcgtcgtcgtcgtcgtccgg

SEQ ID NO: 7071 - DNA, 399 bp, Zea mays
  Clone ID: LIB148-038-Q1-E1-A11
cgatacaagcctctagagggagtcgatattacctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcgtcgcctactagctgcactaagcgg

SEQ ID NO: 7072 - DNA, 408 bp, Zea mays
  Clone ID: LIB148-038-Q1-E1-A12
cccacgcgtccgaaagaagagagagctgggggatggacacgcacgtcggcaaattaatcgactcggtgggctccatcttccgcggcagcgacgtcctgccctggtgcgatcccgacatcatcgccggtttcgagagtgaggttgctgaggctgcaaatgaagaacagaaaaccgagagcctgatgaggctctcctgggcgcttgttcactctagacagcctgaagatgtcaaccggggcatcggaatgcttgaagcttcattggacaggtctagcagcccagaggaaacaagggagaagctctacttgttagctgttggtcgttacagaactggggattatacaagaagccgacagcttttggaaagatgcttagagatccaacatgactggagacaagccataactt

SEQ ID NO: 7073 - DNA, 417 bp, Zea mays
  Clone ID: LIB148-038-Q1-E1-A2
gaccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccggtatcaaggcgtcgctcaacttccgcatccagggccactacatgaagctggtcgaaccgggaggggctccacaccctgcagaacacgtacgactcgctcgacgtccacgtcggccactgcctctccgtgctcgtcgacgccgaccagaagcccggcgactactacatggtggcctccacgcggttcatccacgacgccaagtccgcgtccgccgtcatccgctacgccggctccagcgccccgccggcgccgaacatgaccgagccaccggccgg

SEQ ID NO: 7074 - DNA, 424 bp, Zea mays
  Clone ID: LIB148-038-Q1-E1-A3
caagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgac

SEQ ID NO: 7075 - DNA, 410 bp, Zea mays
  Clone ID: LIB148-038-Q1-E1-A4
ccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgttgccgctgccccatcgtcgtcgtcgtctaagaagtctggtccagctgccgcgccgaccaacgccgcctctacaccgtcttcttccacggacgaggagttgagcccttccccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcacca

SEQ ID NO: 7076 - DNA, 381 bp, Zea mays
  Clone ID: LIB148-038-Q1-E1-A5
gcaaccaccaagaatgatcgatgtctaaacacgcgtggtcgccgttgtcgtctgtcattcctcgtgtacagaagaagcttagtgcctaacacatgaattaacggtacactgaatctatcacatgtctcgcctatatatgttcctgttggccgtccatcgacttggacattttggaacccacaaaccacacagagcaatactgaaaaaaatgtgggtttacagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaaagcttacttacccttgaaggcaagttcaaagccctt

SEQ ID NO: 7077 - DNA, 405 bp, Zea mays
  Clone ID: LIB148-038-Q1-E1-A6
gtgagtatcatgtggtcgttagtgcaggtgcaggtgctggtggcggtggcattagcatttctggtaggcggtgcctggtgtggtcctcccaaggttcccccgggtaagaacatcacagccaaatatggtagtgattggctagatgccaaggcgacatggtatggcaagccgacaggtgctggccccgacgacaatggtggcggctgcgggtacaaggacgtgaataaggcccctttcaatagcatgggcgcgtgtggcaacgtccccatcttcaaggacggtctaggttgtggatcctgcttcgagatcaagtgtgacaagccagcggagtgctctggcaagcccgtggtggtgtacattacggacatgaactacgagcccattgcggcataccacttcgaccta

SEQ ID NO: 7078 - DNA, 403 bp, Zea mays
  Clone ID: LIB148-038-Q1-E1-A7
aggaatcacgcgatatccaataggtccgttggcccccacgacgagctttagttagatctactgcagccagccttttgcgagcagccacagcggtggcggccgcgccggcgtcggcttcacgctcatggctcgtgcccaacgaagctcaagacgagctcatgcttgtgatcgtcaagcaatcacgtcgtgatccgatcattttgtggctcagggaaggcgttgtaggaatgcagtgcgactgatgttgttgttcattgcgcggtgcgtaactacgctggctgagagattagaatgacatgttgccagtacattacaagcgctcctgtctgatctctgtttcagaactagtttgggaaatgtaagatgagaccgtggacgccaatgtttcagatcctcctccttt

SEQ ID NO: 7079 - DNA, 408 bp, Zea mays
  Clone ID: LIB148-038-Q1-E1-A8
gagggtgcttcgcacgtgcatgtgagatcgggcgatcccgatcgtcggccggcgcgaattgaactaacgacgacgtacgtgcgaccgggccgggcgttggattattccggcctgagcaatgggcaagatcgagtacggcgtggtggcgcgcggcgcggtggtgctggcggagcactacggcgcggcggcggcgggcggcaacgcgggcgccgtggcgcggcaggtcctggagcgtctccctggcggcggcgacgacgactgcaacgtgtcgtacacgcaggacctccacgtgttccacgtcaagcgcaccgacggcctcacggcgctctgcatggccgacgacgccgccgggcggcgtgtccccttcgcgttcctggaggacatccacgggaggttcgtcaaggcgta

SEQ ID NO: 7080 - DNA, 408 bp, Zea mays
  Clone ID: LIB148-038-Q1-E1-B1
gtgacgacctctcctcctcgctgtctctctgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgccggcgtgtccgcgctcagagggttcaagctatcatcaccgacgacc

SEQ ID NO: 7081 - DNA, 403 bp, Zea mays
  Clone ID: LIB148-038-Q1-E1-B10
acgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgct

SEQ ID NO: 7082 - DNA, 399 bp, Zea mays
  Clone ID: LIB148-038-Q1-E1-B11
acccacgcgtctgctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctaaacgggaatgactgccgcagaatgacgaat

SEQ ID NO: 7083 - DNA, 400 bp, Zea mays
  Clone ID: LIB148-038-Q1-E1-B12
cccacgcgtccgtcgaagcagtggtggtgggtaagggtaaggtggccaaggataccgtgtccgagtcacctgctccaagccccgcccccgtctccgccccttagttgcgtgttgggcgccgctgcccgccggcccccggccaccatgcgtcgtgtctgcgcgcgcacgcacgcattgaacgggagatagaatatggtatcgttcaatgcagattgccatgctatagctccagagtttatctacctggtagcaccatgacacgatggcccgttcgtattttctggcttgctcgtacttttcagttccatggttttacaacaccttttactcccagcagaaaatacataatatgcatggtactcctcttttttttccgtatagtaatataaacaaattttca

SEQ ID NO: 7084 - DNA, 421 bp, Zea mays
  Clone ID: LIB148-038-Q1-E1-B3
catcaatcatgtctggtcgttcgtggacaataatggcgcctctcctggcgtcgatgctgctcgtcgggctcgccgtgggctccgatgaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaaaggcgagctggggaaagactacggcaccctgacggcggccgtgggcccgtcgctgtacaccaacggcaccgggtgcggcgcgtgctatgagctcaatggccccaaaggcaccgtggtggtgacggccaccaacgatgccccgccgccggtgagcgggcaaaaaggcgagcacttcgacctcaccataac

SEQ ID NO: 7085 - DNA, 433 bp, Zea mays
  Clone ID: LIB148-038-Q1-E1-A10
ctcgcgggtcgatacaagcctctacagtgacgtcctactaacgcgtccgtcaccagcctcctccgacacgtaaattgcaccgatcgagacacagggaacatcggcaacagccttggcgggaacccgtgccctgtagctcctcgatcgcggctgtcacggagctcttacccacgcctgcggccgtggacgcggccaggctggcggacatctgcatgggaaccgcgttcggcgatatctgcaccaacacggtggggagcgaagtgcatagcgccggtgtgttagacgccatggcggtgttgcagattcacgtgggcgcgttcaacaagcacagcgaggaggagagggcacacgtcaaggatgccgcaatgacagcgtcacacaaggcacggacggtgctggacctgtacaacagcctgtacctgcacctagatga

SEQ ID NO: 7086 - DNA, 409 bp, Zea mays
  Clone ID: LIB148-037-Q1-E1-G7
cccacgcgtccgcccacgcgtccggtccaagccagaaaacagtaaaatggcccaatgtaagaccatcgtcgcagcagtcctcgtggttgctctcgtggtttcgacgatcccagccagcgccgatacgaacctggaacctgcaggaggctctacggagggcagtgcccgcacctccggcatgcagaaggaagagacccgaggcaacaagaagccagcgacgctcgctggatctcttggttcaggcaagaatgccatctacgggtaaatgattagaaggaatcctgcttcggaaggtatgaaaacaatggggatgtgctcaacaatcaatctcaaccccaggtgacggcaatgagtcacccacaggaatgtaaccggatatagatggacattgctcgttccatatttcttt

SEQ ID NO: 7087 - DNA, 393 bp, Zea mays
  unsure at all n locations
  Clone ID: LIB148-037-Q1-E1-G8
gccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtntggttcatccgattaattaattgtttttt

SEQ ID NO: 7088 - DNA, 350 bp, Zea mays
  Clone ID: LIB148-037-Q1-E1-H1
cactgaggcgcccctgaacccaaaggctaaccgtgagaaggacggccagatcatgttcgagaccttcaacacccccgctatgtgcgtcgccatccatgccgtcctgtctctgtatgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcgggtactccttcagcaccactgctgaacgggaaattgtcagggacatgaaggggaaagctcgcctacattgccctg

SEQ ID NO: 7089 - DNA, 401 bp, Zea mays
  unsure at all n locations
  Clone ID: LIB148-037-Q1-E1-H10
gatttcacataaacttgcagaccttgagccttcaaggttgccaaagcttgcagagacttcctcggtccatcagggcattgctagagcttagatgcctttgtctctatggaacttcnctaagctatgtaccaaagggtgttggtaaattgaagcatctcaatcatctagatggtctaatcattggtcatgacaacaatgcgcctgagggttgtgacttagatgaccttaaagcattgtcagaactaaggcaccttcatataaagagtttggatanggctacttccggtgcgtctgcactcgcaaacaagccattcctagaggatctgtacctctctgagcaagcaccagcaatagaaaatcaggaggatctggangacaaagatgaaacagaaaaagaagag

SEQ ID NO: 7090 - DNA, 425 bp, Zea mays
  Clone ID: LIB148-037-Q1-E1-H11
acgcacgggtcgatgcacgcctctacaatgagtcgtcgacgtgcccgcgacggggcagggcagccggtgcagtcgcttgtgccccaccgtcgtgccgttggccacgggcgcgccgtccacgtacaccgcgtgccgctccacgcgctgccccagcgccacgtgctcctggatccgcaccacgttgaacgcccgcgcccgcgcgcccggccgccgccgcagctcgatccagtacccgttccggcgcccgtcctcggccgtcggcgcccagtacgtgtcgtcgcggccgtccatcacgttgcgcgccgcgaaccgggcgccgcgctcgctgctggccctggcctcgctgcccgcggcgaggtccgtgccgaagacggtggccacggcggccccgaactcgcgcagccgcgcgatgtcggcgtcctcga

SEQ ID NO: 7091 - DNA, 384 bp, Zea mays
  Clone ID: LIB148-037-Q1-E1-H12
ccaagccttcggttcatttccccccaaccggcaaggaaacccgggggcaaaaggaaggaaaatgggttccgcaaaaaaagctccccgggtggttttcaacccaaccgttggaagttccgtttgcacaaccaaaaagacaagagccaagaaagaagaatccgccggaacccctggtggttctgctggaggcagcggcgggacgttcgacatctccaagctcggcgcgaccagcgacggcaagacggactgcacaaaggcagtccaagacgcgtggacgtcagcgtgcgaagcgaccggaagcgccacggtggtgatccccaagggcgactacctggtcggccctctcaacttcactgggccatgcaagggcagcagcatcgccat

SEQ ID NO: 7092 - DNA, 426 bp, Zea mays
  unsure at all n locations
  Clone ID: LIB148-037-Q1-E1-H2
gaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagangaaaatattgcccacaac

SEQ ID NO: 7093 - DNA, 397 bp, Zea mays
  unsure at all n locations
  Clone ID: LIB148-037-Q1-E1-H3
tacatcgatccgcctcatcgtggccgccctctcggcgcgcgccgcggcgcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatcgcgtncacccagttccagaagtcggagcacgacgcggagatcaaccactcgctccccggggacgccttcgacgccgtggtgcgcgccaagctggccctggagctggagtgcccggggtggtgtcctgcgccgacatcctcgcgctggcgtcggggg

SEQ ID NO: 7094 - DNA, 429 bp, Zea mays
  unsure at all n locations
  Clone ID: LIB148-037-Q1-E1-H6
agaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacagaggaagtanggattgatttaatcattgatttaatcccacacg

SEQ ID NO: 7095 - DNA, 393 bp, Zea mays
  Clone ID: LIB148-037-Q1-E1-H7
gtgaagtcaccgccacctccagcaccagtgagctcaccaccacctccagtgaagtctcctccgccaccagcaccagttagctccccaccacccccaataaaatctcctcctccaccggcaccagttagctctcctccaccagcaccagtgaagccaccatcactaccaccaccggccccagtaagctcacctcctccggttgtcacccctgccccgccgaagaaagaagagcagtcattaccaccaccagcagaatcccaacctccaccatcattcaatgacatcatccttccacctatcatggccaacaagtacgcatctccgcctcgccctcagttccaagggtattaagcgccacagagacatggttgatgaagcatgaaaggaacagtc

SEQ ID NO: 7096 - DNA, 403 bp, Zea mays
  unsure at all n locations
  Clone ID: LIB148-037-Q1-E1-H8
gcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccactgccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcnacaactgaccggaccggccggcgttccccgt

SEQ ID NO: 7097 - DNA, 418 bp, Zea mays
  Clone ID: LIB148-037-Q1-E1-H9
taagataatccacacgaggacaaccttgtcaccaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaaggacgtcaatgtgacggcgcccggggacagccccaacacggacggcatccacatgggcgactcgtccggggtcaccatcaccaacaccgtcatcggcgtcggcgacgactgcatctccatcggccccgggacctccaaggtgaacatcaccggcgtgacctgcggccccggccacggcatcagcatcg

SEQ ID NO: 7098 - DNA, 423 bp, Zea mays
  Clone ID: LIB148-038-Q1-E1-A1
actcgcgggtcgacgcacgcctctgcacagagtcatctataccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggatgccgaggaagagacgaaggggagagagagtgacatggctgcgcgcattccgatgcgtgggcatgttttttgattcgacacacctttt

SEQ ID NO: 7099 - DNA, 430 bp, Zea mays
  Clone ID: LIB148-037-Q1-E1-G6
cggacgcgtgggcggacgcgtgggttcgtggatgccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagccgggtgcaggcccagcgcggggacactggtggtgacggcgaccgacctgtgcccgcccaacga

SEQ ID NO: 7100 - DNA, 310 bp, Zea mays
  unsure at all n locations
  Clone ID: LIB148-037-Q1-E1-E9
gtgaacgtgaagatgatcaccggcgacaagctggccatcggcaaggagacggcgcggcgcctgngcatgggcagcaacatgtacccgtccaccaccctgctgggcgacaacaagaccggcgagatgggcggcctgaacatcgacgagctgatcgagaaggccgacgggttcgcgggggtgttcccggagcacaagtacgagatcgtgaagcggctgcaggaccggaagcacatctgcggcatgaccggggacggcgtgaacgacgcgccggcgctgaagaaggcggacatcggcatcgcggtggacgacg

SEQ ID NO: 7101 - DNA, 383 bp, Zea mays
  Clone ID: LIB148-037-Q1-E1-F1
cccacgcgtccgcgtgcctagcatgcatgcatgtgacgacctctcctcctcgctgtctctctgtatctgcaactgcaagcaaggaaattaattaaaagaagatcggcgccatggcggcaacgacgacggggatgcagatgatgcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaagcgccgcc

SEQ ID NO: 7102 - DNA, 314 bp, Zea mays
  unsure at all n locations
  Clone ID: LIB148-037-Q1-E1-F10
gtgcaacaaaccctaagacccttgaggggaaagccccagctganggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaagaggaggaagttgtggagaagaccgtcatcgagaaggagaagccatc

SEQ ID NO: 7103 - DNA, 404 bp, Zea mays
  Clone ID: LIB148-037-Q1-E1-F11
cgggtcgaccaagcctccgaacaagcctccggccaaaaggaaaggaacttagaaatcctccaaatccttgattcaaataaaacaactcctcctccctcccctcaataacaacccaaacttgtaaccggcaggattctaacaaaaacttaattactttatggacggattggtaggcctcttgaaagtccgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgacccca

SEQ ID NO: 7104 - DNA, 172 bp, Zea mays
  Clone ID: LIB148-037-Q1-E1-F2
tacacacgcgtccgcccacgcgtccggcttgttagcacaaataaacagatcgatcgattacagcaatggcggccaaggtgttcctcctcctccgactcagcatggtcgccgtcgtcctggctgccatcgccacagtagtgctcgcggaggaagccgatccgcgggcactgcc

SEQ ID NO: 7105 - DNA, 322 bp, Zea mays
  Clone ID: LIB148-037-Q1-E1-F3
cccacacgtccgccgacgaagacgtggtgaaaccgcgccccgggaagctccggtggggcgtcatccaaattgaaccgctgtggattaccttcgccaagaccatgatcatcacgctcaaggaggagctcatcatccgcggcgacaagaccattgacggccgcggcgtgcaagtgcgcatcaacaatggcgcgcagctcacgttgcaattcgtcaacaacgtcatcatccacaacatccacatcaacgacatcgtctcctccaacaaggacggccgctacgtccgcgactcgccggaccacttcggctggcgcaccgtctccga

SEQ ID NO: 7106 - DNA, 418 bp, Zea mays
  unsure at all n locations
  Clone ID: LIB148-037-Q1-E1-F4
ctcaccccgccttcacgcctccctcaccaaataaggtcccgcccttttccgacattcacangggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcatagactgcga

SEQ ID NO: 7107 - DNA, 405 bp, Zea mays
  Clone ID: LIB148-037-Q1-E1-F5
ccggatcgcacaacaggaacatcagcagcagggaggacgccacctcaggagcggcagccacacggccgagatgcacgagtccctttccaatggagccggcggcaccccgccccttcccaacggtcgggcagcggctgccggggcggcgcggtcgcgcctgggccgcgacgggccgccctccgagctggacgtgatgaaggagaagttctccaagctcctgttaggcgaggacatgtccggcaccggcaagggcgtgccgtccgcgctcgcgctgtccaacgccatcaccaaccttgcggcgtccgtcttcggcgagcagcgcaagctggagcccatggcgcccgacaccaaggagcgctggaagagggaagtcggatggctgctctccgtcaccgacctcaacgt

SEQ ID NO: 7108 - DNA, 316 bp, Zea mays
  Clone ID: LIB148-037-Q1-E1-F6
agcgccatccgccgcagcaggtcacgcggcggtgtcgtcaggacggtcaaggacctcgccgacgaacgggcggccgtgctcgccgccagcagcaaggtctccgacgcggcgtctgcggtgccgccgctgcctcctggtgtcgagaccgccagcagcaacggtgcccgcggcggcagcgtggaggtggaggataagcagcggcggcgccacgacgactgccaccccgaggtcgttcccgagaagatcatacgggaggacgcgccgccagttgttgcggagaccgctgcggccccaccaccacggaggtggaggtgga

SEQ ID NO: 7109 - DNA, 399 bp, Zea mays
  Clone ID: LIB148-037-Q1-E1-F7
cccacacgttctgcgaacgcgtgggcggacgcgtgggcggacgcgtggggcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggggccgtcgtcgtccctgccgcggagcgccagcgagctacccgacccgccgtcaacgttcagctccaacacggcgcaccaccccgttctcgtgcccaccacacctaggttgtccttatcctgctc

SEQ ID NO: 7110 - DNA, 399 bp, Zea mays
  Clone ID: LIB148-037-Q1-E1-F8
attcaagcacctccacttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggttcgccacggccgccgagaccacgac

SEQ ID NO: 7111 - DNA, 303 bp, Zea mays
  Clone ID: LIB148-037-Q1-E1-F9
tgtgtttctcttgcatgaggatcatcatcctacatgggatcaccagctcctcttccacacgactcgccggggcgggatatacgaaaccatcaatattatcatccaggattcagtacatcacctgattccacatcatccgcagcttagattctaccctgcttttctgttcgcagctcaattccaatatcccaattgcatctcaattcaattcaatcaattctatcaatcgcatcctgccaggcatcatccctaccaactaggctcactacactttcactcagattcgcttttacttatccaacc

SEQ ID NO: 7112 - DNA, 408 bp, Zea mays
  unsure at all n locations
  Clone ID: LIB148-037-Q1-E1-G10
ctgctcgccggccaaaaatcgcctcatcaacaacccccccttcaaggctcccgtctcaatgggtctcctctcaaacaggattgggagggagagcctcaaggcgggggatcatatctactcctgnagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctaactgggggtgctctctaccgtttcgagtacgcagtcaacccggcgctcttcct

SEQ ID NO: 7113 - DNA, 175 bp, Zea mays
  Clone ID: LIB148-037-Q1-E1-G11
gaaatttccgcaagttcagcaccagaagcccaattccaagtggtaaaacctccaactccaagtcgtacccttcctaaaggtccaaccgggaacccatggcccggtcaaaaacttcaggtggaacaatcccaaaattcaacagttcaagggaccagcccgtaaacaagggggttaa

SEQ ID NO: 7114 - DNA, 398 bp, Zea mays
  Clone ID: LIB148-037-Q1-E1-G4
ggaccaggaacggcaccgtggtcagctacgaccgccgctcgctcatgatcgacggccaccgggaaatcttcttctccgggtccatccactacccgcggagcccgccggacatgtggccggagctcatcgccaaggccaaggagggcgggctcaacaccatcgagacctacgtgttctggaacatccacgagcccgagaagggtgagttcaacttcgaggggcagaacgacgtggtgaggttcttccagctgatccaggagcacgacatgtacgccatggtccggctcgggcccttcatccaggcagaatggaaccacggaggactgccctactggctaagggagatccctgacattgtgttccggacgaacaacgagccatacaagatgcacatggag

SEQ ID NO: 7115 - DNA, 402 bp, Zea mays
  unsure at all n locations
  Clone ID: LIB148-037-Q1-E1-G5
aaatcaagcacctccacctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggangangaagccgtggagaagaccgtcgtcgaggaagagaagccagcggcagccgccaatgcagaggacaaggtcgccaccgccgccgagaccacgacgac

SEQ ID NO: 7116 - DNA, 416 bp, Zea mays
  unsure at all n locations
  Clone ID: LIB148-037-Q1-E1-E7
cgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagcctcgggatggccttcaggttcgccgagatcgagtacgtcaccaaggtgaacgatctcatcggtgccggcaagtccgtacgcacgttgagcgacatcctcgacaaggacatccagaatgactgcgtgaagaagcagggaagccactcccggaacttacgcacggtccgtctcgggcntcggcctcattaaaggccctcttcgagc

SEQ ID NO: 7117 - DNA, 395 bp, Zea mays
  Clone ID: LIB148-064-Q1-E1-H2
ggccgaggcccgcgtccgaagcgaccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaag

SEQ ID NO: 7118 - DNA, 390 bp, Zea mays
  Clone ID: LIB148-064-Q1-E1-H4
gacgcacgaggccacgtggggacagcgagaggtgaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcctcg

SEQ ID NO: 7119 - DNA, 386 bp, Zea mays
  Clone ID: LIB148-064-Q1-E1-H5
cccgtccctcgccaccgccatggccgacgtcggcgagcctcctccctcgctctgccccttatgcggccaccccgctgccttctccgtttcaccgtcgacgtctgcggcggccagcgtgtcccccgcaaggccgctgctgaagcgaaggaccccacccgaggcgccacctgcggtcgtgagggtggagatcggggatgaggccgcggcgctgcgcgaggcattggcgcggcagcaagcggcgctcgccgacgtccaggcggagctcgacgcggagcgcggggccgcggccggcgccgccagcgaggccatgaccatgatcctccgcttgcagcgcgagaaggctgaggccatgatggaggcacgccagttccgccgctacgccgaag

SEQ ID NO: 7120 - DNA, 378 bp, Zea mays
  unsure at all n locations
  Clone ID: LIB148-064-Q1-E1-H6
acggaggccgggcccgtgctgtccatgtgcccggcgttcgccaaggagccggcgcccgccaagccggggtcgtgcggcacagtggtgcgcaacgcggagctcaaggtggtggacccggacacgggcctctccctcggccgcaacctccccggcgagatctgcatccggggcccgcagatcatgaaagggtacctgaacgacccggaggccaccgcgaggacgatcgacgtccacggctggctccacaccggcgacatcggctacgtcgacgacgacgacgaggtcttcatcgtcgaccgcgtcaaggagctcatcaagttcaagggcttccangtgccgccggccgagctcgaggctccggctcttcgccaacccgtc

SEQ ID NO: 7121 - DNA, 76 bp, Zea mays
  Clone ID: LIB148-064-Q1-E1-H8
gaggccgggcccgtgctgtccatgtgcccggcgttcgccaagccagcacatccaaataaaaccgagaattaaatag

SEQ ID NO: 7122 - DNA, 331 bp, Zea mays
  Clone ID: LIB148-064-Q1-E1-H9
cacacgcgtcaggcgaagcaacagaacgtgaactaaaaggtaagaaagaggacaggtttacgagagaacgaagttgaaagaacaaagtgtaacgcggcgtcatcatagatatccgaaaggactacagcaccaaatatacaccacagagtgtaagagaagtcgccgtccggacaaacgtgcacggtacgccacgagcaccgcaacccacttcagtgtcatatccctcatcagactgaacacgatcctgagtaccggttacggagcgagtccacgtccggcaagagacggggcccaacgattcggatttcttcaccgatctcctgaagagggt

SEQ ID NO: 7123 - DNA, 425 bp, Zea mays
  Clone ID: LIB148-065-Q1-E1-A10
cgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggaaccgggagcggaggggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttt

SEQ ID NO: 7124 - DNA, 332 bp, Zea mays
  Clone ID: LIB148-065-Q1-E1-A11
gagacttcctcgcctccatcccatcccgccgccgccgtctctacggtcgctaataagccgccgcatccagggatggagatgaagaagatcgcccgcgcggtcctcgtcgccgcctcggccaccgtggcgcgggccgcggaggcgccggctccgtctcccaccagcggctcctccgcggtcgcacccgccatcgtcggggccgccgtggcctccttcctcgcgtaccacagtcactgagcccccggccgaggagccggaaccggagggaagagaccaaggtggggggagagacttggctgcgcctgcgccgctccgcggctccgcgcattccc

SEQ ID NO: 7125 - DNA, 380 bp, Zea mays
  Clone ID: LIB148-065-Q1-E1-A12
actcaacttcccctgttcctcgaccacctcaacgagcttctgctccgacgacgatgacgcgccgccacagccacatggcggacgacgccgtcgccgccggagcggccgtttgctgcgcaaggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcccctgccgtcgcaggagctgctgcagccctgc

SEQ ID NO: 7126 - DNA, 90 bp, Zea mays
  unsure at all n locations
  Clone ID: LIB148-065-Q1-E1-A2
cgtcgggccacggcacgctgcgctggggcgtcatccancccggcccgctgtggatcatcttcgcgcggtccatgatcatgcagctctcgc

SEQ ID NO: 7127 - DNA, 206 bp, Zea mays
  unsure at all n locations
  Clone ID: LIB148-065-Q1-E1-A4
gcgtccggcttctactggaggatgctcaggtggcgccgatgctggcgctggcgctaccgtangtgctggtgtctctggaggcgctaaagttggtgcggggcgttgnacgaaacggcgggaagaagtggcaaggcgtatacaggaaccggtgccgatgcgggtgtttccggtggaaggatcggtggcgtcgatgctggtgtctccgg

SEQ ID NO: 7128 - DNA, 343 bp, Zea mays
  Clone ID: LIB148-065-Q1-E1-A5
gccaagttacgagcagcaagcagagatcagatcatccatcggcaatgtcgaacatcgggcagtccgtcgaggccggcaaggcggaggcccgaggcgagtaccaggcggagcacgcggcgcagtgcgtcaaggacaccgccggagccgcggccgacagcgcgcagctgcagcagcaccgcgccaccggcaccgttgagcaggtggcgcagacgggccaacgcgtggcggcaggcgtcaaggacacggtggcgggcgccgcggttggcgtgcacaacacggtcgcgggcgtgcgagcgggcgtcacgaacacggtgaccggcgcggtggcgggcgtcacgaacac

SEQ ID NO: 7129 - DNA, 196 bp, Zea mays
  Clone ID: LIB148-065-Q1-E1-A6
ccacgcgtccggatcgatgcacggaggaggatgctgccgctgctctggcctaatcactagtataaagcaggcggagacagcctggccgcctgaccgcagtgctcccccttcctccccgtccccaaccacatgccctgcctccgccccgccccgccctgcccaagctcgattccccagcccccaacaaacaattact

SEQ ID NO: 7130 - DNA, 387 bp, Zea mays
  Clone ID: LIB148-065-Q1-E1-B10
cgaaaaacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacatccccatcttcaaggacggcaagggctgcggctcatgctacgacgtgagatgcaacgataaacctgagtgctccggcaatccagtcacggtgtacatcactgacatgaac

SEQ ID NO: 7131 - DNA, 392 bp, Zea mays
  Clone ID: LIB148-065-Q1-E1-B11
ccggcggcctcgtggccatcgtcgtgtccgcgtcgttcaaggccaggttcccagccccggcctacgccgtcgaccccgccgggtccacgccgccgcaggccgacttcgtgtggcggatcatcctgatgctgggcgcgatgcccgcggcgctcacctactactggcgcaccaagatgcccgagacggcgcggtacacggcgctggttgccaagaacgccaagcaggccgcggctgacatgtccaaggtgctgcaggtggagatctcagccggcgccgccgaggaggacgccgcggctgcgactgcgactgagcctgcgccggcgtcctttgggctcttctccggggagttcctccgccggcacgggctgcacctcctgggcacgtcctcgacg

SEQ ID NO: 7132 - DNA, 390 bp, Zea mays
  Clone ID: LIB148-065-Q1-E1-B12
cggaagcgtggcggacgcgtgggttcacgcctccctcaccagataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccattgacggggtgaccgacgggaacggcacgtacacgatcgagctcaaggacagccacgacgaggacatct

SEQ ID NO: 7133 - DNA, 448 bp, Zea mays
  unsure at all n locations
  Clone ID: LIB148-064-Q1-E1-H10
ccacgcgtccggacnatcacaatagcaaaaaccaacatccgtcgtcgccaaacgttacaaggggccaagggcattaacaacggccaacaataatggggcaaaacattagggattttgcccctgggccttggtgggccttgctgggtggttgccgcagcggcgcccgtggccaccgcgtacggctgctacgacgactgctacgagcgctgcgccaaagggaaagaaagaccccgcctgcaccaagatgtgcaaccaggcgtgcggctccacggaccaaggcgccggtgccgccggcgccgcgccggcttgatcgcccagcgcattcatcgcttcagctcgatataatcgctgctccgttagcaacccacatatgattcgattaatcttcctcctctaatttctcgaccccgtcgaatttttttcctttcgattcctctactaaactact

SEQ ID NO: 7134 - DNA, 397 bp, Zea mays
  Clone ID: LIB148-064-Q1-E1-F4
aatcccatccgtgtcccggagcccagggagcggaggcgggcgggccggcgggcggccatggacgtggactgcgtctcgctgcccgacgccccggcgggcgacgtggatggcggcgccgcccggccgtggcccaaggccgtcaccaacggcggcgtccacgagctgctggagtgccccgtgtgcaccaactccatgttcccgccgatccaccagtgccccaatggacacacgctgtgttccacatgcaaggccagagtacacaaccgttgccctacctgcaggcaagagctgggcgacatcaggtgcctggcgctggagaaagtcgccgagtcgctggagctcccctgcaggtactactcgctggggtgcccggagatcatgccgtactacagcaaga

SEQ ID NO: 7135 - DNA, 380 bp, Zea mays
  Clone ID: LIB148-064-Q1-E1-F5
aagaccgttgaactgaacaaaccacagattgagcagctcatattttggtgtcagtattggattttagttgccctgttgacagttttggagagatttggagattttacaatatcatggctaccgttttactcagaagcaaaggtgttgttctttgtatatttgtggtaccctaagacaaagggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacgttttaaaatatgttgctgcccagtccccttctcggaaatc

SEQ ID NO: 7136 - DNA, 350 bp, Zea mays
  Clone ID: LIB148-064-Q1-E1-F7
acgaggctcaaatgcctagccctagtaagggcggcggtgactggccgctgctcagggacatgatcgccgataaccaccggctcatcgtgttcacatccaagaaagggaagcaggggacggaggggctcgcgtaccagtgggactacgtcgtggaaacccaatacgggagcgagggcatggcggatggcagttgcccaaagcggaccgagtcgaagcccatggactctaaggcccagtcactagtgctgctgaacttcttcaccagcaacccgagccaaagctgggcctgcagcaacatctccgcgccgctcatcagcatgcttaacgcctgctaccacgcctccgccaaa

SEQ ID NO: 7137 - DNA, 394 bp, Zea mays
  Clone ID: LIB148-064-Q1-E1-F8
actctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcc

SEQ ID NO: 7138 - DNA, 409 bp, Zea mays
  Clone ID: LIB148-064-Q1-E1-G1
agctaccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctgcgggcaaccaaca

SEQ ID NO: 7139 - DNA, 297 bp, Zea mays
  Clone ID: LIB148-064-Q1-E1-G10
cgcgggattaccatcaccaacaccgtcattggcgtcggcgacaacttcatctccatcggccccgggatctccaaggtgagcttcaccgacgtgacctgcggccctggccacggcatcagcatccgatgcttagggttgttcagggacaatcaggacttcagggcaagtagcatgcaggattgacttctgttaaaacaatcttctggcttcgtctattggcattagacgtatgcgtcgcctttcacaagttcacgttgatccagtacgacatttgcacttgttacgtttgacccacgc

SEQ ID NO: 7140 - DNA, 443 bp, Zea mays
  unsure at all n locations
  Clone ID: LIB148-064-Q1-E1-G12
tgtaccggtcatgntccgggtccacccagcgtccgaaaaaaggaaccaagagagaaaaagacgccaggccgcccggcaacattcaagaaggaaggaaccccaaaaacccggcggcggcaacaatggctccgcgcacctcatcggcggcaacttgcctgtgcctcgctctcgccgcggccacgctggcgctggcccacggggcccaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacaggatcatcccggggttc

SEQ ID NO: 7141 - DNA, 382 bp, Zea mays
  unsure at all n locations
  Clone ID: LIB148-064-Q1-E1-G2
accctatctcccttcgtcaccatcacatccagccagccaacaaaaatgtcgcgcgtcacagctgcggtgctcttctacatcctcgccgttgctgccctcaacgcggccgaagccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctganggaccggctgctgatgactccg

SEQ ID NO: 7142 - DNA, 385 bp, Zea mays
  Clone ID: LIB148-064-Q1-E1-G3
aacgcagccgctgccgctgccgctgctgccgtgccaagtcgccgggcaagctccggatcggggggcgcgcgcgcggggccgccgccgccgccattatattgggttagttaggccagcttgtcattgcatcggagagatgtatccggccactacgccctacgatacggcgtccggggtgggcgtggcgccggtggccggcttgttccccgtcgccggagaggccagggagtggtcgtcgaggctcctggactgcttcgacgacttcgacatctgctgcatgacgttttggtgcccgtgcatcacgttcgggcggacggccgagatcgtgggacaccgcatgacgtcgtgcgggactagcgcagcgctgttcgcgctgatccagtgg

SEQ ID NO: 7143 - DNA, 421 bp, Zea mays
  Clone ID: LIB148-064-Q1-E1-G4
gcacgcgtccgaaagtacgtcgatggcgacggtgacattgtggcagtggacgtcaaggagaagggctctgacacgtacgagcccctaaagcactcctggggcgccatctggaggaaggacagcgacaaaccgcttaagggacccctcaccgtccgcctcactaccgagggaggcaccaagtccgtctacgacgatgtcatccctgccaactggaaggccaacaccgcctacaccgccaaataattaactttagtgctgacaatactttaagccggcctatgctagctatactagaattggttggatcccaagcaatgcattacacatgcatgcattggaccgtgatatctatttgctaccactaccctattacgacagtgatgctggcgccaacaatgatggtgtcatcctcccttctcca

SEQ ID NO: 7144 - DNA, 382 bp, Zea mays
  Clone ID: LIB148-064-Q1-E1-G5
acccacgcgtccgcccacgcgtccgggttaagagcctcaaaggaggtaaggagatgaggatggatgttcttctgatggaaaatcttttgtttgagcgcgatgtgacaacattgtatgatttaaagggctctgccagatcaagatataacccagactcaaatggtagcgataaagtacttcttgatcagaacttaattgaagcgatgcctacatcacctatatttgtcggaaacaaggcaaagaggctgctggagagagctgtttggaatgacacgtcctttcttgcttccatcgatgtaatggattactctttacttgttggtgttgatgagaaaaggcatgaacttgtaatgggtattatagatttcataaggcaatatac

SEQ ID NO: 7145 - DNA, 380 bp, Zea mays
  Clone ID: LIB148-064-Q1-E1-G6
ggagctcgccgaggcgtcggcgagggaggcgtacaggcccgacccgtacaacgtcaccaacagcttcaacgccgccgtccacagagctgtcagcagcagtcggcgtgagatgcgggagaggccgaggaagcacaagaagaggggcccatgccgggcgacgaaccctatcgacaagtgctggcgctgccgcagggactgggcgacggaccggcagcgcctggcccgttgcgccagaggcttcgggcacgcgaacaccggcggccttggcggcaagatctacgtggtgaccgaccccaccgacctcgacgtggtgaacccgcgccccggcacgctgcgctggggcgtcatccagcccggcccgctgtggatcatcttcgcgc

SEQ ID NO: 7146 - DNA, 186 bp, Zea mays
  Clone ID: LIB148-064-Q1-E1-G7
aggagctcgtcgaggcgttggtcagggaggcgtacatgcgcgacccgtacgacgtcacgaagaacttcaacgccgctgtccatagatctgtcatcatcaatccgcgtgagaggtcggagaggccggggaatcactttggaggggggccaatgcttggctacgagccctagcaacatgtgttggcga

SEQ ID NO: 7147 - DNA, 407 bp, Zea mays
  Clone ID: LIB148-064-Q1-E1-G9
cacacgcgtcaaatcgtcttgggggaaaacacatgatagacctaaagaaagctcaggcctgcgcataggacttttcgaatctcgaagggcctagccacgaaagccatcagggcctagaggagtctcgcacaggtttcgattgaactccgctacgaggggcgttacaacgcaacgagagcagtctggagagcatgggcattgggctttgacggagagaggatggtcaagtccttcatgaccaagggcaacgtcgttgtcgtatgtgacaacttcataggcccttgcaagggcgacgtgaccatccaggtggatggcaatctgctggcgaccacggacctaagccactacaaggaacatggtaattggatcgagattctacgcgtggataacctggtcatcagcggcaa

SEQ ID NO: 7148 - DNA, 388 bp, Zea mays
  unsure at all n locations
  Clone ID: LIB148-064-Q1-E1-H1
aanaaacganagatgactgtcgtgagcaacaagttgtcattaatgcaagttcaagttctggtggccgttggaacatcatttctaataaggggtgcctgntgttgtcctcccaaggtttccccangaaagaacatcacaagcaactatggcagtgattggctaaatgccaaggcaacatggtatggcaagcctacaggtgccggccccgacgacaatggtggcggatgtgggtacaaggacgtgaacaaggcccctttcaacagcatgggcgcatgtggcaacgtccccatcttcaaggatggtctgggttgtggatcctgcttcgagatcaagtgcgacaagccagcggagtgctctggcaagcccgtggtggtatacattacagaca

SEQ ID NO: 7149 - DNA, 328 bp, Zea mays
  Clone ID: LIB148-064-Q1-E1-F11
attccgggcagacacacgcgtccagaacggttgccaaattttggcgcgtatccactaatgcacagcattttaggattgcgttgacttctgtgcaccatcgcacgagacatatttatattgtacgttgagtataagacatctgggactcatcattcatcccaaacttcggtcgatggaagtcgaaacgtcttatcgttcaatatgagtataggggtttgacagcagtctgttgcatgagtacttcgtgttgataagtctctacatacgtacgtgcatgtattaggacaaaccagtggaacagtaagtttacgatgtccaggtgaccgtt

SEQ ID NO: 7150 - DNA, 340 bp, Zea mays
  Clone ID: LIB148-064-Q1-E1-D3
acgagatccagaacgtcgacaacctgtccatcaacggccacggcaccatcgacgggcagggagccctggtgtggaacaagaacgagtgccagcgttcctacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactg

SEQ ID NO: 7151 - DNA, 378 bp, Zea mays
  Clone ID: LIB148-064-Q1-E1-D4
aggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacg

SEQ ID NO: 7152 - DNA, 416 bp, Zea mays
  Clone ID: LIB148-064-Q1-E1-D5
agacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatccacaagtgcaaggacatgctgatccaggacgtaaatttgacggcccccggggaacgtccccacacggac

SEQ ID NO: 7153 - DNA, 393 bp, Zea mays
  unsure at all n locations
  Clone ID: LIB148-064-Q1-E1-D6
agcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttaanaaaaa

SEQ ID NO: 7154 - DNA, 360 bp, Zea mays
  Clone ID: LIB148-064-Q1-E1-D7
aaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgacgagctaactctgaccgtcacagatcccagcctagctctgaagctggaggtgttcgacaaggacacgttcagcagggacgaacccattggggacgcgg

SEQ ID NO: 7155 - DNA, 63 bp, Zea mays
  Clone ID: LIB148-064-Q1-E1-D8
tctttatcacgccagatgccatcgcccaagaccccgctacctgggatcactcccctgcggacc

SEQ ID NO: 7156 - DNA, 223 bp, Zea mays
  Clone ID: LIB148-064-Q1-E1-D9
cacatgcaagtaggtaaagcgaacgggtgagtaaagaggtgtgaaagagtggaagaacatgaatgcacagaagaatgtaagaaatggttagagtaacaaccatgaaggaagtaaaaccgggaatctgagaggaggaaagccagagtggaactgagaaaaggtccacacacgagaagtcaccaatggggacaattgggccatgtacacggaagtatgacccaat

SEQ ID NO: 7157 - DNA, 254 bp, Zea mays
  Clone ID: LIB148-064-Q1-E1-E1
aggcaatggcttgcctggtctgatgatgaccttccttttgcatgcatgcatggtatctcatccttgatgatgatctagctcactagttctttttaatttccgcttcattcgcttttccaaattcgattgtgtttcagccaagttgtttagcgggacatctcttgtctgatcttcctgctaaatagagttggactcctatatatagaggccttccggcacatataatatacgtcggaccaatattattgtgatca

SEQ ID NO: 7158 - DNA, 380 bp, Zea mays
  Clone ID: LIB148-064-Q1-E1-E10
acgcgtcaacacacgcgtccgaatcctcgtgcacaactttcttcttctagccctttgcgcatatcttgctgtttttggtttactgaacatgcaaaataccatcgacgaattttccctatcaggcgatctttccacactaaaagttgcagcagaggattggtcagacacgtatatcggggactttactagagagggcgtcaaggacagctttcgacacttatttttgttacacaactcgccaggccatgaccagtttttgactaacgacacctcaatatctggctcatctatagaacctcactaagtgcctgagtggtttccttttcacgatacttcttcggatatcactgtcagttcggtcaatttcaccagctcccgtg

SEQ ID NO: 7159 - DNA, 385 bp, Zea mays
  Clone ID: LIB148-064-Q1-E1-E11
cacgcgtccacacaaggcaaactattttctgggcgcttcgagttagtttgtatttgatggttttcatagttactagaattggaagtttgatcaaccgcttttatcagttgacgcatcagggatattcaccctttggtctcatggtgctccatgcagttacgcagagtttgcaaggttttctatttggacttatttatatttaccacgaaagagcactaggggaagttgttctattcattcgtcgcaagtggagtcgcagaggggatttgcgcgaggattcttttatcgcattagagaaaagaggacttgctcatttttcacaatttgatgaagacgaggaccacgaggacaacatggattcgcagagtagttcccttgcattttg

SEQ ID NO: 7160 - DNA, 370 bp, Zea mays
  Clone ID: LIB148-064-Q1-E1-E2
acgcgtccaagggaacgcttacatggtctgatcatgacctacattttgcatgcatccatggtatctcatccttgatgatgatctatctcactagttctttttaatttccgcttcatgggcgtttccaaattcgattgtgtttcatccgggtgtgtttagcgggacatctcttgtctgatcttcctgctaaatacaattggactcctatatatagaggccttccggcacatataatatacatcggaccaacattattgtgatcactaattatgtctctatatgttgccacggggataaaaaattttttttttttataaatactgaacgacacacatcaccatgatatataaaatttacctggcaaacatta

SEQ ID NO: 7161 - DNA, 372 bp, Zea mays
  Clone ID: LIB148-064-Q1-E1-E3
actgcaccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttctttgttccctctttctccttaatttaacgaattgatgcatgccgctgatgttcttccccctgagagagggattaacacttgtatcatcgc

SEQ ID NO: 7162 - DNA, 195 bp, Zea mays
  Clone ID: LIB148-064-Q1-E1-E5
acttacagtccatcctctctttcttttcccctttctcaaagagctaggaccttgctcgactgagcatcaggctgtagggctctttgtgatcatcttttgccagttttcttcttgtagcagaagttgttgggcatggaactcctgttcctttcaccaatagaagcataatgatcagcactgtgaaacattttttcc

SEQ ID NO: 7163 - DNA, 376 bp, Zea mays
  Clone ID: LIB148-064-Q1-E1-E6
agtaccattatggctggttcgtggatggcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcg

SEQ ID NO: 7164 - DNA, 383 bp, Zea mays
  Clone ID: LIB148-064-Q1-E1-E7
agccgggagaatgggaatccagctcagatttcgcttctctccctccgccgtggtgagcccccgcgggcgacgtgtgtcccgttgcctttccttcgcttcgacggccaggccacctgttggcctcgcatggctctgcctcctgccaagcatccaagctccctctcgcccggcggcccagcgccgcggcgtctatatagagccagatccgcgcgatccccgccaatcggcaatcgctgcaccctgcctcaacttatctagctcacccgcatccctgctcggcactgccttgtgccttctcctcgcacttgccttcttcttgtatctagccccccttcatcacaatcaccggcagcggcgcgccgtcgtctcaggtgagagctcca

SEQ ID NO: 7165 - DNA, 281 bp, Zea mays
  Clone ID: LIB148-064-Q1-E1-E8
cccacgagtccagccgggataatgggaatccatctcagatttcacttctgtccccccgccgtggtgagcaaccgcgggcgacgtgtgtcccgttgcctttccttcgcttcgacggcgagggcacctgttggcctcgcatggctctggcgggggccaagcatcgaagctccatctcgcccggctgcccagcgccgcagcgtctattcaaacccagatccgcgcgatccccgccaatcggcaatccctgcaccttgcctcaccttatctagctcagctgcatc

SEQ ID NO: 7166 - DNA, 340 bp, Zea mays
  Clone ID: LIB148-064-Q1-E1-E9
cacgcctccacggattcgtgggaaactgccgggagacagacggtcacaccgcgacaggaagggagtcaacggaacagccgtgggagaagaccatcctgaatcgcctcccgcccacggatctggcgtctctggtcagccctctccctctccttcccggggccattgccggtgcctcgcccgggccgctcgtgctctacaaacgactacgatgcgcggctgcgggagctgcagcggcatcgccactggtacttgatgagcaccgcgggtgcaggtccggaggaccccgcctacttgcacttgtcggtggcggcgggggatctttttatcgacgacccacagc

SEQ ID NO: 7167 - DNA, 390 bp, Zea mays
  Clone ID: LIB148-064-Q1-E1-F1
aaccgaccagccagcgaggaatcctgatttggagcactggacgggacgcgttgccattagctgtcgcgtcagttacgttttgcttgccctgttctcgttcggccttgacaacccggaaatcctccagccctctagtccccaacgacgcaggaagcaggatcgagccgaatcctccggaactcgccgccggggccaaccgacctcacactattgatcgaggatgtcgtacgcctacctcttcaagtacatcatcatcggcgacacaggcgtggggaagtcatgcctgctgctgcagttcacggataagcgcttccagcccgtgcacgatctcaccatcggcgttgaatttggcgcccgcatgatcaccatcgacaacaagcccatcaaact

SEQ ID NO: 7168 - DNA, 365 bp, Zea mays
  Clone ID: LIB148-064-Q1-E1-F10
tcgcaaataagccgccgcatcaagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcctgggcgtgccctgattgggcacggccgtggcagtggcacaccttcgtcttccttttgtttgttttttttcctt

SEQ ID NO: 7169 - DNA, 369 bp, Zea mays
  Clone ID: LIB148-064-Q1-E1-D2
aggcacgtgcgtgcgtgcgtacgtacgcagcccagggacaccgaccgccgccgccgcccgcagctcctcctcctcctccgaccctctcatcaaccgcacgtacacgtcctcgctccatggcgggcatgcccacggaaagcgcgacccggcgcttcgccgccgcgtgcggcgtgctcagccagtacgtccggacgaccggcgcgcccgcgatgacgccgccgccgccgttcctgaagccaccagccgccgcccaggagacgacggtcgcgccgcgcacgcagcagctgaccatcttctacggctggagggtggtggtgctggacgcctgcccggccgacaaggcggacgagctgatccgcctcgccgcct

SEQ ID NO: 7170 - DNA, 395 bp, Zea mays
  unsure at all n locations
  Clone ID: LIB148-037-Q1-E1-D2
aggtgagcgcccgcgactcggtgaagctgacgggcgggcccgagtacgcggtgcccctggggcggcgcgactcgctcgtgtccaaccgcgaggacgccgacaacctgccgggcccggacatcgcggtgcccaagctcatcgacgagttcgacaagcagggcttcaacgtcgaggagatggtcgcgatgctgggcggcggccacagcatcggcgtccgcaagtgcttccttcatcgagaccgacgcggcgcccatcgaccccaagtacaagaagacgatcagcgacgcgtgcgacggcaaggactcgggctccgtcnccatggactccacctcgcccaacgacctggacgggagctacttcggcctggtgctggagaaaaaaatgccgctcaacat

SEQ ID NO: 7171 - DNA, 395 bp, Zea mays
  unsure at all n locations
  Clone ID: LIB148-037-Q1-E1-D4
gcgccgtgatcgcgaacatggagacgtgcgtcgacgggttccccgatgacgagttcaaggccaaggtgaaggagtcgttcaacgatgggaaggagctcactagcaacgccctggcgctcatcgagaaggggtcatcgctcctctctgtgctaaagggcggctcgaaacgacggttgctcgaggaggagggagaaccggcgcaagccgggcctgcactcgacaaggacggcatcccggagtgggtgcccgacggtgagcggagggtgctcaaaggcggcggcttcaagagcacactcacgccaaatgtggtggtggcgaaggacggcagcggcaagttcaagnacatcaacgaggcgctcgccgccatgccaaagacctacgacggnagatacgtg

SEQ ID NO: 7172 - DNA, 410 bp, Zea mays
  Clone ID: LIB148-037-Q1-E1-D5
cggacgcgtgggtgcgtggagatgcgcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccacggccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccgga

SEQ ID NO: 7173 - DNA, 406 bp, Zea mays
  Clone ID: LIB148-037-Q1-E1-D6
ataataatgaaaggtcccgcccttttcctccgagatccacaacgggggaggggaaaacacgtacattcacccggcggcaataatggcctcggttccggctccggcgacgacgaccgccgccgtcatcctatgcctatgcgtcgtcctcgcctgtgccgcggctgactacccgaatctctccgactacgtcatccatagccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctatacgatcgagctcaatgacagccacgaggaggacatctgccaggtggtgctggtgggc

SEQ ID NO: 7174 - DNA, 383 bp, Zea mays
  Clone ID: LIB148-037-Q1-E1-D7
agggtgtcagaccgtaactgacagctatttagcaataatacatacatagctataccctctttaggtcaagagggtggagttctccttattcggaggaagagctccatcctcattctacaataccaaaccaataaatggcctctagcccacagtcctcgccatcatcctccaagaagtcgtcgacaccacaagaagcatcggctttggcgccaaaatcatcttcaaagtcatcctcgccaccaaagggtgagtcaaattcttctcccattcctccatcgaaatcgtccctgtcaccagcgccagtaccagagaaaagtggtagtacgtctatctctaaagatgggaacacgaagaagtcgtcctcatcggcgtcctcggcagat

SEQ ID NO: 7175 - DNA, 411 bp, Zea mays
  unsure at all n locations
  Clone ID: LIB148-037-Q1-E1-D8
cccacgcgtccgctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgaactcanggacaaccacgaggaggacatctg

SEQ ID NO: 7176 - DNA, 395 bp, Zea mays
  Clone ID: LIB148-037-Q1-E1-D9
ggcgaaggacggcagcggcaagttcaagaccatcaacgaggcgctcgccgccatgccaaagacctacgacggaagatacgtgatccaagtgaaggagggagtgtacgaggagtacgtgaccatcaccaagactatgaagaacgtgaccttcttaggtgacggctccaagaagtccatcgtcaccggcaagaagagcttcgccgacgggatcacgactttcaagactgcaaccttcactgcgcaaggcgacggattcatggcgatcgggatggggttccaaaacacggccggcgcggagaagcaccaggcggtggcgctgctggtgcagtcggacaagtccatcttcctcaactgcaagatggacgggttccaggacacgctgtacgcgcactcca

SEQ ID NO: 7177 - DNA, 399 bp, Zea mays
  Clone ID: LIB148-037-Q1-E1-E1
ggctgcccgctgggctcgccatcgccatcgcctccgcgccgggaaccgcggacgggcgaggtcggactgggcggctggggtgtgggcgatcaatcatgcgctcgcccctcccaccgcgcacatgcgttcgccggggagccggggctactcggcgcggcacgcacgcaggcaactttttggtggcgaccaccacgtcgcgctcgctacctcgaccagtacgtgcccactcttgccctgctgcaccgaccactgcggctttgggagaacaacgaaggggggtcactttggggccggatcagagaccacacaagttcattgtaggcaatgtccacgcgggccatcgagtactacgaactacgtacgtacggtaacggtgcacggcgcgaataactgggagac

SEQ ID NO: 7178 - DNA, 428 bp, Zea mays
  Clone ID: LIB148-037-Q1-E1-E10
aggacacttgggcggacgcgtgggttcggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctga

SEQ ID NO: 7179 - DNA, 423 bp, Zea mays
  Clone ID: LIB148-037-Q1-E1-E12
gcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctcgaccccgtcgaatttttttcctttctattcttctactatactactatta

SEQ ID NO: 7180 - DNA, 383 bp, Zea mays
  Clone ID: LIB148-037-Q1-E1-E2
caatccttgcacccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaagagttgagccct

SEQ ID NO: 7181 - DNA, 362 bp, Zea mays
  unsure at all n locations
  Clone ID: LIB148-037-Q1-E1-E3
ccccaagattggattcccccccaaaaacaacaagggccttggcccccttctttccgggctcgtcccccgccggtccttccggccccccaaaggtgcaacccggcccaacaacacaacaactacaacggaaatggtcaacgctagggcaccttgtacggtcagcccaaacggtgccggcgctcctgacaacggcggtgcgtgcgggatcaagaacgtgaacctgccaccctacagcggcatgacggcgtgcggcaacgtcnccatcttcaaggacggcaagggctgcggctcatgctacgaagtgagatgcaaggaaaaacctgagtgctcgggcaatccagtcacngtgtacatcactgaca

SEQ ID NO: 7182 - DNA, 398 bp, Zea mays
  Clone ID: LIB148-037-Q1-E1-E4
gcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctcgaccccgtcgaatttttttccttt

SEQ ID NO: 7183 - DNA, 421 bp, Zea mays
  unsure at all n locations
  Clone ID: LIB148-037-Q1-E1-E5
cggctctagaccttggtcaacgaagtgcgcaacctcgggagcaccaaatgggatgaccatgaaatggccaaagttattctaagatcactcattttttgcaatcctacgcaagttcaattaattcgtggtgatcctagatataagctaatgtctcccgaggaggttataggaaagtttgtgagctttgaattgatgatcaaaggctccaaacaaatcatcaacttggagcaaggcggcacctccacacccgaggtgcaacccgtcgcattcaaaggcaacagaggaaaagaaagaatagtctcaatcaagtaggctttccatcgacgcctccaagctcgacaacgaggaaatggcactcatcatcaagagcttccgccaaatcctcaagcanaggagagggaaggagtacaaaccccgctcc

SEQ ID NO: 7184 - DNA, 373 bp, Zea mays
  Clone ID: LIB148-037-Q1-E1-E6
gcttcgtcaacgtcggctgccgccgtgcgccggcgctggcggtcgggtggtggtcgcggcgccgggtgctggcgggatcggaagatctccatcccagcctcgcggtcctagcgcttgagcttgcccgcaaggccggcgccggcgccggcgccacagggctgcgcgcagatctcacgtgcggcgccggtccgtgcctccccacctgatctcctcccccccatcctacgcgccgggcgcccgcgctggtcgtccacacgctgctccgctgtcgcgtaacgcgcatctttggacagcccagacactccgccttcgtttggcagcagccaagcaaagcaagatcccctcttcctccactttctatttgtccgcagtg

SEQ ID NO: 7185 - DNA, 412 bp, Zea mays
  unsure at all n locations
  Clone ID: LIB148-037-Q1-E1-D12
cccacgcttccgcgcaggcgggtggtcggcgtctcactatcaacaaccgcgccgctccggttaaatttctcctcaaccggcaagcgcaattctgtgcctcaatcaattcggtcgtaaggcaattgagcaagcaatatatatatatatatatatatatatataggagattcttcgagcgagctagtagcgagatgggttccgccgtcctcttttactgcatctgcatcgccgccgtcgtcgcattgtcgtcgtccatggtcgccgtcgggtccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgnacacacgcg

SEQ ID NO: 7186 - DNA, 204 bp, Zea mays
  Clone ID: LIB148-037-Q1-E1-B3
gcgatccgtatgtcgtcctacgacttggcaagaagaaacttaagacgagcgtgaagaagagatctgtgaaccccatctggcacgaggagctaactctgaccgtcacagatcccagcctagctctgaaactggaggtgttccacaaggacacgttcagcagggacgaaccgatgggggacgcggagatcgacgtggcgccgctgg

SEQ ID NO: 7187 - DNA, 428 bp, Zea mays
  unsure at all n locations
  Clone ID: LIB148-037-Q1-E1-B4
tacacacacttctgccacgcgtccggacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangangcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaagggacatggtaattggatcgagaatctacgcgtggataacctggtcatca

SEQ ID NO: 7188 - DNA, 418 bp, Zea mays
  unsure at all n locations
  Clone ID: LIB148-037-Q1-E1-B5
cccacgcgtccggccaggaacgccgaggaggctgctctggcagtggccgagatggagaaggccaagtgccgcgcggccatggaggccgccgaggcggcgcagaggctggctgacctggaggcgcagcggcgccgcaacgccgaggtgcgcgcgcgccgggaggccgacgagaaggtgcgcgctctggatgccatttccaaccacgacttccggtaccgcaagtaccacatcgacgagatcgagatggccacggagcgcttctccgacgagctcaaaatcggcgagggcggctacggccccgtctaccgcgcctccctcgaccacacccccgtcgccatcaaggtgctccggcccgacgcgcaccaggggaggaagcagttcctgcangaggtggaggtgctcagctgcaatccgcacc

SEQ ID NO: 7189 - DNA, 416 bp, Zea mays
  Clone ID: LIB148-037-Q1-E1-B7
ccttcattcaacgacatcatccttccacctatcatggccaacaaatacgcatctccgcctcctcctctattccaaggatattaagctctatggagagatggtcgaccaagaatgaattgaacaacaatatataaggtcgcatgcgcaaccaaacagctacatgtacattgcaggcgtgtgtgaaattgtttatttattttttgcatgtgcacgcgtgagtatttgcttctccgtacatactctatgtatgaacgtgtgcatgtgtgaactaactacatgagacgacaaggtgcaagagacatgtctggggcgtcatttgtatggctttaattttttttattatatatagataaggaaatattttccttaaaaatggagtacaagggattgttgagaactgcttttggtcatgatat

SEQ ID NO: 7190 - DNA, 435 bp, Zea mays
  Clone ID: LIB148-037-Q1-E1-B9
gacgcgtattacgcttccgggctggttcgtggatgccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtggccgcccaacgaacaac

SEQ ID NO: 7191 - DNA, 283 bp, Zea mays
  unsure at all n locations
  Clone ID: LIB148-037-Q1-E1-C1
gcttcagccgcagcttctacgaggactgccgcatcgagtcggtggtcaaggaggtggcggtgctgacggcgcagcagcgttccaagtccatcgagggcgccatcgacaccggcttctcgttcaagaactgcagcatcggcggcgtcaagggcggccagatctacctgngccgcgcctggggggactcctcccgggtcgtctactcgtacacgaagatgggggaagaggtggtccccgtgggctgggacggctggcagatcgccaagcgggagagcagcggcat

SEQ ID NO: 7192 - DNA, 419 bp, Zea mays
  Clone ID: LIB148-037-Q1-E1-C10
accacgcgtccgcgacaccatccacatcgacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcgggcatgtggagcgtccgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgaccgatcgcgcacggtgctgtacacaactaaaggagagcgagaggggacttttt

SEQ ID NO: 7193 - DNA, 401 bp, Zea mays
  Clone ID: LIB148-037-Q1-E1-C11
gccaaccacgcctccggccaagcctccgcaactaacttaccaatggtggaaccttggcaatggtcacactcctccccggctgccgtcccggtcttggccgcccggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccat

SEQ ID NO: 7194 - DNA, 422 bp, Zea mays
  Clone ID: LIB148-037-Q1-E1-C12
cggacgcgtgggcgaataacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcaaggaaaaacctgagtgctcgggcaatccagtcacggtgtacatcactgacatgaactacgagcctatcgctccctacac

SEQ ID NO: 7195 - DNA, 419 bp, Zea mays
  Clone ID: LIB148-037-Q1-E1-C2
agatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgaacgctgcgccaacggcaagaaagaccccgcctgcaccaagatgtgcaaccaggcgtgcggctccacggaccaaggcgccggtgccgccggcgccgcgccggcttgatcgcccagcgcattcatcgcttcagctcgatataatcgctgctccgtcagcaacccacatatgattcgatcaatcctcctcctctaatttctcgaccccgtcgaattttt

SEQ ID NO: 7196 - DNA, 285 bp, Zea mays
  Clone ID: LIB148-037-Q1-E1-C4
ggcggggatgtgcggcatgccgccctgctcgttgttctcagatgcagcatgcgtgcactacgtgcggttggctggcatttgcatcgctgcgcacttgcctctgggaacttgcattaccggggcgtacattgaggcgctgggcatctttcggatgcgtgcctatcggtacaaactctgatgttcactccggacgattcgttcgacgcagttgagttcctgcgtcgcgactctcgctctctacgctaatcacgtggctgacatgggaagacacatcgacgcctccac

SEQ ID NO: 7197 - DNA, 414 bp, Zea mays
  Clone ID: LIB148-037-Q1-E1-C6
gcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccggccaacgaacagcagtccgcggacagc

SEQ ID NO: 7198 - DNA, 421 bp, Zea mays
  Clone ID: LIB148-037-Q1-E1-C7
gtgggatcgagttgtttcactgcacgagcacatcctccggcgaccaccggcctccctctccgtcctctagcgaccgaccaacgcgtcgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaacggatccgggggcatcactgtgaagaaaacagggcagtcactcatcattggcatctacgacgagcc

SEQ ID NO: 7199 - DNA, 339 bp, Zea mays
  Clone ID: LIB148-037-Q1-E1-C8
agtggagatgcagatgcaaactgttgtatgtggtggtgcttatattgctatcctgttgcctgattgtacgtgttgtcgtcgtggcaaatgttcagtgggtgtaaaatatgaggtcgtaccgtgacctcaaactaagggaaaaaggcaattgtatgaccccagatgggttaataaaaataattggacagtttccggcaaaaaaaaaaaaaaaaaaaaaaaaaaaaaaaaaaaaaaaaaagagagcaaaaaaaaacaaaaaaaaaaacaaagggacacaagaaaagaacgaacaaaaaacaagcaggcaacacgtacaaacaaaaaaagggggggcccccc

SEQ ID NO: 7200 - DNA, 364 bp, Zea mays
  Clone ID: LIB148-037-Q1-E1-B2
aacatgaccacctaaaaactcttggtggaggtgactacctttttgcgttccgtatgttcatggtgctttttaggcgtgaagtatcatttggagactccttatacctctgggagatgatgtgggctctggaatacgaacctgacattttcttcgcagcgtgtgaatgaacaaggtgcagtatataaacacaaagtttctaaatcaaaactgaaaggactgcgccattttggcaagtgggataataaggataaagacaaggataaggaagatgctaaaaatggggctgaggatggtgaagacggtcctgttccaatttctgttttcatggttgcaagtgtccttaatgaaaagatagaaaagctgt

SEQ ID NO: 7201 - DNA, 413 bp, Zea mays
  Clone ID: LIB148-037-Q1-E1-D10
gcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggccgcggctaccgcggtgccgcctgc

SEQ ID NO: 7202 - DNA, 425 bp, Zea mays
  Clone ID: LIB148-036-Q1-E1-H9
gtcgatgacgcctctagagtcaatctgcataatcgccggcaccacgaacggcctgcgcatcaagtcgtacgaggactccaagtcgtcgctcaaggccagcaagttcctgtacgagggcatcaccagggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatctgcaagtccatcggcttgggaaaggagctcgcctgcatctgaacca

SEQ ID NO: 7203 - DNA, 391 bp, Zea mays
  Clone ID: LIB148-037-Q1-E1-A1
cggacgcgtgggcggacgcgtgggcggacgcgtgggacgagccgctgcacgcttaataacattgtagattggtacgggaggtcgaggaaatggaataagacggctattccaatcctaatcgggacaaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttctgacgacgccctcctctaactagtaactcggcagcacacgcacgac

SEQ ID NO: 7204 - DNA, 414 bp, Zea mays
  Clone ID: LIB148-037-Q1-E1-A10
cgaagatggcgttcatcagcaataccgcaattgaaggcggcggccttggcccccctgcggccgggcccaaccgtttcccccggcgccccccccgccgccggtggcgttgccggagggggcccgtcggtgccggccggtccgctggacatcgcgcagctgggcgccaaaggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtcaatcaac

SEQ ID NO: 7205 - DNA, 412 bp, Zea mays
  Clone ID: LIB148-037-Q1-E1-A11
acaccctagactgagtcgaagtaacgtcccagctgatgaccctggtgaacaacatctccatcaggatctccaaccgggagttccggccggggcactgcacgcactacttgaagcactcggggctgctcatgaacgtgttcagcaacgcgttcaacccggacatgagcccccgccggtacgcgcacgtcgacgtcgacttccgcaactcggagcgggactggtaccagttcaagtggcagaccacgtcgccgccgtggtccaagctgtgcgccatgccggggcgcgtgacgcgcgaggtgtacggccagatgaccgtcgcgacgagcgtcaacaaggggatctactacttcatccagttcctggagcagctgcacgactgatccatcgtgagatagatcatcaagttcaacag

SEQ ID NO: 7206 - DNA, 418 bp, Zea mays
  unsure at all n locations
  Clone ID: LIB148-037-Q1-E1-A12
tacagacactcgtgcgaacgcgtgggcggacgcgtgggcggacgcgtgggcggacgcgtgggtgcgtgcctagcatgcatgcatgtgacgacctctcctcctcgctgtctctctgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcnagcacac

SEQ ID NO: 7207 - DNA, 269 bp, Zea mays
  Clone ID: LIB148-037-Q1-E1-A2
cccacgcgtccgcaattttctaccctaggcagaagaatccacatgcataataaaaggtgaaagctagcataagaggtacctaactctaccctactatagagaaaaagtcagcacattgcaagaaataataatggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcg

SEQ ID NO: 7208 - DNA, 296 bp, Zea mays
  Clone ID: LIB148-037-Q1-E1-A3
caggcacaggtccagaagtcgcgggacgcagcaggccacaagtccgggtgattgacccagcgacgacgccgccgaactcgtcaaccccaggaaaggcacgctccggcacgccgtgacccgggcccgggcgctgtggatcaacttcgcgcgcgacattgtgattcaactctggcaagaactcatcgtgaacagcgaaaagaccatcgaacggccgcgaacgcaagtgcacatcgttggcgcgcagattaccctgcagaacgtgcgcaacgtgatcctccacaacctgcacgtccacg

SEQ ID NO: 7209 - DNA, 369 bp, Zea mays
  Clone ID: LIB148-037-Q1-E1-A4
cttcaagcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctg

SEQ ID NO: 7210 - DNA, 397 bp, Zea mays
  Clone ID: LIB148-037-Q1-E1-A5
agcctgtgcaacgaaacctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacacgaag

SEQ ID NO: 7211 - DNA, 416 bp, Zea mays
  unsure at all n locations
  Clone ID: LIB148-037-Q1-E1-A7
aagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttncgggacaagacgcagatctacaactggcacat

SEQ ID NO: 7212 - DNA, 412 bp, Zea mays
  unsure at all n locations
  Clone ID: LIB148-037-Q1-E1-A8
cttcaccgagccccagatcaagtgctacatgcgacagctgctggaggggctggcgcactgccatgcgcgcggggtgatgcaccgggacatcaagtgcgccaacctgctggtgaacaacagcggcgagctcaaggtggcggacttcgggctggcgaacctcttcgcgccggcgccggcggcgccgctcaccagccgggtggtcacgctctggtaccgcccgccggagctgctcctgggcgccacggcgtacgagccctccgtcgacctctggagcgccggctgcgtcttcgcggagatgcacgcgcgccggcccgtcctgcagggccgcaccgaggtcgagcagattcacaggatcttcangctctgtggctcgccgcccgaagacttctggcgccgcttggggctctcccac

SEQ ID NO: 7213 - DNA, 351 bp, Zea mays
  Clone ID: LIB148-037-Q1-E1-A9
cccacgcgtccgggagtccgccatcgaagagatcgtccgtgaggcggcggaacggggaggaggatgcgagactgtcttcttgcaggctgtctcggagatcatggaccgccgtctcgacgacatatcaaaggacatgttagcctctagatatgcacatggctgacaaaataacgatgtaatcaactcaatggctaatgcaaagaatggtgtactatttcaaaaaaaaaaaaaaaaaaaaaaaaaaaaaaaaaaaaaaaaaaaaaaaagaaagaaaaacaaaaagataaaaaaaaaaaataaaaaaaaaaaaaaaaaaaaaaaaaaaaaaaaagggggggcccccctaaaggt

SEQ ID NO: 7214 - DNA, 408 bp, Zea mays
  Clone ID: LIB148-037-Q1-E1-B1
caccgtagagggcatgtgccccggcaaggtctcgtgcgcagacatcctggccttcgcggcgcgcgacgccgccgtggccgcgggcctcccgagatacgaggtcgcggcggggcgccgcgacggcatgcgctcgaacatggacgacctcccgggcaacttccccgtgccgggccaccacgtgccgcgcctcaccgagctcttcagccagcgggggctctcccaggaggacctcgtcctgctctccggcgcgcactccatcggcggcgcgcactgcttcatgttctccaaccgcatctacaacttctcccaggacgccgacgtcgacccgacgctggacccggagtacgccaagtggctgcgccagatgtgcccgccgcggcagcccggcgacgaccccgagcaagcgcc

SEQ ID NO: 7215 - DNA, 399 bp, Zea mays
  Clone ID: LIB148-037-Q1-E1-B10
ggacaaaactcctatctgaacggtaatcaactcaacaatgactggaatgatgttcccaacaacaaaggacttcaattaagtgttcctgtaaatgaattgggcatatgggcaaattcctggtaaaatgacaattaagttccccaatggaaggcaatcaactgcccaattacacctaacaaaatccttagaatcatcaaagaatatgcttttgttgcatctccctatcctgttattaatactctagaagaacaccttacacctgatcttcaagagagagtagctaagatggtcctttaagtgtctggagacatcctgtattaccctgaatccaaacatcttcaagaatttccttcacctgaagctctaaaggggcgtgtcatgctgtcaacaaaaccccca

SEQ ID NO: 7216 - DNA, 383 bp, Zea mays
  unsure at all n locations
  Clone ID: LIB148-037-Q1-E1-B11
gggccaaccaaccccccaggccaaatcctcaaaggcaaatcctcctccgggccttccggtgaacaacaattgcaaggtaaattcccggaacctgaattcccggcggaccttccggttcaccttgtccaggatcaacaacacggacatggaaatcaaggtggaccgcctcggcggaccgaacaagggctacggcaacttcaccaacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggacaggttcaaganggagctggacggcatcc

SEQ ID NO: 7217 - DNA, 418 bp, Zea mays
  Clone ID: LIB148-037-Q1-E1-B12
gggtcgacacacccgtctacacacactccgagaaccttcacaatataaaggaaccaaatttaacaaaccaaacaaacctttaacccaaaattaacaaaggccgaattcaatttccaaggtaaaacctttggaagggaaaaacaattacaactcaaccggtgaatccagattcgaaaattaagattttggggcccccattaataaaaacacaattgggttttaatccaattggcccaagttcgccaaaaagatgcagatgaaaacacgagactctgcagcttattacagctgtgacgatcactttgttgtggtggacaaaacagttgactatggtcgaagaggatcaccgtcagataaaagcagtgcttcagaagtaagaactcatgttcggccactggatgctagcacagcagcccac

SEQ ID NO: 7218 - DNA, 432 bp, Zea mays
  Clone ID: LIB148-036-Q1-E1-H8
ctccactccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgccacgcccggcggctccgcgtacgggtgcaacccggccacggacaggacgtgcaggcccgagggcgtcggggtggtgctgcccgacggcggcattgacctcgacggcgacggcgacgaggacgagctgccgcagttcgacccacacttcacgatcctcggccatgcccagtgagtgtgagtgcaggtgcagctggctggttggtcatctcagtcggtgtactggacatgcgtcgtaatctctgtcgttcattcgacgcgagaggaattgag

SEQ ID NO: 7219 - DNA, 374 bp, Zea mays
  Clone ID: LIB148-064-Q1-E1-C1
agtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgggaaactcgacggccgcgttcgccgcgccgcgcggctacgcgctggccacgcccgtggccggcctcctcgcgtacgacgcgtcggcggggcccgacgcgcgcgtctcgctccgggcgctcggcgcgccggtgcgcgtcgagttcaaggacgacctgtcggcggcggcggctctggacaaggggttcgagttcgacgccaccaccgcgcggtgcgtgacgttcgcggccagcgggg

SEQ ID NO: 7220 - DNA, 386 bp, Zea mays
  Clone ID: LIB148-064-Q1-E1-C10
cacgcgtccacaaacagggactcgacagatatggcttccggtgttgcagtagacgatacatgcggaaaggagttcactgttcttgtgagaagcacgccaagaaagtaccgtgctattatttgcaaactcactgatgacctgtcttctgtatgtgtggaaaagacgcttcccgcagccaacataaccaagtgcagtgcacaagaagactggaaaaagtttgtgactgaattgccccaaaacgattgtcgttttgcagtatatgactttgagtatcacacttctgaatgtgtttccaagaatataataatatccattctttggtcacctgaaactgcgaatattacgtccacgatgttgtaatcttctatcagagaagctcttgttca

SEQ ID NO: 7221 - DNA, 452 bp, Zea mays
  Clone ID: LIB148-064-Q1-E1-C11
taccggtcgtatatctcgggggctcgaacacgcgtcaagagaatggcatcaccttctttacaagtagaacaacgaccagtcacggaaacctattgtatggtctaatatcggagtgggtgcagttcttcaactgtttgaagttactactcgtggacagccgtttgaagttatcaagacacagcttgctgcaaatcgaaaggacagcatgatttctgctttgaagactatctattctagaggaggcatattgggcttttaacaaggactgattccctgggcatggattgaagctagtacgaaaggcggtgtcttatttttggcgcataatgaagcttctacctttgttgcgtcgttgggattttctccaaccgtttcagatacggtaggatgtacatttggtggtgtcgcacaagcttatactactatggggttctgtacgtttatgaaaaccg

SEQ ID NO: 7222 - DNA, 446 bp, Zea mays
  Clone ID: LIB148-064-Q1-E1-C12
attgcccttgtcgtctatcatagacacacgttaaccttggtccattactactaggaatgacccttcgtaaaccagtctttaccaaagtagaaaaactacaacccgggacacaggggcacaacttgatcgttcaagtgatgaacgtcggtgaggttatggaaaaagtgagaccgagtggtgacaaactgcaaatcgccgaagtgctacttgcagatgaaactggagcggtattatttacagcaaggaacgaacaaatcaaactttttaaaaagggagagtgtgtgaccgttcgaaacgcaaaagtcaatatggtgcgaggctttattcgtttagtagttgacaaatggggagctattaagccgcctggaccaacggaaaagttacaaggaccaccaaaagtagaaaacaatatttccaacatagaatatgaactcgtgtaagacact

SEQ ID NO: 7223 - DNA, 388 bp, Zea mays
  Clone ID: LIB148-064-Q1-E1-C2
atcgacctctcgaattccgtctcttgtctctgtcctcctcgctcggcttccccggttcttgagaggggaaagatgacgcggacgatatggatggggagggacgacaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactatcgactacaccctacacgtgttggtaggctactgccccgtgtacatcttcatgcagaccttcatgatcccaggaacgatattcatgtcactgcttgctggtgctctgtttgggc

SEQ ID NO: 7224 - DNA, 329 bp, Zea mays
  Clone ID: LIB148-064-Q1-E1-C3
acattcccttcgcttcccttccctgagcaaacagaagtaaccacaatcatttcaggcatcatcgacacaagttactatacactccacatcgtgggcgaccaccaggatgagcaccagcacagaatgggccaggagcaccacactaagggccaggaccaccacaataaggaccacggggagcacaaggagggcatcatggataagataaagacaacatgacctgcgagctaccgaacttctccggcaaccacaaggacaaaaaccatacggagaagacagttcagaacacgtagacatagacgatgcacggcgaaggccaagaccatggt

SEQ ID NO: 7225 - DNA, 381 bp, Zea mays
  Clone ID: LIB148-064-Q1-E1-C5
acccacgagtccagccacgatggggtgcacagacaatgcgatgagagccttgttcctcctggtcctcttctgcatcgtgcatggtgagaaggaagagtcaaagggcatcgatgcgaaagcgtccgggcctggtgggtccttcgacatcacggggttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggctacgtgaccatccaggtggatggcaatctgctggcgaccacggacctaagccagtacaaggaacatgggaattg

SEQ ID NO: 7226 - DNA, 432 bp, Zea mays
  Clone ID: LIB148-064-Q1-E1-C6
acagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgtgatcaagcaaggagacgacacttgaattctctacagtttggcataggtcgggagagacactctcgaccggccacaccatgtaacaaactaaccttcgatgtctcccaataatttcctcaacggagttcttctgatgaaac

SEQ ID NO: 7227 - DNA, 378 bp, Zea mays
  Clone ID: LIB148-064-Q1-E1-C7
gtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagcta

SEQ ID NO: 7228 - DNA, 403 bp, Zea mays
  Clone ID: LIB148-064-Q1-E1-C8
agttcctgtcctctcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgct

SEQ ID NO: 7229 - DNA, 397 bp, Zea mays
  Clone ID: LIB148-064-Q1-E1-C9
acagcgtcctcgatcctcactgagaaaggttactccttcaccacctctgcggcacgcgaaattgtgggagacatcaacgctcagcttgcatatgtggctcttgaatacgacgaggagctcgagaatgccaagagcagctcatcggtggagaagagctacgagctgcctgatggtcaggtgatcaccattggggcagagaggttcagatgccctgaggtccacttccagccttccttcattggtatggaagctcctgacatccatgataccacctacaactccatcatgacgtgcgatgtcgacatcatgaatgacttgtatggtaacattgtgctcagtggtggcaccaccatgttccctggtattgcggaccgtatgagcaacgagatgactgccc

SEQ ID NO: 7230 - DNA, 379 bp, Zea mays
  unsure at all n locations
  Clone ID: LIB148-064-Q1-E1-D1
agcaacaacaatctgttccggccgccaaacanaacccanaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcccccggggg

SEQ ID NO: 7231 - DNA, 444 bp, Zea mays
  Clone ID: LIB148-064-Q1-E1-D11
cacacgcgtcaacacacgcgtccgggatgacattccaacttggcggaaagtgcgctgtggtttggtgtctcgttttgaacttgtgaataataaagatgcctcctgttgcaccattgtttggaatctcaccaaagacagttaatcgtgaacttgagcactggatgagcaacctaaatgaagtccaaagtgtgataaatagtgtcgaacccaagttgaatacaactccagccaagtggaaagctctctcccaacacgtgaaagaagtctctgaagagttgagtcatattcaataaggaggatcctcattatgatgttattgtggcaggagtacaagctagtaaaaattttgaaagtgcagaagcagacatttccaaaaacgatggtattagagaacgagcgatgacaaggttgagaaagtatcgtgacgaaatcgaatctcttcgt

SEQ ID NO: 7232 - DNA, 449 bp, Zea mays
  Clone ID: LIB148-064-Q1-E1-B9
accacgcgtcagaacacgcgtccgcgccattggccatcgcttgaatccatttaggaaaaggttgcttcttggacgtatgccgctataagcaaaacggagtgacaaagttggaagaaaatgcctcgagcaggtaaagttgtgtctcgctcggttgtaggaggtgaccgaaacagaagagaaccaacacttataaggattggtcaacctcaagcttccactaccgcgaaaagttcgactagtgccaaaccacatagatatcgtccaggtacgagagcgctgatggaaatacgcaagtttcaaaagagtaccgacttgttgattcgcaagttaccgtttgcacgtctggttaaggaaataactcagcactatcatcacgaacttcgctggcaagtggaggcagtactagcccttcaaacaagtgcagaggactacctagttggtttgttgga

SEQ ID NO: 7233 - DNA, 329 bp, Zea mays
  Clone ID: LIB148-064-Q1-E1-D12
acgcgtcaaccaggcgtccgcaaagtttggttcttttcttggtatgcagttctacatccaacatcatcaaatgtgtcagcggaggtatagaatgattcgccatcgatttacgccatcattacgggtacagcaccagattctacaaagattataggggattctggtcaggacgctacgttgaacggaactggtaccgagaaagactacaatgttgactattcatgttcctgtcacatcctgtaagttcagtttgatactttctatctctgcgcatgatactcagcagctatactggttatgcgcagcatgatcgctacttttgttaactc

SEQ ID NO: 7234 - DNA, 375 bp, Zea mays
  Clone ID: LIB148-064-Q1-E1-A3
atctggggttcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtg

SEQ ID NO: 7235 - DNA, 392 bp, Zea mays
  Clone ID: LIB148-064-Q1-E1-A4
aaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggc

SEQ ID NO: 7236 - DNA, 371 bp, Zea mays
  Clone ID: LIB148-064-Q1-E1-A5
attgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgccc

SEQ ID NO: 7237 - DNA, 415 bp, Zea mays
  Clone ID: LIB148-064-Q1-E1-A6
aggcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtccaa

SEQ ID NO: 7238 - DNA, 337 bp, Zea mays
  Clone ID: LIB148-064-Q1-E1-A7
agcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgag

SEQ ID NO: 7239 - DNA, 381 bp, Zea mays
  Clone ID: LIB148-064-Q1-E1-A8
accacgcgtccgcacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcaaggaaaaacctgagtgctcgggcaatccagtcacggtgtacatca

SEQ ID NO: 7240 - DNA, 342 bp, Zea mays
  Clone ID: LIB148-064-Q1-E1-B1
aggtccgctcggcggcgctgttccagaactgcctcatgacggtgcgcaagcccggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccg

SEQ ID NO: 7241 - DNA, 435 bp, Zea mays
  Clone ID: LIB148-064-Q1-E1-B11
aaacacgcgtccgtgggccttccgaagagttttcacaaaacataaaatatgtcttttcttttagaacttttaaaagaaattcgctggagaggactttggggaacttttcaagcagccaaaatgaatagactgggtacaatgaagtactttgtcggcgaagacgagtttcacaaccgatactttcaaaaagtaaacgatgttatgttgaaggatcgttgggtggaatatgcttctaaggaattcacccctgatccttattcgttacctcctgagtggcatgcctggctgcatcatattatagatgagccacccacaaaagtaggtttccagagaccaaagtatcaagcacagatcgtcgcaaaccgtacaggcacaacagatgcgtattttcccaagaacaatcctcttagtaagaactttaagggcttggctaca

SEQ ID NO: 7242 - DNA, 445 bp, Zea mays
  Clone ID: LIB148-064-Q1-E1-B12
aaaccacgcgtccgcccacgcgtccggaacgcgtcggtgggtcgttcggtcggtcggtgaagagcacgacaagacgggatgttggtgtacaaagacgcttttacaggtgatgaagtatgttccgacgccatgaaaaacctccatgaagaggaaaacggtttgctgttggtatgtgactcgtacaacatttccaaaggaggggaagattatgggatagaagtaaacaacgatgaagatgaagaaggaggaggaggaggagcagataatgcggtggaacaagtgaatattgtggtcgagtcgtttggtttacaaccttttcccatcagcaaaaaggactttcaagtaactatcaagcgttatagcaaacgagtcaaggactatttggagaagaacaaccggatagagtggaaaagtttatggaaggaatgaagtcgtggttgcccaa

SEQ ID NO: 7243 - DNA, 391 bp, Zea mays
  Clone ID: LIB148-064-Q1-E1-B2
aatcgaggatgatgaaatgggggctcagcagcggcacgcccgcggattcctactacgaggtacggtcagattgcacggacggtgtgcccaaaaacaagttcaagatcaaggctggcaaaacattaagtgctcggaaatggcaggctgcatttagtcccgatggctgtcttgatattgcctcagtcctaagccggatacaaagaggaggtgtccatccgacagtcagaggagaggtctgggaattcttacttggttgtttcgattccagaagtacctttgatgaaagggaagagataaggcaaatacggaggatacaatatgacagatggaaggaagattgtcgacagatggattcgcatgttggtagcggtaaagttatcacagcaccact

SEQ ID NO: 7244 - DNA, 186 bp, Zea mays
  Clone ID: LIB148-064-Q1-E1-B3
gcgtccagtccagtatcaacgtacccaggggtgcggcggcggggtccgtacaggaggtcaatgacgccttgacgaacatgttccccagtgagaccgagatcgttgtcaaaattcaggtccttgctggtggccgtgggctgggatcgtgcgcaactgtgctgcacggaggtgtccatgatgttaccg

SEQ ID NO: 7245 - DNA, 392 bp, Zea mays
  Clone ID: LIB148-064-Q1-E1-B4
ggaggccaagagcgcagcggcgaagccatagccaagctcacccgatccagtccctgccgcccccagcgtgccacagccagtcccgcgctcagctcagctcagattcacgagctcgtctcccagatccagcttcgtttggttgaattctcttctttggaagtgctggtgggcggcgtggtttggtgctcttggggccggcgtgtttctgcgttctccgggctatctgcctgtcttgctgcggcctgcggcggcggggtggagatgggggtggccggggagaagttccagctggggacggtgggggcgctcagcctctcggtggtgtcctccgtctccatcgtcatctgcaacaaggctctcatgagctccctccgcttcaactttgccaccac

SEQ ID NO: 7246 - DNA, 372 bp, Zea mays
  Clone ID: LIB148-064-Q1-E1-B5
agcacgacctcgtcccggtccacaacaacatctagctcggcggcctcttcaagccacgggaagacgatgcgctccgcttcgtcgtccgtgggtggtgcaagtgcaagcgcaaggcagacagacgcggcgagaaggagagcagagaagcccggtgccacatccgtgtggcctgcggccggcggcgcggttaccaacgcctcgtcgtctaaggatgtggccatcagggcagcaaaatcgccatccagcgccgcgcacaagacgaggcctgctggtgtcgagaaggcagcagcgtcttctgctgtaaagctgatgacgatgcctcagaaaacaatggcaggagctggaaaaagtcaagctgcacctcccgcccgt

SEQ ID NO: 7247 - DNA, 387 bp, Zea mays
  unsure at all n locations
  Clone ID: LIB148-064-Q1-E1-B6
aggaaaactagcttgcagcagtagaaattcaagtggggcttaccatctatttcacacttcctgccttttacactggactattctgtgccaatacgagatgctgaacgatgaaatagctaggaaggggaagagcaaccgaggaaggaaggcaaagaatgcacctaggagaagcaaaataacgtccatagtttgcccagaatgtcagggtactggaattcacgtcaacggagatgaacttgagaagccaagcatttctttatcagagatgtttcgcttcaagatgaaagcaatcgaagctcacaaagcatggctgaagagacctgaagtgcttgaaaactgttccactgggcttcatttcncctcagaacatgtggagaactctgagga

SEQ ID NO: 7248 - DNA, 382 bp, Zea mays
  Clone ID: LIB148-064-Q1-E1-A2
gaataaactatggggcaagccttcccacggcttgtcctcctcgccctcgtggcgttgttgtctgccggcctcttcccgcaggcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgaccatttggccgtgctgaacatgcaggtggccgcgttcgccaagcgcacagcgcaggcgcggaagcacgtcgcggtggcggcccgcactattccaccgccgcaggcacaggccctcagaacctgcgacacgatgtacatgaacacgcaggacgccatcggcg

SEQ ID NO: 7249 - DNA, 362 bp, Zea mays
  Clone ID: LIB148-064-Q1-E1-B7
gaaaactagcttgcagcatgtagcattcaagtggggcttagcagctatttcacacttcctgccttttacactgaattagtctgtgccaatacgagatactgagggatgaaatagctacgaaggggaataacaggcgacgaatgaaggcaaagaatgcacctatgataagcaagctaacgtccatagtttgcccagaatgtcagggtactggaattcacgtcaacggagatgaacttgataagccaggcatttctttaacagagatgtttctcttcaagatgaaagcaatctattttcacaaatcatggctgaatagacctgaaatgcttgaaaactgttccactgggcctcatttcccctca

SEQ ID NO: 7250 - DNA, 257 bp, Zea mays
  Clone ID: LIB148-064-Q1-E1-B8
agttcaagcacctcctcttcccccgccgggcaacaactcagccgccgcaaccgccacatcagccatgggcgcctgcgcaaccaagcccaagacgcttgaggggcaggccccagctgacgccgccgtctccaaacccagggtggcgcccgacgccactctaatctacgttaaggttgctgccgtccataatttgcctagactgtcagcgtaccgcaattcatgtcaagcgatatgcacttgatacaccccccatttct

SEQ ID NO: 7251 - DNA, 214 bp, Zea mays
  Clone ID: LIB148-063-Q1-E1-G7
accacgcgtcgggcacatttgtttcagtttattgatgcgcgcatgcatgctagcagacatctttcctaaaaaaatttaaataatttccatctcgcattattttagtagctaccattcatgttttctgagtagttgtataaatgctaccaccgtcatcttttgtacccggccggaacaaacgaaaaacacactatctatgctgtgttgtgaattc

SEQ ID NO: 7252 - DNA, 328 bp, Zea mays
  Clone ID: LIB148-063-Q1-E1-G8
atcaagctcatcaagtgctagttcgatctgctgccggatcactgagactctgtatcgcagtccagtgactatccacagcagcagcagcaggtcctcctcgacgactcagtaggcatggactgctaactggtaatcaacagctaacctgcgctctgccactagtgcctcgaagaaatcctgcaagtcaacgacttcaagagagcggggctgcatttcggcctcgagcactgcaagaacctgctccacagcatcaactcttaaagaaccggttaggccgacctgcacgctgccctagaccgcgctgaacacatacgtctgctgtacaaca

SEQ ID NO: 7253 - DNA, 347 bp, Zea mays
  Clone ID: LIB148-063-Q1-E1-G9
ccacgcgatcgaccctccctctatggcgatggtgccattgttgcagtgtgcgttgccgataacggctttgacaggtgcgatcccctaacgcactcctggggccccatctcaggggaaggtgaggggcccaccgcttacgggacctctcaccgtcgggctcactacccagtggaggcaccacgtccgtctaccacgatctcatccctgccacctggtaatgcgatcaccgcataccccgcccaatagttgacttctactggtgacaatcctttacgccggcgcatgtctaccactaccacaattggttgggtcccacccaatgcattacacctgcatccattggcccg

SEQ ID NO: 7254 - DNA, 340 bp, Zea mays
  unsure at all n locations
  Clone ID: LIB148-063-Q1-E1-H10
acatcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgattcccaagggcgactnactgntcggccctctcaac

SEQ ID NO: 7255 - DNA, 390 bp, Zea mays
  Clone ID: LIB148-063-Q1-E1-H11
gtaaaatcacctccatctccagcatatgtgagtgaaccgcctccaacggtgaaatctccttcaccaccatcacctccaccgatgattaaatcaccgccaccaccggtgccggtgaggtcacctccatcgtcagtgaaatcaccgcctccttcaccactgttaagttcgccgccgccaccagcgcccgtgaggtcacctccaccgctaacgaaattatcacctcctccaccaccgataaggtcgccacccccaccacaagcaaactcacctcctccatcagctccaataagctcacctcctcctccgatgcaatcccctccaccgcctgctccagtcagctcaccaccaccacctataaaatcaccaacaccggctccagtaagctcaaca

SEQ ID NO: 7256 - DNA, 400 bp, Zea mays
  Clone ID: LIB148-063-Q1-E1-H12
attcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacga

SEQ ID NO: 7257 - DNA, 351 bp, Zea mays
  Clone ID: LIB148-063-Q1-E1-H3
cgcgtcggccctgcctctgccacctcgaggtgatgaacttgtattccgcccccttgaacatctccaacctgtgaaatactcccggcctggattacccttgttgggttttggagaggagattttggacaatgctttgactaaggcagaaaaaaataagatcaatttacatttggtggctgcagaagaagctcttgcattgtcgatatggactatggctacagtttgtcgttctctgtctttggaaagtgtgctaggcttattcactggagttttgctggagaagcaaattgtggtaatatgcccaaatctgggtgttctgtcagcaattcttttgtctattataccgatgat

SEQ ID NO: 7258 - DNA, 428 bp, Zea mays
  unsure at all n locations
  Clone ID: LIB148-063-Q1-E1-H4
cacgcatccgaaattgcgccactgctcgttatcctcctcttgcattgcattgcaggtcgtagttgagcagcagcaaccactgcacaagatgtcgtggcagacgtacgtcgatgagcacctcatgtgcgagatcgaggggccacacctgagctctgccgccatagtcggccacgacggcgccgtttgggcccagagcaccgcattcccacagttcaagccagangagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaagcgctggtgatcggcatctacgacgagcccactgaccctggac

SEQ ID NO: 7259 - DNA, 407 bp, Zea mays
  Clone ID: LIB148-063-Q1-E1-H5
ccacgcgtcgggccggcgccacagcctctcatgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacga

SEQ ID NO: 7260 - DNA, 402 bp, Zea mays
  Clone ID: LIB148-063-Q1-E1-H7
ggaatcacggaacgaccacgcgtcgggcagcatgcgacctagcgagttgtgataccgactcacattctcgatgaacacacgtatgtcacgcgacgctcgcagttacagtcctccacctgaccgctgcagaatggcgaccgctaagcgtagcatacggcatgaatctccatcacatcacaagagccaaggacgacggaacagtactaaatatactatacgaaggtttaactcggtcacaatgacgacaaccaactccatgacgtcttcggacactagacccgttcgattagaaattaacgtcatttgcgacatctcaaggatcatggatcaactgaatgcagctagatacaattgtctgcgacgcatcttctgatacatacaactatacatacgttttgcaaa

SEQ ID NO: 7261 - DNA, 407 bp, Zea mays
  Clone ID: LIB148-063-Q1-E1-H8
ccacgcgtccggacagaaaacagtgggatcgagttgtttcactgcacgagcacatcctccggcgaccaccggcctccctctccgtcctctagcgaccgaccaacgcgtcgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaaggggatcgggggcatcactgtgaagaaaac

SEQ ID NO: 7262 - DNA, 412 bp, Zea mays
  Clone ID: LIB148-063-Q1-E1-H9
aagaagttcccaggcatcggcgccttccagtgcaacgacaggtacatgcgtagccgcctgcaggcggcagcggaggcggccggcaagcctgattggggccacggtgggccgaccgactctggcggctacaacaactggccggaggacaccgtcttcttccgcggcgacaacggtgggtggagcaccgtgtacggcgacttcttcctgtcgtggtactcgcagatgctgctggagcacggcgacctcatcctgtcgggcgccacgtccgtgttcggcgccgcgcccgtggaggtctccgtgaaggtggccggcatccactggcactacggcagccggtcgcacgccccggagctcaccgcgggctactacaacacgcggtgccacgacgggtatctcaacatcccgcgcctcc

SEQ ID NO: 7263 - DNA, 384 bp, Zea mays
  Clone ID: LIB148-064-Q1-E1-A1
attggagattaaaaaggatgtagttctgttggatgacgatgatgatatagagcctgctagatcaactgatgttcagatatccaataagtgggaggagtcaaatatccactatccttcaagcactgatccagaagcggttgaactgacctactctgacatgaaatgtcttgaaccagaagaatatttaaaatcacctgttagaaatttttaccttcagtacctcaagaaggcaagacctcgcagggatttacacatgtttaacacctatttttatagcaaactcgaagaagcactatccatgccgggtcaccatgactcagaattcagcaagttacggagatggtggaaaggtgtaaataattttaagaaaacgttcaaaaattt

SEQ ID NO: 7264 - DNA, 436 bp, Zea mays
  Clone ID: LIB148-064-Q1-E1-A10
agaaatcgggggtttcgagttctaaaaagtcccaatcaaagtcgaacaagaagaaagagaaaactcggaagaagcaaagttgtaagtctagcggtgaaaagaacaagaataagacaagttcggaaggaaaatatttggaacaaccagactcttgctacgaaagcaaagatgaagacagttggagtggtaacagtagtagttcattatcgaagagaccaactcagcatgcttttggcgcaacgagtcgattttcaaaggatacagtacactttgttcaagatgaatctagtcgttactccaatggacctatcatggataaagatttagaagagtgggaagcagatattgaggcggaagtggaagctttccgtaagagactcgaggaacttagtgcgccattgaagaataagccaaaggtcggtgcctttccgcatcg

SEQ ID NO: 7265 - DNA, 448 bp, Zea mays
  Clone ID: LIB148-064-Q1-E1-A11
ggcacaacgacgcgtcagcatttttggatttttggattcgtttgttgttggtctggttgctcaaggtgtgaaatggcagtagttgaagataacagagtctttgttggtggtcatccttggtcagttagtgaagaagaccttcgtgaaactttttccaaatatggagaagttgttgatgcaagggtgaatatccgtgttccttttgttttgggttaaacttggatcccttgactacctgcacctattctcgggttcccttttatttgccccatagttagtgtcactaactagtcgcatgttactttgagagggtagagagcttttcgagttactttataactgttcacacttgggaaccctcgaaaatagtgtgaatgatatgcacttgggttgactagtgtacaccaaagttgttgttactatatagtgctcacaactgtgtcgttgc

SEQ ID NO: 7266 - DNA, 420 bp, Zea mays
  Clone ID: LIB148-064-Q1-E1-A12
aaaaagggagtcattccaccaggggagtaaaggcgcaagaaagaaacccaaagcaattgacgggaatcggaaaaaggggtggatcacgtaaattaatccgatgtaaaccgagaaccttacctctccaagaaggtgttgcacggctgtcgaaagaacgtgctgtgaagtgagagaacgtacgagaaagccaagtgaggaaaagaaggcaagtagagggcggcccgagaaaggagagggcgtaagacgtgatacagagtaggaagaaaagagaagagagctagaaaggaggtaaaagaagagtaaaaggactagaagaggtacggaattcacgaggaaggagcgtgaaggaaggaggaatcccaagtaatcgaggaagaaaaagcttcggtgaaagcgtgaacggattttgtacacactgcc

SEQ ID NO: 7267 - DNA, 487 bp, Zea mays
  Clone ID: LIB148-063-Q1-E1-G6
tggttcgtggatggcagcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaccagcagtccgcggacagcggcgggttggtgcaaccgccgcgggagcacttcgactcagcatgcccgcgttcctccaga

SEQ ID NO: 7268 - DNA, 444 bp, Zea mays
  Clone ID: LIB148-036-Q1-E1-G2
acaacactctaaagtgagtcatattaatcttcttgagctcagagctcgagccaccgatatggttgtcctttacttccataaggctgcttcggtagggcaaaatactttctttgacgttttaaaatatgttgctgcccagtccccttctcggaaatcaaggctgcaccctcatcaggaaccacagcagcagcaaccacaagtgcaggtggagctgcagcagcaaccacaagtgcaggtggagctgcagcagccgcaaccacaaaaacaagcagcacctgttatgcgcagaggagcatctattgctgctcggcaagcagcaatggcacagcaatctctggagactatacccgttccatcttcacccaagatcaagcgtcaaacatcagggagacctggttcggtggcatccacaaagcctgcagcagctgcattccacacaaaacc

SEQ ID NO: 7269 - DNA, 380 bp, Zea mays
  Clone ID: LIB148-036-Q1-E1-G3
aaagacgctcgggtgacgatgcctgaggctagacaaatactgagctagccttcagaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacata

SEQ ID NO: 7270 - DNA, 436 bp, Zea mays
  Clone ID: LIB148-036-Q1-E1-G4
aggagtggtggcgcaacgagcagttctgggtgatcggcggcacgtcggcccacctggcggccgtgctccagggcttgctgaaggtgatcgcgggcatcgagatctccttcacgctgacggccaaggctgctgcggaggacgacgatgaccccttcgcggagctgtacctggtgaagtggacgtcgctcttcatcccaccgttggcagtgatcggtatcaacatcattgcgctcgtagtcggtgtgtcccgcgccgtgtacgcggagatcccgcagtacagcaagcttctgggcggcgggttcttcagcttctgggtgctggcgcactactacccgttcgccaaggggctcatgggtcgccgcggacgcacgccgaccctcgtctacgtctgggcgggacttatctccatcaccgtctccctgctttggatcacatc

SEQ ID NO: 7271 - DNA, 389 bp, Zea mays
  Clone ID: LIB148-036-Q1-E1-G5
cgatggcgttcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaactgg

SEQ ID NO: 7272 - DNA, 421 bp, Zea mays
  Clone ID: LIB148-036-Q1-E1-G6
tacgcagcatcgcgacaggaccacaccgcccgtctgaccgacgcaacccagccgtccagacgcgccgccgaccgtccttccaccaccacgcccgcgccgtcgcacgctccctagggttccgcagggccggggatcgccggagatggactggagcgcggtgacggcggaggacttggtggacgcgctgcgggaggtggactggtccatgccgccgcggcctgtcccggagttcttctcccgcttcaccgtcccacgctcctactccaagtggaccagccgcctcaagtgcaacctctactactacaggacaaactatttcatcttgatcatgttcatccttgggatgggcttcctttggaagccagttgctatagttgctgcttttatgactggacttagcatcgcatttctcaatgatagt

SEQ ID NO: 7273 - DNA, 194 bp, Zea mays
  Clone ID: LIB148-036-Q1-E1-G7
taaatgcattacacatgcatgcattggaccgtgatatctatttgctaccactaccctattacgacagtgatgctggcgccaacaatgatggtgtcatcctccttctccatcttcttcatctccatatatagctagagtgagacttcgctgttgtttaaaagagaagagttaagaaatggattgacaagttatat

SEQ ID NO: 7274 - DNA, 434 bp, Zea mays
  Clone ID: LIB148-036-Q1-E1-G9
gggtcgatgcacgcctctatactgaatcatatcatgccttgccggcacagctctgcatagctcctcccaagctttaggattaggatttggatttggatttggatttggatcgggtgtgtttcctgcgtaaccatgagcgagatcatgaagctaaagcgtgggatcagcaccaaaccaggagaccacctcgtccaaaatggccaacaacatccatgtcacgaatgggaggagcaacagcgctactggccctcgccgcgggcgccgccggcgagcccgacggagtcgcccaggaccccaggcgggagccagaagaaggcggttctgggcaaggtgaagagcaaggccaagaaatggatgcacatgctgcatcacaagaagaaacccgcgccaccggaggagatgatgtggacccccaggggcgggcctggacccag

SEQ ID NO: 7275 - DNA, 243 bp, Zea mays
  Clone ID: LIB148-036-Q1-E1-H12
atcttatgaaagttaaggaacccttccaacgaatcccgcaaccggactcccttacacctcctcctccctacggaagggttgccatcccttcaccaacggaaacggtggacgtaccgctgcagcagcggttcatccgctcaggaaccacattgataccggtcctttttcaaaactccatcatctcccaccaggattaatcgcactactgcatcctaaacgcgctcacacttccctgaaacaact

SEQ ID NO: 7276 - DNA, 123 bp, Zea mays
  Clone ID: LIB148-036-Q1-E1-H2
gtcgacagacccgtccgcaggatctcgacatacatcatagctgagaacgtaggtcccaagtggacgttgatatgaacacaagtagcaaccggcgtgttataccggtacagcgacatcgtcacc

SEQ ID NO: 7277 - DNA, 165 bp, Zea mays
  Clone ID: LIB148-036-Q1-E1-H3
ctcacgggtcgacacacgcctctaaagacagtctggggaagtatcgatttgtcacgggaaggtacgcctaatgttgagagaaactgtattcttgtgctccactttctgcagtgccgacgtgtaccctttccgttttactaaattataattagcttcccttcattt

SEQ ID NO: 7278 - DNA, 403 bp, Zea mays
  Clone ID: LIB148-036-Q1-E1-H4
ttccctgcctgcctcttcttctcctccgcctgttcttgccgcggtctccccctccggccgatctggactcgacagatcattaattttttgttggcatacattcccaaccttgatgtaaagacctccttcattcagaaccctgtgttttggaagggtatttcacaatgaagcccaatcagttgattacatcccatgttgatatacatagggtatacccatacgagttccaaccagagttttcaatgtctcatgatcttggattgaatttgttttcacaagccggtacagtgctgggtacttctttaagacatcataggaagatctcttcttctggaaatgcaatggtccatggagctttcaatcgcctcaacaagctttcccgagctctctatttctggctctc

SEQ ID NO: 7279 - DNA, 349 bp, Zea mays
  Clone ID: LIB148-036-Q1-E1-H5
actagtagccaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggtgagtgagc

SEQ ID NO: 7280 - DNA, 423 bp, Zea mays
  Clone ID: LIB148-036-Q1-E1-H6
acaacaagcaggttctcggcgcgctgccgttgccgctgccgtacaccatcacagccttccagctcgcgttcggctccctgctcatcttcctcatgtgggccaccaggctccacccggcgcccaggctctccgctgcgcagctgggcaagatcgcgccgctggccgtggggcacatgctgggcacggtgttcaccaacatgagcctgggcaaggtcgccgtctccttcacgcacaccatcaaggcctccgagcccttcttcaccgtcgtcctctccgccctcttcctcggcgaggttccttcccttccggtgctgggctcgctcgtgccgatcgttggcggcgtcgccttggcgtcattcaccgaagtttctttcaactggaccgggttttggagcgccatggcgtccaatcctgacaaccaat

SEQ ID NO: 7281 - DNA, 431 bp, Zea mays
  Clone ID: LIB148-036-Q1-E1-G12
cacgggtcgatgcacgcctctagactgatcctgatcagcaagtataagattggtagcatattgcatacacgtatacaagtgactgattggctcaggccttatggcttacatttttttcttcttttgctttgtgtttttaggcggtaatatcagctgatttttgagctgttaaatagagaactcgctgctcaatttttaactctagtcttcaagaaggaagacgagttgagttccgtataatcggtgaattcacatccttttgtcgccggcggctccacatgtgccatcatctcatggccatggcgcaatgttatgcagatgtagtgtgaaatccgaagaacctaagcattctgctcatctccatctccatatcagcgtcaaatgctcaaattttttagttcaagtgactgctgatacgcatggaacaaaac

SEQ ID NO: 7282 - DNA, 427 bp, Zea mays
  Clone ID: LIB148-036-Q1-E1-E5
ctggttcgtggatggcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaacagcaatccgcggacag

SEQ ID NO: 7283 - DNA, 439 bp, Zea mays
  Clone ID: LIB148-036-Q1-E1-E6
acaaaactctagactaagtcgtattaccaagaccaggggcagtcggggcgcctgagaacgaggccaccgtcgccgactcgatagtgtgatccacgcaccagccatcgtggcgcgcgtttgactgctataggtacaagtaggatatcaaggcagaaataatgcaggaccctcttctgccgtgcaatcctttagtttttgcaaggagagggaggggataatgcatagatggacaattgctacctggcaccatttttcagcatatgtatagaaaggagctacccatttgaaactgaaagtcgtaggcattgtttaattaagtgcgctagaaataccccagccgcattcagctctttttatatatatgctaacaccgtaatctaatgtttaaacgctatccggttcattggctacaactgtcaatgatatgtaccgagactta

SEQ ID NO: 7284 - DNA, 431 bp, Zea mays
  Clone ID: LIB148-036-Q1-E1-E7
tgggtcgttgcaaacctctacactgacttctggtacctggtgtccgcctgcctcatcctcatgctcttctccctcctgcggatcatcttcccgctgggcaggacggggaccatggtgtacggctgcatcgccgcgctcgtcttctccggcttcatcatctacgacaccgacaacctcatcagggtctactcctacgacgagtacgtcgccgccgccatcgagctctacctcgacatcatcaacctcttccaggccatcctagcggtgctcgaaggcgtcgactgatagggtcatatatataacacggccggctgaggctcatgggctgtgagcatatatacataggatcatatatatgcaatctatacatgagctaccactaccactacccagaaattggttccaagcttgcttggcaatctgttatccat

SEQ ID NO: 7285 - DNA, 426 bp, Zea mays
  Clone ID: LIB148-036-Q1-E1-E8
agctagcgacggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgttcacatccgcgccacgatgagcatggtggcgcaggacacgc

SEQ ID NO: 7286 - DNA, 407 bp, Zea mays
  unsure at all n locations
  Clone ID: LIB148-036-Q1-E1-E9
cgagaacctttctcactcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgngcgatcgcgacatcggcgaggtgtttgtgcccatcgacgacctcctggccggcgccgacaagggtggcg

SEQ ID NO: 7287 - DNA, 126 bp, Zea mays
  Clone ID: LIB148-036-Q1-E1-F11
gatctgcgtggacagcctcaccgcaaagccagagagccagaaggcgaccccgcgccggctggcggagctgtgcgtgaacatcgcggccgagaagggatccgggatggccacgttcgtgcacgggaa

SEQ ID NO: 7288 - DNA, 223 bp, Zea mays
  Clone ID: LIB148-036-Q1-E1-F12
gtcgatgcacgactctaaactcgactcctatgtaaccactcaagtgcatcgtcggccagccgtgctagtagacagcggcccggtcgggcacatactcctcttcctatatacatcggatttggatgggcggcatatatgtacgtgtgtgtaatatattattactacatcttgtactatatgcgacgattgcttgactgatgaatcacgctttttaggttagacc

SEQ ID NO: 7289 - DNA, 420 bp, Zea mays
  Clone ID: LIB148-036-Q1-E1-F2
taacacgcgtcggcacagccacacactagtcggggaaaacgatcgaacgagcacaggcacgcacgcaccatggcccgcgctctcgccctcgcctccttcctcctcgtcgcctccgccaccgtggctttcgccgcggaggccccggcagcctcgccgaagcattcggcctccacgccgtcaaaggcgcccagcagttcgcccgacaagtccgagaaggcccccacggcgtcggctgagaatgctgcagagacgccgaaggcaaccccggccaaggccccggcggcggcctccaagtcagaggcatcgccttccgaggcgcccgactccgggtccagcgctgcgtcacctactagcgagagcgccgcgtcagagaaggcccccgccggtgcccccaaggactcgtcggccagcccttccgcg

SEQ ID NO: 7290 - DNA, 453 bp, Zea mays
  Clone ID: LIB148-036-Q1-E1-F3
ctcacgggtcgatacacgcgtctacatccatccgtatgagcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaaggcgttcatc

SEQ ID NO: 7291 - DNA, 429 bp, Zea mays
  Clone ID: LIB148-036-Q1-E1-F4
gtcgatgcacgcctctacaatgagatcgctactacccgtcgacgccggcctctctcctcacccgctcggagagtcggagcccggcggccggagggcgacgtcgtccctaataaatactaataatttatcactatgcataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccat

SEQ ID NO: 7292 - DNA, 349 bp, Zea mays
  Clone ID: LIB148-036-Q1-E1-F6
tcgtgggacgatgcaagcctctacactgacgtcctgctaacgcgtccggtcaactgcggcctcagcttcggggactggatggcgcccgacaagcccaacccaaacgagctcaccggcgccatcgtcggcgggcccgacaagaacgacggcttcgtggacaagcgcggcaactcctcctacaccgagccctgcacctacatcaactccctcgccatcggcccgctcgccgcgctcgccgtccgaggcgtgcagctcgtcgccacgcagtgatctatccccatgcgtgcgtgtgtgtcccgctgtttcgtttcttccctgacatgatatgatttctactccgttactgatg

SEQ ID NO: 7293 - DNA, 419 bp, Zea mays
  Clone ID: LIB148-036-Q1-E1-F7
ctcgtgggtcgatacaagcctctacaggcaatcttagtagcgggaaggacgacggccacgatccctccaaggcggacaagggattccacggaggagggtacccggccgccggtggatactacggcggccagtaccccggcggcggctaccctgctccaccgggcggcggtgcgtaccctcccgggcctgggtacccggtaccacctggtgggtacccgcctccgggtggctaccctcagcctggcggatacccgccgtcgcacggggcgtacccggcgccgggtgcaggcgcgtatcctcccagcgggtacccccatcaaccggtctacccacagcctggctatccatcgatgcccggtcatggtggcatgtacggaggaggccacggtgcagggggctctgcaggccacggggcgatg

SEQ ID NO: 7294 - DNA, 431 bp, Zea mays
  Clone ID: LIB148-036-Q1-E1-F8
ctcgcgggtcgacccaagcctctaggctgacacgcatgagtcaacgatcgagatcgacccggggcacgacggcggccgacggcggcgaggagggagacgatcgatccaagaggaggtgtatccgtgcgtacgtgtgtgcagcgagcagctagggcatatgcattatttcagaagagaactagctactccgatcaagatgagcgacgaaggattgtacgtatattgctgagaggagatcgaagagacggtgatgagttggcggaagatcgatgcatgcgtggatgatcatcacagccaatcgtacgtgtgtaaaaggtcggccggaggggaataatcgtgcatgagacacctctctcgctcgctcttcctctcctacgtcttaattcattgggttcgtcgatccgagatcctacgtacgtcgtcgtttttgt

SEQ ID NO: 7295 - DNA, 429 bp, Zea mays
  Clone ID: LIB148-036-Q1-E1-F9
ggtcgagcccgcgtctgctcggcagcggcgccatgggcaccgtgttcctcgtcgcggaggggccctcggccttgcgccccagccgctacgccctcaaggtcttcgacaagcgctccgccgcccgcagcaggaagcctgacgccgaccgccgcgcgcggtgggagatcagcgtgctctcccgccttgcgcacccgcacctcccctcgctcctcggcttcaccgagacggacgaccttctcgcgtgggccgtcccctactgctccggcggcgacctcaacgagctccgctactcgctccccgaccgcatcttctcccccgcggccatccgcttctacattgccgagatcgtctccgcggtcgccgagctccacgccgcgggcgtcgtgtaccgcgacctcaagcccgagaacgtgctcctccgcgccgacg

SEQ ID NO: 7296 - DNA, 426 bp, Zea mays
  Clone ID: LIB148-036-Q1-E1-E4
acagagctcctgactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggagagatttggagattttacaatatcatggctaccgttttactcagaagcaaaggtgttgttctttgtatatttgtggtaccctaagacaaagggaactacgtatgtttatggaactttctttaagccatatatttct

SEQ ID NO: 7297 - DNA, 420 bp, Zea mays
  Clone ID: LIB148-036-Q1-E1-D11
ggtcgatggacgcctctaggatgagtcgcaatacgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgccagcaccg

SEQ ID NO: 7298 - DNA, 437 bp, Zea mays
  Clone ID: LIB148-036-Q1-E1-D12
actcacgggtcgatgcacgcctctaatctgaatcgtaggaaggaagctcgtctccggcacgatccccgacgccgggaccatccacgcgcacggctcggagaccgtcaccatccccttcctgctggtctacgacgacatcaggagcacgtacagggagatcgagcccgggagcgtcatcccctacaaggtcagggtggtcctccacgtggacattcccgtggtcgggagggtctcgctcccgctggagaaggacggcgagatcccggtgccgtacaggcccgacgtcagcgtcgacaggatcaagttcgagcagttctccttcgaggagtccaccgcgacgcttcacctgagcctggacaacaggaacgccttcgacctggggctcaactccatggactacgaggtgtggctcggcggcgtgagcatcgcgtccgctg

SEQ ID NO: 7299 - DNA, 423 bp, Zea mays
  Clone ID: LIB148-036-Q1-E1-D2
cggacgcgtgggcggacgcgtgggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccggc

SEQ ID NO: 7300 - DNA, 455 bp, Zea mays
  Clone ID: LIB148-036-Q1-E1-D4
ctcacgggtcgacacacgcctctagcatccatcgtcatgcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgca

SEQ ID NO: 7301 - DNA, 411 bp, Zea mays
  Clone ID: LIB148-036-Q1-E1-D5
ccacgcgtccggggagaccgtcctcgaccgcattgaccccgccgtggcacggcctcgaggccggcgacgacgcaggcgcgaggcgccggagggtccggccatgacgtcgtccgtgcggcagtggtggcgccgcgccgccgctgcgctcaaggacaggaggagcctgctcctggcgcgcctgcgcccgcgccgggccgggtcgtcgtcgtggcaccaccgggagctggaggcggccgtgatccgcgcgacgagccacgaggaccggtggatggactaccggagcgccgcgcgggtgttcgcgtgggcgcgctcgtcgcccacgttcatccggcccgtcatgtgggcgctggcgcgccgcgcgcggcggacgcggtgctgggtcgtggcgctcaagtcgctcatgatcgcgca

SEQ ID NO: 7302 - DNA, 430 bp, Zea mays
  Clone ID: LIB148-036-Q1-E1-D6
cccacgcgtccgtccacctcaacatcttcgagtgcaagaacgtgctgatcgacaaagttacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgacca

SEQ ID NO: 7303 - DNA, 432 bp, Zea mays
  Clone ID: LIB148-036-Q1-E1-D7
ctcgtgggacgatacaagcctctacaatcaatcgtaggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatg

SEQ ID NO: 7304 - DNA, 415 bp, Zea mays
  Clone ID: LIB148-036-Q1-E1-D8
taggacgagacggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctca

SEQ ID NO: 7305 - DNA, 401 bp, Zea mays
  unsure at all n locations
  Clone ID: LIB148-036-Q1-E1-D9
ggcggaggacccgccgcggtggcggaaatctgcataaaaactccttcccccaacctgtgcacaggacggcggggaagcacgccaacaagtacaaggtggtggacgcggtgacggtgctagagatgcangtggacgcgttcaagaagcgcgtgaaggcggcgcggaggctcgccaaggaggaggtcaagacggccgcgacgcccgaagcgcggagggcgctgaacctctgcaagacctactacctggacgccgccgacaacctcggcgcctgcaagcgcgccatcggcttccgcgacgccgtcaccatccgcgccacgatgagcatggtggcgcaagacacgcagaactgcgacgaagagttcaagaangccgtctccaagaaccccatggaggaccacaac

SEQ ID NO: 7306 - DNA, 256 bp, Zea mays
  Clone ID: LIB148-036-Q1-E1-E1
gtcgatacaagactctagactcactcatgctaaggaagagacgaaggggagagagagtgacatggctgcgcgcattccgatgcgtgggcatgttttttgattcgacacaccttttgtcctctttttctttgttccctctttctccttaatttaacgaattgatgcatgccgctgatgttcttcccctgagagagggattaacacttgtatcatttcatcgcttgccatttgtttgaatccattcaacaattcattc

SEQ ID NO: 7307 - DNA, 186 bp, Zea mays
  Clone ID: LIB148-036-Q1-E1-E11
agtcccgttgttgtcccggcggctatcagcatcgcgctagctgtgggggcagtcttggcttcggggttgtttgggctggggggtctaggctcggtctcaggggtcctgggcgtactcggtgggactagtggtactgtgggggggggggtgggcgacgctaagcgccgtgtggctgacgcattaggc

SEQ ID NO: 7308 - DNA, 422 bp, Zea mays
  Clone ID: LIB148-036-Q1-E1-E2
tcacgggtcgatacacgcctctaaaatcagtctcactacttcttctttctatatacatatatagacctaataagaacagagacgtacgataacctgcttattttgcgacccatcccgttcccacgcaaaggcgccgagcgtgatctccgtccgtgccgccatggcctcgcaccgggcgctgctgctgctgctcctcgccgccgcgctcgtcgctgcgctggcctctgtcgcatccgccgacgacgccatcgccatgcccatcatcctgacccccgtggcgcataccccgctggggtccttcgacggcgacaagccggcctctgacgacgacgccgtcgacgacgacgaggacgccgcccctgtcggcgcgcccaacggggccaccatgactgagcccaaggacgacgtccccgccgcgcccg

SEQ ID NO: 7309 - DNA, 429 bp, Zea mays
  Clone ID: LIB148-036-Q1-E1-E3
ctcatgggtcgatacacgcctctagactgattcgcaccaaggtggcctgtgggcgatcgtcgtcgtcgcggtggtcgtcggcgttgtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaaggccagcgactccatgaccgagagcgcgcgagaggactgcaagaagctcctcgaggacgccgttgacgacctcaggggcatgctcga

SEQ ID NO: 7310 - DNA, 389 bp, Zea mays
  unsure at all n locations
  Clone ID: LIB148-036-Q1-E1-D1
gagacttgggaggcaggcgacatgggtggcgggaaggacgacggccacgatccctccaaggcggacaagggattccacggaggagggtacccggccgccggtggatactacggcggccattaccccggcggcggctaccctgctccaccgggcggcggtgcgtaccctcccgggcctgggtacccggtaccacctggtgggtacccgcctccgggtggctaccctcagcctggcggatacccgccgtcgcacagggcgtacccggcgccgggtgcaggcgcgtatcctcccagcgggtacccccatcaaccggtctacccacagcctggctatccatcgatgcccggtcattgtggcatgtaccgaagaggccacggtgcanggggctc

SEQ ID NO: 7311 - DNA, 391 bp, Zea mays
  Clone ID: LIB148-063-Q1-E1-F1
gcgtcgcgctcggggctcggagttatagtctacgattggctagacattccttggctgaagaattactacaattttggttttgaccactatgagatgtcgtggaggaaagtaggcttttcaggtctaattaatctactgctggggcacacgggcccatttgccagcggggattggattctacctgacctcacaatccaaggatccatgaaactaaactctacacttaggacctttcccaatacattctacttcagctatgctacaaagaaaacaagaaaaatatttggaattacagttccttcaagtgttcttggagtgcaccccattctctttctgagagtcctccagatgtgtatgtggcggcaaccttcaaaatgcacctctgccttac

SEQ ID NO: 7312 - DNA, 324 bp, Zea mays
  Clone ID: LIB148-063-Q1-E1-F10
agcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaagaccaccggcgggctggcccggaagttccacgttggggatggccccaaccaagaagccggcgaactcctcaaccccaagaagggcaagctccgggaagccgttaccccggccccggccctgtggattaacttcgcgcgcgaaatgggga

SEQ ID NO: 7313 - DNA, 91 bp, Zea mays
  Clone ID: LIB148-063-Q1-E1-F12
gacccacgcatccgaccacgcgtccgcccacgcgtccgcggacgcgtgggcggacgcgtgggcagcgatgaaaaaagttaagcgtaacaaa

SEQ ID NO: 7314 - DNA, 400 bp, Zea mays
  Clone ID: LIB148-063-Q1-E1-F3
gcgtcggcccaggcgtccgcagaggaggagataaagatgttgttacaagcgggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggatggtcgcatcagttacccagagtttgaattgatgatgaaaagtggatcggactggaggaacgcctctagacgttactcaacagagaatttcagcagcctcagtcaaaaaactgtgc

SEQ ID NO: 7315 - DNA, 426 bp, Zea mays
  unsure at all n locations
  Clone ID: LIB148-063-Q1-E1-F4
gcgtcggcccaggcgtccgcatcgcaatcgcacaccgcctcnccgtgtcncctccttctcgcccggcaccgtcgagctcggctgtggaaacagaacanacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctc

SEQ ID NO: 7316 - DNA, 484 bp, Zea mays
  unsure at all n locations
  Clone ID: LIB148-063-Q1-E1-F5
accacgcgtcggcccacgcgtccgcacacgaatccgcttgattcagttttggaaacatctcagcatgttggaaggtcgtcagtgtcaacaaaccaggatctgcctttcaaggacgtagccaaccaatgtgaagcacttctgattgggaagcagcaaaagctatctgcgtgcatgagtgtctgtgaaaaagaggctggtgaatcttccgtcgagcagtcatctcggcaggatcctcaagcagatacgtttctctgcacagctgatgaacaatggcaccccaattcctgtaagctgccagcgctgtgtcnctacgaccggttccttgcaacgtctgggtgctaagatgatctcttctgcgatgtggatctctataaccaagaacgtgttcagtggacgcctaannaattggtggttccagagctcatgcatgctaaaatatgtgctgtcgtgtgtgagtgcagatgacatgatttccctgttttgg

SEQ ID NO: 7317 - DNA, 484 bp, Zea mays
  unsure at all n locations
  Clone ID: LIB148-063-Q1-E1-F6
ccacgcgtcgggcttatcgtggtctgtacattgggctctatgattccatcaagccagttgtccttactggcaacctccaggacaatttctttgccagtttcgctctgggttggctgatcactaatggtgctggtcttgcatcttaccccatcgataccgtccgcagaaggatgatgatgacatctggtgaggctgtcaagtacaagagctccttggacgcgttccagcagattcttaagaaggaagggcccaagtccctgttcaagggtgctggtgctaacattcttcgtgccattgctggtgctggtgtgctttctggctatgaccagctccagatcctcttcttcggaaagaagtacggctccggcggtgcttaaatggagaaatatgatgacgaacaagagcagtgtgtgttcncggtcctttccaatcanggatctggtgaagtttttgcctttcatatcgaagaaattaataattcatg

SEQ ID NO: 7318 - DNA, 276 bp, Zea mays
  Clone ID: LIB148-063-Q1-E1-F7
accacgcgtccgactgtcgacgacggagggaacagggaggaggagtctggctcacatttctccttactgtcacgtcttcagtatcctttctttgccattttcgctctgggtaggttgatgactaatgttaatggtcttgcattgtaactcatcgataccttccgcagtgggaggatgatgacatctggtaaggctgttaattatgcgagggccttggatccattccagctgattcttactatggattggcccacgtacctgttcaatgctgctagt

SEQ ID NO: 7319 - DNA, 489 bp, Zea mays
  unsure at all n locations
  Clone ID: LIB148-063-Q1-E1-F8
accacgcctcggccgacgcgctccgacgtcactgccttgtgggccttacgtgggcctcatggcttaaaatgccatgccccagcaactacacgagtcaacacaggcccggcccggcccggcccggcccaagaacccccatctctcgattcctccaacaaattcccctttcccttactccccatccccacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgngacaacgtcaagaagagcgccgaccaggccgtcgaccgctacatcgagaagtacatcgacacgagctcgccggaccctctctnacacgtctgcatcggagggatgatcttctcctacttcgtcaatctgccctgngaagcgcgccaactcgcc

SEQ ID NO: 7320 - DNA, 445 bp, Zea mays
  Clone ID: LIB148-063-Q1-E1-F9
acctccatctccagcatatgtgagtgaaccgcctccaacggtgaaatctccttcaccaccatcacctccaccgatgattaaatcaccgccaccaccggtgccggtgaggtcacctccatcgtcagtgaaatcaccacctccttcaccactgttaagttcgccgccgccaccagcgccggtgaggtcacctccaccgctaacgaaatcatcacctcctccaccaccgataaggtcgccacccccaccacaagcaaactcacctcctccatcagctctaataagctcacctcctcctccgatgcaatcccctccaccgcctgctccagtcagctcaccaccaccacctataagatcaccaccaccggctccagtatgctcaccacctcctctggcgcaatcccctccatcacctgctccagtcagctcactaccacacctgtaaaat

SEQ ID NO: 7321 - DNA, 369 bp, Zea mays
  Clone ID: LIB148-063-Q1-E1-G1
tccggaacgacatcgcgtcgggccgtgcgacgtctgctgcaagcacgccccatccacgcccgtcaaaaccacgctgctcgccaagaacaaggacttcgaggcgctcatgcgcgtcgcccacgcgctcatcaagcgggccaccggtggcgccggtgaccgccggcgccggcgcccgccgcccgcgccaagattcattaattgattattaattcgttgattaatccgcggagcgccatacatatctcgatccatattgtatttgtttgtttatagtatatatcgatgtggggtacgtttatatgtacctgccattgtcatttgattaggtacgttgttgcaaacttttaccacagtatttatcttcacatc

SEQ ID NO: 7322 - DNA, 286 bp, Zea mays
  Clone ID: LIB148-063-Q1-E1-G10
acaatacatcaaaagaaataaaaaacaataaaacaaaaaaaaaaaaaaaaaaaaaaaataaaaaagaacaaagcaaaaaaaaaaatccagaggcaagattctctaggaaggtcagcgacaaaggggcgtgccctctaaagtttgagggtttcaattccctggcctccaacttcttccgtctcctacggtgtcccccaagtccattccaagggcctcccttttaaaccttttggatgggtaaaccttggcctttccccactttaacccctttgccgtaccccctctt

SEQ ID NO: 7323 - DNA, 381 bp, Zea mays
  Clone ID: LIB148-063-Q1-E1-G11
aggcgatcgatctggagattccggggccctcctgcaaacggtgccggtcgggtagcagggggtgttctcatcacggtaagcgccgccggcagaatcggcggtccgaatctccaggaaccggcgattccacctcaacgactcccacatctgtgcgaagatggcgtacactcctttggataccctcaaatgggttgtaaaggaaatggagatgaactcggtcgaggttaggcagacggttggtcatcctaccaactcatcttatgaactccagcagcttattgacaagatcctagacttatcggattggttggacatggttgccattcaatgtgcataagttattaccaattacaacccaccccctcacccactacagaagag

SEQ ID NO: 7324 - DNA, 392 bp, Zea mays
  Clone ID: LIB148-063-Q1-E1-G12
acgccctcgttgcggtcgtccacatccttttctctcctcctcgccggcccaacctgaatggtcctccaccaagaaggaaaaagggagggagggaacggaagcatcaaccatgtccaactccgcgtccggaatggccgtccgtgatgaatgcaagctcaagttccaagagctcaaggcaaagaggagcttccgcctcatcgtgttcaagatcaacgagaacgtgcagcaagttgtggtggacaagctgggggggccaagaaaaaactacgacgccttcacggcctgcttccccgccaacgagtgccgctacgccgtgtccgattttgacttcgtcactgacgagaactgccagaagagcaagatcttctttatctcttgggccccggatacat

SEQ ID NO: 7325 - DNA, 264 bp, Zea mays
  Clone ID: LIB148-063-Q1-E1-G3
gcgtcggcccggccgcggcaaggtcgaggggatgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaaatcattgtaatgggagttatatatataactttatctc

SEQ ID NO: 7326 - DNA, 399 bp, Zea mays
  Clone ID: LIB148-063-Q1-E1-E9
aagagtccggtgccttgtttcacatgacaaattaagtctcaagggtcttgatgcctgtatgaactcaagatttatggtggatcctggaactgtgggatgccaaacctgggctaactaccacattatgaactctctgctgatctaacagcatttctacaaaaattcttttgccggaaggttcattattcatgtgtaacaatgaacgaacatctactgcttaagattggtgacctacgcattcttgacccgaactaggtcattgggacagtcatgaagtactcaactggggaaaccattgcacatccaatctccatggcgcaatccattttaacagtgggacaaaggatggcttctgatgcggcacctcatctgcaacttgtggagtgtcacatttgtcag

SEQ ID NO: 7327 - DNA, 445 bp, Zea mays
  Clone ID: LIB148-063-Q1-E1-D6
ccacgcgtcgggccaagctcgagcacgccaacgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaccagtaaactataccacggcggcgtcgcggacatgctgcacaaaactacaacgatacagagcgaacgcatggcatggatagcagtatctacggaaagaaaaggaagaaaaggaaaattaaaaatgtatcagagtgcttgattca

SEQ ID NO: 7328 - DNA, 416 bp, Zea mays
  Clone ID: LIB148-063-Q1-E1-D7
accacgcgtcggcccacgcgtccggagagaaaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttat

SEQ ID NO: 7329 - DNA, 542 bp, Zea mays
  Clone ID: LIB148-063-Q1-E1-D8
accacgcgtcggccgtgtccctccttctcgaccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtcgccggacacctcgagggtcaggagcaagatgctgtacgcgagctccaagggacggttcaagagggagctggagggcatccagctggagctgcaggccaccgaccccagcgagatgagcatggacattgtcatggcgcgagctctctgaagaggaagacgcgcatccgctcgcgcgatcgccatgcatgcccc

SEQ ID NO: 7330 - DNA, 401 bp, Zea mays
  Clone ID: LIB148-063-Q1-E1-D9
accacccctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatg

SEQ ID NO: 7331 - DNA, 292 bp, Zea mays
  Clone ID: LIB148-063-Q1-E1-E1
gcgtcgggcgggaccacgagtatccacatgaagcgcggtgtctgccggaggcgctggtcgtgcacgtggtcgccgctgatcgcgcagccggggtgcgtctcacgggctataacgctctgccgcagtacgacggtactgagcacgactacctggtctataggtcgccgagcgcgccgccgaggaccggatggtggccttcacgtacctgcgcatgggccccgacctcttcgacccggacaactgtcggcgcttcgctgccttcgtgcgccgcatgaacggcgccgggtcgtgc

SEQ ID NO: 7332 - DNA, 379 bp, Zea mays
  Clone ID: LIB148-063-Q1-E1-E11
accacgcgtccgcccacgcgtccgcgaagccggcgctccagctcaaccccgcggccgtcctcctccgccgcctgccgaccccgaccccaacagcggcgacgcccgtcaccgcgacggcgccccccgcgcggcccgccaccgcgtccaacccgctcgcggccttgctcgtccccttctggcgcgggctgcggcgagcgccgaaacagccggtccaccccgcctccgccgccgcggcgcggagggcggcggagcagcaggaggcggaggccgaggcggaggcgcggcagctggtggggtgcgcggtgccgctgttccggccgtacgtggcacagctgccgtggcacggcggcgcccgggcgtggctgtcgaagctgttccc

SEQ ID NO: 7333 - DNA, 447 bp, Zea mays
  unsure at all n locations
  Clone ID: LIB148-063-Q1-E1-E12
aatggtattgtgattatatggcaataaaattttgaactgaatatccacattttttgtataggaaaagaaccattacatcactaggtcaccgtagcagaaggtaataatagtacataatacaaacatgataacatggaatgcaaaaggtacaggatttctacaactaagccatctgtttctaacatgagtagaagaaatgacaggacaggtaaacaaacctctgcagagactgcaactgcatcaaaccagtggtcacatttcaaggcctgcagaagtggccgtagacgggtatcaaaattggagaccactgcagttttaacaccagctttcctcanagctttgaatacattttcagcatcagggtcacaaagcttcgaggcctancangcataataatcttctcgttagtcgagttgaagtcagagacaacgaaagaatgttgttttg

SEQ ID NO: 7334 - DNA, 441 bp, Zea mays
  unsure at all n locations
  Clone ID: LIB148-063-Q1-E1-E3
ctgggcggacgagtgggatcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgnagtggtcttggtggagagcccgcgcagngactg

SEQ ID NO: 7335 - DNA, 483 bp, Zea mays
  unsure at all n locations
  Clone ID: LIB148-063-Q1-E1-E4
cgcgtcggcccacgcgtccggtcgccaaattcattcgatcgaattaggcgccttcttcgtcncacgctccgtctttatttgtaatctgaagcttacaggaacatttgagtggatcatggacggattggtaggcctcttgaaagtccgggtggtgaggggcatcaaccttgcctaccgcgacgcaagaagcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaagcggcgaacgcgagcccggaggcgagcctgangaacggcgccatcatcctgtcggtgcggccgagcgccacgaactgcctcgc

SEQ ID NO: 7336 - DNA, 362 bp, Zea mays
  unsure at all n locations
  Clone ID: LIB148-063-Q1-E1-E5
accacgcgtcgggcgatgcgtcggcactgcagacccggagggtaatcattcnagtgcagcggcgtcatcgacatcagctacgggagccccggcggtaacctatcactatgacacctcatgcattccacaagtctcagttggactagattttgtgcgttaaccatgtttgtaccgcaattatgagtactgctaatgactaacacaacatcatgcggactaaggcctgttgtaggtaaagcagcagctgtgacagatctcatgacaaatggtcgatgcaggatatgtgctgactgtcgtgcacctgatccgaagtggagcatctactaatattggagtgttgctctgcttaatatgtgcagatg

SEQ ID NO: 7337 - DNA, 555 bp, Zea mays
  Clone ID: LIB148-063-Q1-E1-E6
cggaatcacggcccgaccacgcgtcggtcctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttcccgggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgccgacggggcagacggtgctgtgcgggaaacagccgctgccccgggccgggtgcacgagttcgcgcggcagcagatggactacctgctggggcgccaacccgcggcacagctcctacgtcttgggcttcggcgccaacccgcccaagcagccgcacaac

SEQ ID NO: 7338 - DNA, 414 bp, Zea mays
  Clone ID: LIB148-063-Q1-E1-E7
gagctgctgtgggccgcgacctgactgtacctggcgacgatgcggcatgtgtacgcggacttcatcgcccacgaggccatctcgtcgagcgtggccgacttcagctgggacctcaagttcccgggcgcacaggtgctgctggccgagttcatcatgacctcggctgtcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtatgtgaccagcaccgcgttcctgctggtggtgtacgcggacctgctggctctgacggggcagacggtgctgtgcgggaaccagccgttgcccccggcctggttgcagcagttcccgcgg

SEQ ID NO: 7339 - DNA, 500 bp, Zea mays
  unsure at all n locations
  Clone ID: LIB148-063-Q1-E1-E8
ggaattcatcggacgaccacgcgtcggcacatctcttgccacctcattcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcangacgccagcgacacgctgatcacgctgcacaagcagggggagcagatagccggacgcacgagaaggccgtcgagatcgacaggnactcgcaagagcgagacct

SEQ ID NO: 7340 - DNA, 478 bp, Zea mays
  Clone ID: LIB148-063-Q1-E1-D5
accacgcgtcgggccgtcgcagaatcgcacatacgcgcgatcgagaagccaggaccaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatctcccacgagtccgcctcttccgacaacgccgagtccgccgcgttcaacgtgaactcggacaacgtcatcgt

SEQ ID NO: 7341 - DNA, 409 bp, Zea mays
  Clone ID: LIB148-063-Q1-E1-C12
agatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatc

SEQ ID NO: 7342 - DNA, 360 bp, Zea mays
  unsure at all n locations
  Clone ID: LIB148-063-Q1-E1-C2
gcgtcggacagaatcgcctaattctatcgatcgaattaggcgccttcttcgtcncacgctccgtctttatttgtaatctgaagcttacangaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaagagctaactctgaccgtcacagatcccagcctagctctgaagctggaggtgttcgacaaggacacgttcagcaagggacgaccgatggggg

SEQ ID NO: 7343 - DNA, 187 bp, Zea mays
  Clone ID: LIB148-063-Q1-E1-C3
gccgggccttctgggcaaagtcagaaactcgaatgttccgatcgctattgacgagccgatggcacatgtgactatgcaggacggccctcagtagcaggagacgcaacggatcttcttcacagatttcctaccaggtctcacgcccatcgacaaactgctgtacagcgactgacacgaccttgggtac

SEQ ID NO: 7344 - DNA, 373 bp, Zea mays
  unsure at all n locations
  Clone ID: LIB148-063-Q1-E1-C4
tttctcctcctcaactttctccttttcttgccacggcaaaacaccttcgccggcgagagcatggcgatggcgtaccgtgtcctgnaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttcnccatcccggctgccgctgacacccgcggcctcgcactccacgtgaggctccgcgcccagcgtctatacctgngcgatcgcgacatcggcgaagtgttttgtgccatcgacgaactcc

SEQ ID NO: 7345 - DNA, 437 bp, Zea mays
  unsure at all n locations
  Clone ID: LIB148-063-Q1-E1-C5
accacgcgtcggcaagatcactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctnagacctccatcgactgacccatctctctagttataatttttctctcgtccttgcattgcccattagatgctatccattggtaacgcacaacagtaaaacgacaga

SEQ ID NO: 7346 - DNA, 382 bp, Zea mays
  Clone ID: LIB148-063-Q1-E1-C6
ggaatcatggaacgaccacgcgtcgggcaggggaaggaggagaaacagaccaccagatcgatcgagacctcgccgtcgtccggcagggttaatttggttcttctccggccgggtgtgcatggcaaaacgacccacggtgcccaagttcggcacctgggacagcggcgatgccgggtacacggcctacttcgacaaggtgcgcgagaacaagggcgccacggcgccgccgctgcgccggccgcgcagccccaacgaccccgaccccgaccgcgagcccgagccagaggaggggccaatgaagagagtccccccgccgtcgtcgtccaagccggcgaacgccggagccaccgcgagccgccgccgccggagcggccccacgggc

SEQ ID NO: 7347 - DNA, 538 bp, Zea mays
  Clone ID: LIB148-063-Q1-E1-C7
gggcattgcgagcgagcgttactctccgtccgcttccgccgtttgcccgtcgatcagttgttggctgccggccgggtactaccgcctgcacgagcagcggctagccacagcccacagacagacgacgtcaggtcttggcaggtgtgcaagcagacagagctcgctcggtcgccatgtctttcaccggcacgcaggacaagtgcaaagcctgcgacaagacggtccacttcatcgacctgctcaccgccgacggcatctcgtaccacaagacctgcttcaaatgcagccactgcaagggcgtcctctcgattagcagctactcttccatggacggcgttctgtactgcaagacgcacttcgaacagctcttcaaggagacagggaacttctccaagaaattccaaggtggaggtggagcatcttcaaacaagaacgacccggcaaaggctccgagcaagctgtcatctgcattctctggaactcaagacaaatgcgcagcctgccagaagaccgtgtatccattggagaagatgacgct

SEQ ID NO: 7348 - DNA, 436 bp, Zea mays
  Clone ID: LIB148-063-Q1-E1-C8
cggaattcatggaacgaccacgcctcgggacaagatggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaagtggatggcaatctgctggcgagcacggacctaagccagtacaaggaacatggtaattggatcgagattctacgcgtggataacctggtcatcaccggc

SEQ ID NO: 7349 - DNA, 430 bp, Zea mays
  Clone ID: LIB148-063-Q1-E1-C9
acgcggtcagagtcggagcagccgcggcgccgggaggtggctcggagcaacgacgtgatcgaggcggcacgcaccaagctgatgcagaagcgccagtgcagcagggtcaaggcgctcgtcggcgccttcgagactgtcatagacacccagaaggacgccgccgccggcaggccacaacacatctaccgcaagtcagcttaaaacatactgcggcggcggggacgcatcgatcctccacgcttcgtgtcttcgccttaattaattaattaattgttatgatcatgtcggccagcccaacgccgtatgcatgcatgcacacggcgctaattaatccctgtttatttactactccgtgaaatgtagtttctccgtatacacggagcagtagtattctgtaaagaggaaaatggtggaaaccgatgttgcattc

SEQ ID NO: 7350 - DNA, 378 bp, Zea mays
  Clone ID: LIB148-063-Q1-E1-D1
cgacgtcgtcagcgaaaagaatgagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtctccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaacccgccgcatgcacccggagg

SEQ ID NO: 7351 - DNA, 357 bp, Zea mays
  Clone ID: LIB148-063-Q1-E1-D10
aatacgccaagcgcgccttcgtgcactggtacgtcggtgagggtatggaggagggcgagttctccgaggctcgtgaggatctggctgcgctcgagaaggactacgaggaggtcggtgctgagtttgacgagggtgaggacggcgacgagggtgacgagtactagacgctctactggcgcggcttcttcggccttgtgtgccactgctaccctgtgatctgccctgattggctccaatcgtgtaatgttccggtcggttcttatcaacctgtcgttgtgtggttaacaccttacgttgtaagactttattcccccgctttgcaactgggtaattaattttggcgtaatggttttcttg

SEQ ID NO: 7352 - DNA, 414 bp, Zea mays
  Clone ID: LIB148-063-Q1-E1-D11
acccacccgacgcgacgattcctctcctccgcccgttcccaccgatctcacgctctctctctcttcctccgtcgcgtcgggtcggcgtcgccatcgccggccatgggttgcggtggctccaaggaggccgtggccaccggcaacaccagcgccggcagcaaggtcctccggaggaagccctcctccgtctccaccggcgcaagccacacatccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatcc

SEQ ID NO: 7353 - DNA, 381 bp, Zea mays
  Clone ID: LIB148-063-Q1-E1-D12
acaagtttcaacatgtcaaactttgctaacagggaggatctgcttggtcagagtaaaaaggcagatgacatgagcagagttgctgggttagataaccaagggattgttgtccttcagaggcaaattatgaaagagcaagatgagggtcttgagaaactggaagagacagtgctgagcacaaagcatattgcattagcagtcaatgaagaacttaccctgcacacaagattgatagatgaccttgaagatcatgttgatgttacaaattcacgtcttcagcgcgtgcaaaagaggcttgcaattctgagcaagcgcaccaaaggtggctgctcatgtatgtgcctgcttctatctgttgtcgccatcgtgattcttgcagtc

SEQ ID NO: 7354 - DNA, 260 bp, Zea mays
  unsure at all n locations
  Clone ID: LIB148-063-Q1-E1-D2
gacaccagatacgattcgcaagaccttcaacatcaagaatgacttcacccctgaggaggaagangagatccgcacggagaaacagtgggccttcgagtaaggaagtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaacttattaccatg

SEQ ID NO: 7355 - DNA, 445 bp, Zea mays
  Clone ID: LIB148-063-Q1-E1-D3
gcgtcggcccaggcctccgctcacgcatccgcaacatctgcgtcaagtccggcgcctccaaggtggccgtcaacgacgtcgtcttcatgaacatccacggcacctccaacacgccggaggccatcacgctcaactgcgccaacagactgccatgccagggcgtgcagctcgtcaacgtcgacatcaagtacaatggatccggcaacaataccatggccgtctgcaagaatgccatcggcaagtccatcggcttggcaaaggacctggcgtgcatttgaaccaattgactaacatgcatatattatgtactaggtttgtgcccgtgcgttgacacggaagttaaaaattactataacacagagatacatagcgataagtatcactatgacattcacaatccatgtggcacaatatcactgtaaccatctatgattgtgcattgcga

SEQ ID NO: 7356 - DNA, 458 bp, Zea mays
  unsure at all n locations
  Clone ID: LIB148-063-Q1-E1-D4
aggttgaaataattatgtatgcaaggcatgctatccgcaccgccttctgtctgtacaaaattcttgagtacaaagaacgtgatatacacactaccggttgcgctcatcctgtactcaacccactagcctggcaccatcagtcttcatggttgcaagtgtcctcaaggagaatagagaaaatctgttacaagaagccagaggactggatgatcttatcaggatattgaacgatgtaaatgggaacttagatgctaagaaagcttgcgctggagcattgaaacttcacaaaaaatacctgaaaaacgtacaagcanagaaaccttaaacgtgccatggaacacacgtccccaatggggctatcgttcacatttcaacatacacgaccattttctacacacaactttgagtgacgatttatcggacacaggtggtaatcgtctgacatgtcctgagataca

SEQ ID NO: 7357 - DNA, 334 bp, Zea mays
  Clone ID: LIB148-063-Q1-E1-C11
attgaacatcacgagcaggggcccgacacgcttcatcctcaccttcctgtgcaccgcaggtgacatgtcgaccatggtgtcaggtatcttgatctcaatgtccatcctctttaagaatagtgaacaggtaaatgaatgggcgttacctagattagacgatttacaggacatacaccttgctcgagctgccgtactaggaattcagcacggtgcaatcggccatcgaaacagtggccgacggtaaatcgcaatgggtaagcgtccagtaccggtctagtatgcacaggggctgtgttgtgaaaccggagagtagacgcttcatcttcgagagggg

SEQ ID NO: 7358 - DNA, 389 bp, Zea mays
  Clone ID: LIB148-036-Q1-E1-B4
tacagacacttgtggtaggtccttcgacatcatcacgttgggcgcctccggcaatgtcaagacagacagcacgaaggctgtgcatgacgcatgggcatcggcgtgcggcggcactgggaatcagacaatcctcatacccaaaggtgacttccttgtcggacaactcaacttcacaggcccttgcaaaggcgacgtgaccatccaagtggatggcaatctgctggcgaccacggacctaagccagtacaatgaacatggtaattggatcgagattctacgcctggataacctggtcatcaccggcaagggaaaccttgacgggcacggcccagccgtgtggagcaagaactcctgcaccaagaagtatgactgcaagatccttcccaact

SEQ ID NO: 7359 - DNA, 375 bp, Zea mays
  Clone ID: LIB148-036-Q1-E1-B5
tagagacactcggatgatcgtcgacctggagcccgttccggccatcagcaagcggcacggcggcagcgtcggctgcgaccacgcggcgccgtgcgccatggctaggaccatgtcgaccagcttcaaggagccaccttgtgtcgccgaacacctccctctctctggccccgtgcagctcgcggcgtcgaccggcttctcctgggccaagaagccccggcccgacgccacgacggccgcggtaactgtgatgatgcgcgaccggctccatgtggccagggaccatcaggtacaacatcagcggatgaggagacggagcatgaaccatctccggctccggcgccaccaccaccgccacatcagcggcggcatcatacg

SEQ ID NO: 7360 - DNA, 428 bp, Zea mays
  Clone ID: LIB148-036-Q1-E1-B7
ctcgcgggtcgatacaagcctctagaatgagtcatattaagggatgctgtccgattgccaccaggggaggatctcaatgaatggctagctgttaacactgttgatttcttcaaccaggtgaacatcctgtatggtactctaatggagttctgcacaccagctacatgcccaacaatgtcagctggaccaaagtttgagtatagatgggccgatggggtgcagatcaagaaaccaattgaggtttcagcaccaaagtatgttgagtacttgatggattggatcgaagctcagcttgatgacgaatccatcttccctcagaaactcggaaccccttttccacaaaatttcaaggaagttgtgaagacaatctttaagcgacttttccgtgtttatgctcatatttaccactcacattttcaaaagattgt

SEQ ID NO: 7361 - DNA, 416 bp, Zea mays
  Clone ID: LIB148-036-Q1-E1-B8
acccacgcgtctgtaaaaatcacattttaaagcagtaaattaattcaaatgaaaaagttttcaactacaaatttgtataactcatcatgatgtacattttatattttgaatatttcttcatatgataaactaaaaataaatttgttcataaaacctatatctctctcatagtttatgtaactacgagagatatgtataaaatttgtgcatattgttagaactatcatgtgagatgaataaatgatcaaacaaccaaaataaactttatagatcttgaaaagttatagaagtttgtagttgacaactttttcatttgaagtcatattgtcaacgaaaactatgcctgaatttaaaaaatttaaaatttgaattttgaaaacaacctcgaaagaaaaaaccaccaacatgaaagttgt

SEQ ID NO: 7362 - DNA, 410 bp, Zea mays
  Clone ID: LIB148-036-Q1-E1-B9
gtgtcgacggacgcctctaaagtgcatcgcatcagtgatccaccatgactcagtcaccagtgggcacgattacaactaattcgtggctcatcgtattagctgtggcgtccgcgatcgttgcagcgtcggctgccgacgccaatacaccgagcagagcgttcagcacctgattaccgatcaaccatgagtgctcaacactagtaccacagaagtccgtctcagatcgtaggtaggagccccttcactacagactgtctcgaagcgcaacatcgagagtcacatgattgatgaagtccacaagcacagggtaatagaccaatatctctgccgcgctaaaggatatcccggtaagcaacaccaatcgcctgatgttgcatttcaagacctgaacttacttacgctaaaaggta

SEQ ID NO: 7363 - DNA, 396 bp, Zea mays
  Clone ID: LIB148-036-Q1-E1-C1
tacggtgagccgctgtacgtcgcggctgcgtccagctccgcctggtgccgggactccgtggttttgggcatctgcttcgtctctggtcgatctgcttcatatacttctagatctgcgccatctccgttgctacgaccttgaccccaagaagtttgatgaggacttcaatatactaaactggtggcatgaacataagttgtcctatcctattctatctatcttagctagagatgttatttctgttcctgtctcaacaatttcctcagaatctgcatttagcctttgtggcaggataattgaggaacgacgacgtcgcctagcaccagaaatggtagagatgttactttgcatgaaagattgggaactaagagaagcaagagggcaacactctacaca

SEQ ID NO: 7364 - DNA, 408 bp, Zea mays
  Clone ID: LIB148-036-Q1-E1-C10
tctacagtaactcgtctgatcgctatgaagacaggacagtgggagggaaaaaggaagtcgttgaggcgatcaaggcaacagggcggtgcaacctgttcctcgtcggacagggcacgccctgcatgccgctggttgactggagcacggacagcccggagctcgggccggtgggtacttacctggcgctgccggaattctcgacggtggcatctgtgctggtcatgaaacagtacgatccgatggcgaagcacgacgacttcgtcgaggaggtggccgacatagcggtggacgttgacacgccgggccccagtaaccggggaaacaatactagcttccatgccggatgatacgtgctggtgttagatgtattattaacatgtcgagcagacaagactgattaacattatg

SEQ ID NO: 7365 - DNA, 417 bp, Zea mays
  Clone ID: LIB148-036-Q1-E1-C11
tacagtgactgcgcacaggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacatacttggtttcaagttctaaag

SEQ ID NO: 7366 - DNA, 431 bp, Zea mays
  Clone ID: LIB148-036-Q1-E1-C2
tgcaaacaccagttttctaccctaaacacaagaacccagatgcataataaaaggtgaaagctagcagaagaggtacctaactctaccctactatagagaaaaagtcagcacattgcaagcaataataatggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgagggaggcgtacaggcccgacccgtacaacgtcaccaacagcttcaacgccgccgtccacagagctgtcagcagcagtcggcgtgagatgcgggagaggccgaggaagcacaagaagaagggcccgttccggggcgacgaaacctatcgac

SEQ ID NO: 7367 - DNA, 430 bp, Zea mays
  Clone ID: LIB148-036-Q1-E1-C4
tcatgggtcgatacacgcctctaaaggtcgtcatcatagtgtatcaacttaagcagtgacaatcttctaaagaatgtcgaagaggactacttcacagctctgcaaagttcacctgccccagtataatgaagaaactgataaatatctaaaagggaacatgcaaatcaaggtgtaaatcttaacagtgccagaaatctggcagttttgggtgaggagattctacctgccatttttcggtttgtacataggagcctgtaacatttgtggttttttttatatgggccaggatagaacttctccattgtttgttcaaggcaagcagaattatcgcctgcatgttgtattttgtataaatgttcatcctttaactaaaactcagaagtgaagattgatataaagaaagaaaagaggaagaccagggaggagggga

SEQ ID NO: 7368 - DNA, 375 bp, Zea mays
  Clone ID: LIB148-036-Q1-E1-C5
acccacgcgtccgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgc

SEQ ID NO: 7369 - DNA, 437 bp, Zea mays
  Clone ID: LIB148-036-Q1-E1-C6
ctcgcgggtcgatacacgcgtctacgcatcggcatgccagcgctgccgtacaacctggttttggacaccgccaccgacctgacgtggatcaactgtcgtctgcggcgccgcaagggcaagcactatgggcgacagtcgatggggcagacgatgtcggtgggcggggaaggcgcgacggcggcgaagaaggaggcgagcaagaactggtaccggccggccaagtcgtcgtcgtggcgcaggatccggtgctcgcagaaggagtgcgcggtgctgccctacaacacgtgccagagccccagcaaggcagagtcgtgcagctacttccagaagacgcaggacggcacggtgacgatcggcatctatggcaaggagaaggcgacggtgacggtgtcggacgggcggatggccaagctccccggtctcatcctgggctgctc

SEQ ID NO: 7370 - DNA, 174 bp, Zea mays
  Clone ID: LIB148-036-Q1-E1-C7
tacacacacgttctggcaagcgggtggtacggcgtggccatgagtcagttagagagcgagcttgtgatggggagagttcttttgttggacggagagttcaaaatccaaaaatcttggtgtatgtacagttgtctatgaggaatactaacacgtcttgcagtgcttctgcctctc

SEQ ID NO: 7371 - DNA, 430 bp, Zea mays
  Clone ID: LIB148-036-Q1-E1-C8
taggatgcctcgcacgaagtgtccgatcctgcctaacaccaacttcacgtacaagtggcagcccaaggaccagatcggcagcttcttctacttcccgtccatcggcatgcagcgggcggcgggcggctacggggccatcagcgtggtcagccgcctcctcatcccggtcccgttcgaccagcccccgccggagaacgaccacgtggtgctcatcggagactggtacaccaaggaccacgaggtgctagcccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccgggatcaaggcgtcgctcaacttccgcatccagggccactac

SEQ ID NO: 7372 - DNA, 399 bp, Zea mays
  Clone ID: LIB148-036-Q1-E1-C9
ctctagactgactcgtatcagcccggcgcgctgctggtgatcgccttcctggcggcgcagctggtggcgacgtgcatcgccgtgtacgccaactgggagttctgcaagatgcagggcatcggctggggctggggcggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgag

SEQ ID NO: 7373 - DNA, 440 bp, Zea mays
  Clone ID: LIB148-036-Q1-E1-B2
gtcgatacacgcctctacatggaatcgtcatatagcttcgagaagccttggcccaatgctgcatccggttcagccgcaccaaggtccagacgtctataaaaggagcccaggtcactagggtttagttttgacgccccaccccggtgcacaagcggggacgagtaccgagaggagcacgacgatggcggttcccaaggggcgcgcacgacggctcccccaagcgcacgacggtgacggttcctgaggtgcacatgtggtggctgctctccaaggcgcatgttggcgacggttcccaagaggcgcgcgcggctggtcctcaggaggcacgaatagcggcggtggccagaagcatgcacaggcagcaacacctccctgttgtgagtgtgacagtaagggcctctacctcaaactattttcgagctccgacgaatcggacgcca

SEQ ID NO: 7374 - DNA, 407 bp, Zea mays
  Clone ID: LIB148-035-Q1-E1-H9
ggtcgatgcacgcctctacaatggctcgcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgaactcaacgcgtacaagaggaactgg

SEQ ID NO: 7375 - DNA, 403 bp, Zea mays
  Clone ID: LIB148-036-Q1-E1-A2
gttgaggttgcggcagatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctac

SEQ ID NO: 7376 - DNA, 382 bp, Zea mays
  Clone ID: LIB148-036-Q1-E1-A3
ctcgtgggtcattacaagactctatagtggtatccatgcagcggcatctccctcatcgatgtcaacgtggactacgccggcacgaacaacaaaaccatggtcgtctgcaccaacgccaagggcaccgccaagggaagcatccaggcactggcttgcctggtctgatgatgaccttccttttgcatgcatgcatggtatctcatccttgatgatgatctagctcattacttctttttaatttcggcttcattcgcttttccaaattcgattgtgtttcagccaagttgtttaacgggacatctcttgtcatatcttcctgctacatagacttggactcctatatatacaggccttccagcacatataacatacgtcggaccaa

SEQ ID NO: 7377 - DNA, 389 bp, Zea mays
  unsure at all n locations
  Clone ID: LIB148-036-Q1-E1-A4
cccacgcgtccgctgaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggangcatcaccgtgaagaagac

SEQ ID NO: 7378 - DNA, 406 bp, Zea mays
  Clone ID: LIB148-036-Q1-E1-A5
actcgcgggtcgatacaagactctagagcgggtcctatcaatctagacaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgc

SEQ ID NO: 7379 - DNA, 417 bp, Zea mays
  Clone ID: LIB148-036-Q1-E1-A6
ctcgcgggtcgacacacgcctctagacgcagtcggagaaagcggacggcgagctacccttcggacacgacgccgtcacgttttccttcttggtggcgtgcgtggccgccagcgtcgcgctcgcgtcgtccatgtgatcggcgtgcgaccgcaagccaaaggcggccaccaaagcggacccggctgggacggcctcatcgatctccggtggtagcggcagccatgaagctggcgcagaggaagcagcggtagaggaggaagtggtgaggctgtcgccggagctggcgatgcacggcgccatcgagccggtggcgctgccgtcgtcgacgtcgaggcggcggctgtccatcaacgtgagcaagaagctgatcctgaatatctcggacaagctgcggctgacccggcaggagcacaacga

SEQ ID NO: 7380 - DNA, 421 bp, Zea mays
  unsure at all n locations
  Clone ID: LIB148-036-Q1-E1-A8
caagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagttacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctgnggcgctacaaggacgagaaggacgtggaagacgtgcaggtgacggggtgcacgatcgccgggcacacgaac

SEQ ID NO: 7381 - DNA, 438 bp, Zea mays
  unsure at all n locations
  Clone ID: LIB148-036-Q1-E1-A9
ctcgtgggtcgatacaagcctctagagttaatcttattaagataaatgagatatacagatacaagacagaagaatactcccatgacgccactaacaaattcaacatttaccctgagcaaatcccttcctggcttgttgactggattcctgagaaaggaggttaccttatagggaatctgcagccagctcacatggattttaggttcttctctcttggcaacctttgggccatagcttcgtctctaactactccaaaacaagctgagggaattcttagccttattgaagaaaaatgggatgatcttgtagcaaacatgcccctgaagatatgcttccctgcaatggaagatgatgaatggcgcattattactggcagtgatcctaaaaataccccatggtcatatcataatggtggatcntggccaaccttattgtggc

SEQ ID NO: 7382 - DNA, 420 bp, Zea mays
  Clone ID: LIB148-036-Q1-E1-B10
ctctacaatgagtcgtattaagcgcgacgatgggatccctcgctaataacatcatggtcgtgggtgtcgtccttgcagcgctcgtcgccggcgggtcatgcgggcccccgaaagtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcg

SEQ ID NO: 7383 - DNA, 404 bp, Zea mays
  Clone ID: LIB148-036-Q1-E1-B11
gtcgttgcaccactctagaatgagtcgtattaatataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgccggcgcccaacatgaccgagccaccggccggctgggcctggtccatcaaccaggccaggtcgttccgctggaacctgacggccagcgccgcgcgccccaacccgcagggctcctaccactacggccagatcaacatcacccgcaccatcaaggtcatggtctcccgcggccacatcgacggcaagctccgcta

SEQ ID NO: 7384 - DNA, 375 bp, Zea mays
  Clone ID: LIB148-036-Q1-E1-B12
gttctacagcggcataacgaagctccgcggcaacgatgacatctccaagtggaggcagctgtggccaacagacgtcctggagtaagcatgaaccgcatcccttctcacaccgacattgatccatcgctcaaatgacacgcctttctttcatcatcatattgaccacattcgtcgtctctgtcgcgctgttgtaaacgggttagtagaagaacaaatcccgtagctggacaagggtgtaacacttactctctccgtttcgttttagttgtcgctggacagtgcaaaattgacctatccagctacaactaagaagaaacggatggagtaattgttaggcgtacaaggcgcagactgcttcccacttgttcgtggggc

SEQ ID NO: 7385 - DNA, 436 bp, Zea mays
  unsure at all n locations
  Clone ID: LIB148-035-Q1-E1-H4
taaagtgagtcgtcactatttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaccgacgggaacggcacgtacacgatcgagctcaaggacagccacgaggaggacatctgcgaggtggtcttggtggagagcccgcgcaaggactgcgaccaggtgcaggcggacagggaacgcgccggcgtcctgctcnacangaacgtcggcatcagcgacaacctgcg

SEQ ID NO: 7386 - DNA, 450 bp, Zea mays
  Clone ID: LIB148-035-Q1-E1-G4
cgggtcgacgcacgcctctagcgagagtcctatgactggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgcccgtcacatcggcgccacgatgagcatggtggcgcaggacacgca

SEQ ID NO: 7387 - DNA, 441 bp, Zea mays
  Clone ID: LIB148-035-Q1-E1-G5
tcgcgggtcgatacaagcctctacagtgcctcatccataagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcgtccctgc

SEQ ID NO: 7388 - DNA, 433 bp, Zea mays
  unsure at all n locations
  Clone ID: LIB148-035-Q1-E1-G6
acaaccccctagactgagtcatgatatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtnacaaattctgagtgctggattcttgctattgtc

SEQ ID NO: 7389 - DNA, 415 bp, Zea mays
  Clone ID: LIB148-035-Q1-E1-G7
cgcgttggtcgttacaacaccctagactgagtcgtactaccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttctgcaaga

SEQ ID NO: 7390 - DNA, 456 bp, Zea mays
  Clone ID: LIB148-035-Q1-E1-G8
actcgcgggtcgacacacgcctctagatcgagtccagctatggcggccaaggtgttcctcctcctccgactcagcatggtcgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccgg

SEQ ID NO: 7391 - DNA, 413 bp, Zea mays
  Clone ID: LIB148-035-Q1-E1-G9
ctcacgggtcgatgcacgcctctagccgcagtcggcgaagcgcacagcgccaccgaattcctcaacatcttcaagccgcggaacgagcacgactacttccacaacgcgaaccaggaggaggatgtgatgccccgggccagcgaccagcagaacctcataacggcgccggtgaccaagagcggcctcatgaaggtgccgccccggtccgcgcccaccgcggttgcgcaggacacggtggtgctccccgtggacaacgccgcggggttccccggcgcttggtccatcatcagcgagaacgcgggcgtgtccgcgatgcacctggtgatcatgcggagcgacaaggccatcatgttcgacacggtcaccacggggccgtcgctgctgcggctgcccaaggggaactgccgcctcga

SEQ ID NO: 7392 - DNA, 405 bp, Zea mays
  Clone ID: LIB148-035-Q1-E1-H1
ggtcgatgcaagcctctacacagcatcatgcaatgaggaaggagatcgagaggctgaggcaaatctaccaccagcagagcctgaagagcggcagggagcccgacgcggccccgtcggtccgcgacgacaaggacatgatcggcagcgaggggaccgccgcgcccggcccgccctcgtgatgaggaggaggtggtggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggtttgggttgggttggt

SEQ ID NO: 7393 - DNA, 407 bp, Zea mays
  Clone ID: LIB148-035-Q1-E1-H10
gtcgatgcacgcctctacactaagtcgtatcagctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtt

SEQ ID NO: 7394 - DNA, 433 bp, Zea mays
  Clone ID: LIB148-035-Q1-E1-H11
tcacgggtcgatgcacgcctctacattgactcctactatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccgggcagtgcaacatgggggggc

SEQ ID NO: 7395 - DNA, 384 bp, Zea mays
  Clone ID: LIB148-035-Q1-E1-H2
tcgttgcaccaccctacactgattcgtagtaggtcaggcccttctgctgggtcgtcctgctgcatgcgtcgccgtggtcggggacacagaggaggagatcgagggagatggagtgcctgctggggctgctcaaggttatggtggtacaatgagtgcacctgaccatctgcgacgccctcacccacaccagcgacccctacgtcttcctccgcctcggacagcagacagtcgcatcaagtctgtcataccccatgatcgatctgctgcaggacgagctgctcatgctgttgtcccagtccatggcgacgtcgtccggggatgagcactactacctgagcatggccaccgcctacgagaacgccgcgggcgccgtcatcgcggcga

SEQ ID NO: 7396 - DNA, 384 bp, Zea mays
  Clone ID: LIB148-035-Q1-E1-G11
acccgcgggaggagagtctgaggaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttccctcctggtcctgctcctgctgctgcaacaaccaggtgacctgatgatcgatggtagctgctgttcctgtcgccattgcctcctgctggcaggaacaggaactctctgaagcacggggtcagggtagttcatgttgcttcgattcgatcgtaggggagataatgccggatggctttgtaaagtttgggaggacatgcat

SEQ ID NO: 7397 - DNA, 464 bp, Zea mays
  unsure at all n locations
  Clone ID: LIB148-063-Q1-E1-A8
ggaatcacgggacgaccacgcgtcggccgacgcgtgggccgaggactangaggcgtagcgctgtgcagggcgcgagcgcgttcgttcggcatggaacagaacgccggctcgttcctcgccgtgcgtcgcctctccggtggcgccatccaccaccatcgtcaccactcttccccggctgaggtcgtgggcgtgtccactgcgtggctcggtaaggggctttcatgcgtctgcgcgcagaggagggagagcgacgtgcgcctgtccttcgatttgagtcccattcaggaagagtgcttgaataggttgcagaaccggatagaggtgcagtatgatggttcaaatctggagcatcagaaagcactggaagccctttggcgttcctcttttcctggaactgaacttctagggttagtatcagaccagtggaaggagatgggatggcaagggaaaagatcatctacaga

SEQ ID NO: 7398 - DNA, 376 bp, Zea mays
  Clone ID: LIB148-063-Q1-E1-A9
aacgagatcaagggctaacacctctccggcgcggacaacgacggccacgagggtgacgcatgtgcgcaaagaacgggtttccccgagttcaagagtgaggagatggcgaacatcatgaacgacttcgacgacccacaggacctcgcaccaacaggcctgttcctcgggctgacgaagtacatggtcatccaaggagaacctggtgctgtcatccatggcaacaagggatcaggaggcatcaccgtgaacaatataggtcatgcactcgtggttggcatcgacgatcagccgatgacgcctgcgcaatgcaacatggtgcttgcaacgctaggcgactatgtgcttgaacaaggcatgtgactactacgtagcagct

SEQ ID NO: 7399 - DNA, 356 bp, Zea mays
  Clone ID: LIB148-063-Q1-E1-B1
cgcgtccgcccagatccagtcgtcgcaaattgacgcaacgctcaagcccgagccgccgcagtcgcaccggtggtcctcgtcgtcgagaggccacgagcacggcgagacgccgcgggtggacaacttccgctcgccgttcgcgcgcgggggccccgcgaacacgcgcaagtcgtacgccgacctcagccacatgtccatgccggactcggccgacatctcgtttgtcagcagcaccggccgccggagcgtcgaccaccacccggcgatcccgccgcggatgtccaacggctccgtggacagctacgaccacagcttcgagatgtcacgcacgcccagcaagtggggcggcgactcct

SEQ ID NO: 7400 - DNA, 385 bp, Zea mays
  Clone ID: LIB148-063-Q1-E1-B10
aggaccagcagcgcctcatcttcgccggcaagcagctggaggatggccgcaccctggcggattacagcatccagaaggagagcactctccacctggtgctccgcctcaggggtggcatgcagatttttgtgaagacattgactggcaagactatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcaggggtggtatgcagatctttgtgaagaccctgactggaaaaaccataac

SEQ ID NO: 7401 - DNA, 414 bp, Zea mays
  Clone ID: LIB148-063-Q1-E1-B11
aagcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaacgacctgtgcccgcccaaggacaagtggtgcaagccgccgc

SEQ ID NO: 7402 - DNA, 432 bp, Zea mays
  Clone ID: LIB148-063-Q1-E1-B12
aatcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaatttttttcctttctattcttctactatactactactatctgtttgtcgcgttgaattcttctcatacat

SEQ ID NO: 7403 - DNA, 319 bp, Zea mays
  Clone ID: LIB148-063-Q1-E1-B2
gtcggcccacgcctccggggagacacgcaaccgccgatggcgaagaagcacagggacccagcctctgaggccgcgagcggcgactccccggccgcgtccatccgctccctcttctccgcggacaacccgttccgccggaaggcctctacggaggagccccccgcgactcctgcacccgccacgacgcccctccccatgcaacccagccgtgacgccagggatgccgagccgtcctcgaagaagaataagaagagcaaggaggatggcccgcggcgcaagcggaagcgggacgagttggaggccggccgggagcggcggc

SEQ ID NO: 7404 - DNA, 432 bp, Zea mays
  unsure at all n locations
  Clone ID: LIB148-063-Q1-E1-B3
cttgcaccctagcctgagtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgccgaggtggcgtcncctgccgctgatgggcctgctg

SEQ ID NO: 7405 - DNA, 294 bp, Zea mays
  unsure at all n locations
  Clone ID: LIB148-063-Q1-E1-B4
cgtcggaccgangtcactatggtcaaacattagagttcggcagtatcagcttcacgagggaaatcataatgcggcacacgtcgttccggtcaagaancatttgaatagtgtcaggaccctgttgccatgctttgcgaaactgaagctgttcatgcgcattgtggatttcgagccatctgggtggcgccatcatgcataagacatcgaattgcctcacaactaatggacgttgcaaagagtaccttctgcatatgcaagactttggggatttcacaatctgctttcgctcgtccg

SEQ ID NO: 7406 - DNA, 182 bp, Zea mays
  Clone ID: LIB148-063-Q1-E1-B5
cggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccaacgcgacttctacggcgggcgggac

SEQ ID NO: 7407 - DNA, 403 bp, Zea mays
  unsure at all n locations
  Clone ID: LIB148-063-Q1-E1-B6
cggaattacggaacgaccacgcgtcgcgcgctccgaaggggaagctctgataacatcaccgttgtcatcgtccgcttcctatatggaactaccggtgataaatcaggcgcagacaaagagaccaccaatgaccaaaactcctaattgcctcctgtagggatccatcatgcgtgtgttttcttctggctgttgtatctgatgctcaaagtagatgctccgtgtgtcttccgcaaggaaactgattcccccgaccgtcgtcgtgatgctgcccgctcatgctcgtagacgggaatgcctgccgcagaatgacgaatanggctggtgtgtgttatactatgagggccctcctcgnnncccccacccgcngcgtggacagccccagcgggtgcaagcccagcgcggc

SEQ ID NO: 7408 - DNA, 475 bp, Zea mays
  Clone ID: LIB148-063-Q1-E1-B7
cggattatcggcacgaccacgcgtgcgcccacgcgtccggaaacaagcacatagaaacaaatacatcgctagctcgccaccaacaatggcctcaaggtactctatcctgcttgccacaacgacactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcaaggccggcaccacctacaagaccactctcagcatctgatgagcctgtgatgagtgatgacgaata

SEQ ID NO: 7409 - DNA, 376 bp, Zea mays
  Clone ID: LIB148-063-Q1-E1-B8
ggaatcacggaacgaccacgcgtcgggcagcgcgaggatcatccaacccaccatgtaaatgtcgaaggtccactgtacatatcgccttctcttaccggcgaagttataggcagccggaataaggagagctggctgttggatcgaagcctacaggattccaacgttcggatcggcgccccgtccaaattgcaggcatttctttgccgttccctcttctttcttcaaacgagaacacgcacccattgctggtacagaacatgacataaaagattcagtaacatgatttgaccgtgtggcattgtggcgcctgcaaggccgtgtaaaaaaaaaagtaccccctatgcaaacgctttgctaccaaatctggcggctaccg

SEQ ID NO: 7410 - DNA, 356 bp, Zea mays
  Clone ID: LIB148-063-Q1-E1-B9
aatccgcctcactaccgagggaggcaccaagtccgtctacgacgatgtcatccctgccaactggaaggccaacaccgcctacaccgccaaataattaactttagtgctgacaatactttaagccgacctatgctagctatactagattgggttggatcccaagcaatgcattacacatgcatgcattggaccgtgatatctatttgctaccactaccctattacgacagtgatgctggcgccaacaatgatggtgtcatcctccttctccatcttcttcatctccatatatagctagagtgagacttcgctgttgtttaaaagagaagagttaagaaatggattgacacgttatat

SEQ ID NO: 7411 - DNA, 539 bp, Zea mays
  unsure at all n locations
  Clone ID: LIB148-063-Q1-E1-C1
cgcgtcggccacgcgcccggggcgctacgcgtgagcagcaacgcgctctgggccgacggcgtcaacgccgccggtttcgtcgtcncgccgcgcgtcgtgccggccccgttcgcgcgctgcctcaccatcgtcttcgagcgcttcaccggcggctcggcggccgcgttcgccgcgccgcgcctctacgcgctggccgcgcccgtggccggctttttcgcgtacgacgcggcggcggggcccgacgcccgggtctcgctccgggcgctcggcgcgccggtgcgcgtcgagttcgatgacgagctgtcggcggcggctctggacaaggggttcgacgcggccgccgcgctgtgcgtgacgttcgcggccagcgggggaggtcgtggccacgtacgccgtcacgtcgggctccgcgtcnacgtgcgcggtcaccggcacgggccacttcggtataggtgtgcggctgcccgagacgccgccgccagcctcagccgggttggtgggccgtgacggtgggtgtcggcgccggtggggtgctggga

SEQ ID NO: 7412 - DNA, 417 bp, Zea mays
  Clone ID: LIB148-063-Q1-E1-C10
accggagatcatcaacaagaagggctacgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctgggacagccgcacggctccagcagcctcaaggatgtcaaggtcgccttcagcaacgccgaccacaaggacagcagcaccaaggtggaacagccggcggacagctccttgaagccggggagcctgaa

SEQ ID NO: 7413 - DNA, 182 bp, Zea mays
  Clone ID: LIB148-063-Q1-E1-A7
ccacgcgtgcgcggacgcgtgggatgaccaccctgcctgcaaccttttgtacaaatagtactaatggtagttagattactgtgatacagtcaaaaggaaatttgtatgatgatcaggttgcatgtaaccagaatcatcaatcagcctgtaaaaagagaatatgtgaaaattgtattaagctg

SEQ ID NO: 7414 - DNA, 241 bp, Zea mays
  unsure at all n locations
  Clone ID: LIB148-062-Q1-E1-E7
ccacgcgtcggcccacgcgtcaggcggcctacaactcagaggcgtcaccttccgaggcacctacctccgggtctgaatccggtgccgcctcgactaacgagagcgctgcgtcagaagaggcccctacaagtgcgcccgangacgcatcatcgggcagcccttccacgtcgccgtcagatgccgatgctgcagtatcgcccgatagtagcagcggtggtggtaccgcctcgaaagagccttc

SEQ ID NO: 7415 - DNA, 221 bp, Zea mays
  unsure at all n locations
  Clone ID: LIB148-062-Q1-E1-E8
ctgcgggaacactgtacaagagcgggaagccggcgctgccgtggcggcagcgcctcgagatcaccatcggcgccgcgcggcgcctgcactacctccacaccgccgccatctacacgagcatccgnctcgacgtgtccgcgaccacgatcctggtggacgacaactgggtagccagggtttccgacttcggcttgtccaagaccggcccgacggccatgaac

SEQ ID NO: 7416 - DNA, 101 bp, Zea mays
  Clone ID: LIB148-062-Q1-E1-F1
tcatagctaagcaggtctgacaggatgtcgtggcagacatacgtcgatgagcacctcatgtgcgagatcgagggccaccacctgacctccgctgccatagt

SEQ ID NO: 7417 - DNA, 122 bp, Zea mays
  unsure at all n locations
  Clone ID: LIB148-062-Q1-E1-F3
tcggcgcctggcctcnngctggcacctccgacaccgtacgtcctccatcgcgtcgccgccggccggcctctgtccagcccgggctgcctgcgagggcttctgatggccctcgacgccgtcct

SEQ ID NO: 7418 - DNA, 256 bp, Zea mays
  Clone ID: LIB148-062-Q1-E1-F4
tcgctcccagtcccacctaaccgaggcaaaaccggcccttcgcacttccgcagaacgagcactcgtgaaccaaatatttggcacaagttagctttgcctgtttcttgcgtgtacatccctcaaggtttctccgccacacgcgcttcgggttcgcgggagcttgccagatgaatggtcaaaccccgatggtgctcgccgcagtagcattgaggccgtgctgcaaccgcctcatctcgtccgcctcggccgccgcggc

SEQ ID NO: 7419 - DNA, 243 bp, Zea mays
  Clone ID: LIB148-062-Q1-E1-F5
ccacgcgtcggccccattcgtttagctgaaacacaagaataaacgcagccgggcatgggcgaagctaagctcaacaacgtgaccgtcctgctggtggccctcctcctcctgagcagtggcgttcaggacgctgccgccatgccaggcacgtggaactacgacgcgattgtcgccgacgagccaaacggaaagaacaaggacctgtaccgccccgtcgccaacgccaataaatacacccgcggg

SEQ ID NO: 7420 - DNA, 253 bp, Zea mays
  Clone ID: LIB148-062-Q1-E1-F7
ccgggatgaccacgcgtcgggccgaagatcacagaagggacttccggttccgtgctagcgtctagcgatcgcgtcggcctccactccaccttcgcgaaaaagcttaccctttgtgtttgtgtgtctgtctggcaatcgatcgatggccatgagcgaggtcggcgccgcgcgcacgcctgctcgccatggcgctggcgctcgcctgcgtgctgctcgtcaggtccgcggacgccgccacgcccggcggctccgc

SEQ ID NO: 7421 - DNA, 118 bp, Zea mays
  Clone ID: LIB148-062-Q1-E1-G1
tcgccacgcgtccggccgccgcaagaagagcagccgcagctggagcccccgtgtcggccttcatggagatgacgacggatgaggaacggcggaggggcgacgcggggtgctgctgctg

SEQ ID NO: 7422 - DNA, 241 bp, Zea mays
  unsure at all n locations
  Clone ID: LIB148-062-Q1-E1-G6
accacgcgtcggcccacgcgtcagcgcacgcgtccgttcgccttcgcctttgtcttcncgctcncgtcgcgaaatccgcccgccgattaagcttgcttgccctagcagatcgaagcccgagccctagccctagccgaggagcgcgcgcgatgggcgtcgcggtcgtgggctgaggggccgcggctctttgcatggcgtgaggaagcggcgtcccgaggcgcgggaatggaccctagcctga

SEQ ID NO: 7423 - DNA, 354 bp, Zea mays
  unsure at all n locations
  Clone ID: LIB148-062-Q1-E1-G8
ccacgcgtcggcccgacctgttccagccagacaactggcgccgcttcgccgcgttcgtcaagcgcatgacggagccgggcgcgcgggaggcgtgccgggagcaggtggagcgggaggccganggcgtcgcgcacgccacccagcccctcatgcacgacgccgccgtcgcgctcnacaactgaccggaccggccggcgttccccgtcgactgtgttcgatcgctagacggggtggcacgctgcgatgacgacctgtatggcgagtccctatacttactcatacataagctgcgccgccgtgtcgtcngtgcgtgcaccgcgcagtactgtgcgtacagcggaagctgcgactgcg

SEQ ID NO: 7424 - DNA, 134 bp, Zea mays
  Clone ID: LIB148-062-Q1-E1-H5
acgcgtcggccacgcgtccgcgagaacgagtacagcatatggaagcggcgttcaaagatgagggcgacaagtacatcaactgggcagcgaagatggccatctccaccaacatcggcataccgtggatcatgtgc

SEQ ID NO: 7425 - DNA, 448 bp, Zea mays
  unsure at all n locations
  Clone ID: LIB148-062-Q1-E1-H6
gacgacatggcccgcatcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaagcggaggagctcgggctgagcggcggcggcctcggctccgacgacgcggtgcggcggacgctggcgcagcggaagccgagcaaccggtacatcagctacgcggcgctgcgcgcggacgaagtgccgtgcaacaagcgcggccggtcctactacagcaactgcgaggcncagaaggccgccaacccctacgcgcgcggctgctcgccatcacgcgctgcgcccgcaacatgaactgagcccagcgctagct

SEQ ID NO: 7426 - DNA, 254 bp, Zea mays
  unsure at all n locations
  Clone ID: LIB148-062-Q1-E1-H7
ggaatatccgggatgaccacgcgtcggacaacatgcccccggcataccgcaggtgctcatcgtcacgggcctcacctggctctcctggttcnccttcatcctcttcgacaccgactggatgggccgcgagatgtagcacggcaggcccgacggcagccccgangacgtggccaggttccagganggcgtccggcanggcgccttcngcctgctcctcaactccgtcgtcctcggagccagctccttcctcatcg

SEQ ID NO: 7427 - DNA, 95 bp, Zea mays
  Clone ID: LIB148-062-Q1-E1-H8
ggcctgccggtgagcgacgagtgcaaggtgaagttccgggatctgaaggcgcggcggagcttccggttcatcgtgttcaggatcgacgacaagga

SEQ ID NO: 7428 - DNA, 411 bp, Zea mays
  Clone ID: LIB148-063-Q1-E1-A1
ggaattccgggacgaccacgcgtgcgccattacagcaatggcggacaaggtgttcctcctcctccgactcagcatggtcgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctat

SEQ ID NO: 7429 - DNA, 413 bp, Zea mays
  Clone ID: LIB148-063-Q1-E1-A10
accacgcgtccgccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcacccg

SEQ ID NO: 7430 - DNA, 432 bp, Zea mays
  Clone ID: LIB148-063-Q1-E1-A11
accacgcgtccggacggaactaccggtgagaaatcaggcgacgacaaagagaccaccaacgaccaacactcctagctgtctcgtgtagggatccatcgtgctgtgtgttcttctggctgttgtacctgatgctcagagtagacgctggctgctgctccgcaaggaaactgactcccccgaccgccgttcatgctcctggctggctggctcgctggccgcctcgacgggaacgctgccgtagaatgacgactggggctggtgttgttgttacagtatggtccttttttctttcttctttcccctttcatccattaagctctgtgatgtagctgcccgtggtgttgattcatgaaatcatgctagagattttttcctggcagtaagtgcgtgcctgtaaaactgtcgaactatttggacgaaagttgtacactg

SEQ ID NO: 7431 - DNA, 426 bp, Zea mays
  Clone ID: LIB148-063-Q1-E1-A12
aggagttccaccgctactccatcctgtggacgcccgccgccgtggccttctacgtggacgacgtgccggtgcgcgaggtgcggcagtcggccgccatgggcggggacttcccctccaagcccatgtccgtgtacgccaccgtgtgggacgcctccacctgggccaccgccgggggccggtaccgcgtcaactaccgctacgggcccttcgtcgcctccttcaccgacctggccctcctcggctgccgcgttgacgggcccatccagcagacgacggcggagcggtgcgccgcagccgccgaggcactcagggcgtcggacgtggccgtcatgacggtggagaagcagcaagccatgcgcaggttccgggagcgcaacatggtctactcctactgctacgacacgctgcgctaccccgccgcgttcc

SEQ ID NO: 7432 - DNA, 247 bp, Zea mays
  Clone ID: LIB148-063-Q1-E1-A3
tgaacaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggccagcacggcgacaagtccggcgaccacaaggacaaagaccataag

SEQ ID NO: 7433 - DNA, 260 bp, Zea mays
  unsure at all n locations
  Clone ID: LIB148-062-Q1-E1-E6
accaccgtcgacacatccgcatgaaggacgtcaagtgcggccgggccacgcatcagctcggcccctgnggcggtacaaggacgagaaggacgtggaggacgtgaaggtgacggggtgcacgctcgccggcaccacgaagggccggcgcatcaagtcgtacgaggactccaagtcgtcgctcagggccagcaagttcctgtaccaggacgtcaccatggacaacgtctcctaacccatcatcagtagacagaagtactgcc

SEQ ID NO: 7434 - DNA, 407 bp, Zea mays
  unsure at all n locations
  Clone ID: LIB148-063-Q1-E1-A4
cgcgtcggcacaatttctacgattcaaagctagcaacacagcatataagactgatgtcgaccggattgtcataactccagctggcccatcaggcccatcttctcctcagtctgaagctggggagtccaatgtgtttcaccaggaaaaagatgctgcagcagatggggcaccgcctgacactgatggagcagtggctgaggccggagaggaagaaacaacggaaaatgttggtgaagcgacatttagctatgaccgcttgatatccaaatccaccgatccagttcgtgggatagattacaaacgcagagaggcatacttatcagatagtgaattccaaactgtntttggcatgacaaaggatgcattctaccgacagccaaattggaaccaggaactacagaaccaaa

SEQ ID NO: 7435 - DNA, 374 bp, Zea mays
  Clone ID: LIB148-063-Q1-E1-A5
gagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatg

SEQ ID NO: 7436 - DNA, 422 bp, Zea mays
  Clone ID: LIB148-063-Q1-E1-A6
ggaattcacggaacgaccacgcgtcggccacggaggccaattctccaacttcctccctccgtcgatcatccagcaccagcatgagaatcccgtcgaatccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttctgttataattactaccgagctactatctccacattattattggtaaagaaagaaagggcgcctcctctaacttgatgggcaatccgtttccatctcaacttcaacgccaacaacagttgatgctactatggttggaaatcgggcatggtt

SEQ ID NO: 7437 - DNA, 422 bp, Zea mays
  Clone ID: LIB148-061-Q1-E1-H6
acacgtccgaacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgact

SEQ ID NO: 7438 - DNA, 404 bp, Zea mays
  Clone ID: LIB148-061-Q1-E1-H7
acgacccgccgacgcccctacgccaggtgcccaggccttcgtcgggtcctttaccggcgacgagcacacaccagggcactggagggctaccatctgcttcgctttctgaaaaaaaaacagtttcggcataattatcaccctaagatgcctggaattacaatggatggatttgttgcagaggaggtgccgaacagggtgaattcctctccacagaatgaaaatctgcccgccccaaattcgacggcagcttcaacaatggcgccaagcatgcaaagtgaggcacttgagatgcatgtcgagagctccggtactggggagccctcaattgagcagctctacaacaatgtgtgcgagatgaagagctcaagtgagggtggctccctgtcacatgagagctttggctc

SEQ ID NO: 7439 - DNA, 418 bp, Zea mays
  Clone ID: LIB148-061-Q1-E1-H8
acgcgtccgcagcaatggagctggtctgggtctgttgcaacggaggattccgatgatttcgaggttgcaactaattgctcgttagagctggactgcgtgaggccatctagtgccccaaaagcttcaggtttatcaaatggagggggcacagctgtaaaaaagatccaagtcaagggttcaaaaggttcagacgttaggggagtgaatcctggaaaaaggtcatcgccattacagaagaagccgagtggaccctcaccgacgctaatcaagaagggcggaggtgaaggaaggaagactccaaatggtaaaacaggaaccaagaagtaagcaacccagatgaaacttggttttgctgtgaccaacttcaccttggttagggacagataaacatgttgatactaccgggtgatacattgat

SEQ ID NO: 7440 - DNA, 397 bp, Zea mays
  Clone ID: LIB148-061-Q1-E1-H9
caagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacga

SEQ ID NO: 7441 - DNA, 371 bp, Zea mays
  unsure at all n locations
  Clone ID: LIB148-062-Q1-E1-A1
acgcgtcggcccacgcgtccgcccacgcatcggccagatgctgtcgaagctgcggcaccggcacctggtgtccctgatcggctactgcgacgagaacgaggagatgatcctggtgtacgagtacatgcacaacggcgtgttccngaacgaggtcgacggcagcgaggggaaggcgccgctgccgtggaagcagcggctggagatctgcatcggcgctgcccgggggctgcactacctgcacacgggcacggcgcaagggatcatccacggcgacgtgaagacgaccaacatcctgcgggaggagaacttcgtggccaaggtgtccgacttcgggctgtccaaagacgggcccgggatgaaccagctgcacg

SEQ ID NO: 7442 - DNA, 340 bp, Zea mays
  unsure at all n locations
  Clone ID: LIB148-062-Q1-E1-A3
attgatgatcttggtgctccgatcatgagaagcacagtggggtgtagtcgattggccccagttcgcgaagagatgcagatgagagcaggagactctgcagcttattgcanctgcggctatgactttgtggtggtggacaaaacagttgactatggtcgaggaggatcaccgtcagataaaagcagtgcttcagaagtaagaactcatgttcggccactggatgctagcacagcagcccacgtggcaggtccctcaagtaagaggcgagctacanttgtgcctgaagaggtttcngatgaacgagtgttccgtcgctttgtcagactacttctggccttca

SEQ ID NO: 7443 - DNA, 342 bp, Zea mays
  unsure at all n locations
  Clone ID: LIB148-062-Q1-E1-A6
accacgcgtcgcgcgcgacgcgtgggcgagccacaccgacgcgacgattcctctcctccgcccgttcccaccgatctcacgctctctctcttcctccgtcgcgtcggcgtcgccatcgccggccatgggttgcggtggctccaaaggaggcgtgngcaccggcaacaccagcgccggcagcaaggtcctccggaggaagtcctcctccgtctccaccggcgcaagccacacctccaccacgtcgccgtcagcctccggcgtcgtcgtcaaggacgtcgtgaaggatgcngcggcggccggcgaagtgatgacgcccggcgacgccgagaagcctatctctgt

SEQ ID NO: 7444 - DNA, 71 bp, Zea mays
  Clone ID: LIB148-062-Q1-E1-B1
gcgatcgccccatggccgccatggctcgttccgtctccctcgtcgtggcgcccctgctcctcctctccctc

SEQ ID NO: 7445 - DNA, 229 bp, Zea mays
  unsure at all n locations
  Clone ID: LIB148-062-Q1-E1-B3
agatgctgctggagcaagcgacacatcctgtcgggcgccacgtccgtgttcggcgcggcgccggtggaggtctccgtgaangtggccggcatccactggcactacggcagccggtcgcacgcccccgagctcaccgcgggctagtacaacaggcggcgccacgacgggtacctcacgatcgcgcgcgtcctgtcgcgccacggcgccgtgctcaacttcacctgcgtgg

SEQ ID NO: 7446 - DNA, 87 bp, Zea mays
  unsure at all n locations
  Clone ID: LIB148-062-Q1-E1-B6
accacgcgtcggcccacgcgtcngacgacgtatcttcatctacgtaccttcaactatactatatgtcgcatactaaatattctgtct

SEQ ID NO: 7447 - DNA, 356 bp, Zea mays
  unsure at all n locations
  Clone ID: LIB148-062-Q1-E1-B7
cgcctccatcgcatcccgccgccgccgtctcgacggtcgctaataagccgccgcatccacggatggagatgaagaagatcgcctgcgccgtcctcgtcgccgccgcggccacgcgtggcgctggccgcggaggcccggctccgtctcgcaccagcggctcctccgcggtcgcagccgccatcttcggggccgccgtggcctccttcttcgcgtacgacattcactgagccgccggacgacgagccgcagcctgacgtaggagaccagngtggngggagagacgtggctgcgctgcacggctctgctgctctcgcgcattcccgacgcctgggcgtgctctgattgggcacggcggt

SEQ ID NO: 7448 - DNA, 356 bp, Zea mays
  unsure at all n locations
  Clone ID: LIB148-062-Q1-E1-C3
atggacgatacataagagaagcacgccgacctcgatcaagagtgaggagagcgaggagccgaagctactgacctacgagcaagaagctccagaggaacccgaaaatgctgtggaagaggagaaagaagaactgagtcgaagagcagaacctcagcctgtgcctgatccagaaccccacccacagcanacgactggagatctactaaacctggaagcagaggtgaatccttcggctctggaactcgaacaaagcaatgcattggcactcactattgtagcatcatgtgactacaagccgccagcatctcaaagtatgtctgatgtcaattcctctgggtgggagctggcactggtca

SEQ ID NO: 7449 - DNA, 237 bp, Zea mays
  unsure at all n locations
  Clone ID: LIB148-062-Q1-E1-C5
gcgagggcctgctgccagggtgtctggcgccaggcgactctgccgtcgctcccggcgctcatcttggtgccgccggccaccaccatctccacgcaccacacctccggcgccgtctagcagcncaggacgccgccggcgatctcggcgccgccgtggaccacgcccaccattcccgtcctgcaggctctctgcccctgcttggtcgtcgacgacgacgacctcgtcctcatcagcacc

SEQ ID NO: 7450 - DNA, 211 bp, Zea mays
  Clone ID: LIB148-062-Q1-E1-C6
cgtcgctgctagtgcctgccgttgaactctccggccaccattgatccgacctcgcctaagccatctatgagtagagaaaaacagtgaacgccacctctgtactcgccccgacgtatggcgcgtcgctcctgcagtaccggcccacgctctgcgcggtgctcaagtgttacggctgccctcaaatccgtcgtcggaccattggcactggggc

SEQ ID NO: 7451 - DNA, 379 bp, Zea mays
  unsure at all n locations
  Clone ID: LIB148-062-Q1-E1-C7
gcgtccgaggcggtgcagccgcgactgggcgcgcgaccgcaagcgcctggccaggtgcgccatgggcttcggccacaggaccaccggcgggctggccggcaagtgcgacgtggtcattgacgccancgacgacgccgcggacctcgtcacccccaggaagggcacgctccggcacgccgtgacccgggcccgggcgctgtggatcaccttcgcgcgcgacatggtgatcgagctcggccaggagctcatcgtgagcagccacaggagcatcgacggccgctgagcgcatgtgcacatcgtgggcgcgcagatcacgctgcagaacgtgcgcaacgtgatcctccacaacctgcacgtcgacgacgccgcggcgcacggc

SEQ ID NO: 7452 - DNA, 358 bp, Zea mays
  Clone ID: LIB148-061-Q1-E1-H5
accaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattggtacaccccagccggcgagccaat

SEQ ID NO: 7453 - DNA, 271 bp, Zea mays
  unsure at all n locations
  Clone ID: LIB148-062-Q1-E1-C8
accacgcgtcggcctcacctcnctcnctcacacagataataaggaaaggtcgcgcccttttcctccgacatccacaaggggggaggggaaaacacgtacattcacccggcggcaataatggcctcggttccggctccggcgacgaggaccgcggccgtcatcctatgcctatgcgtcgtcctctcctgtgccgcggctgacgacncgaacctncccgactacgtcatccaaggccgcgtgtactgcgacacctgccgcgccgggttcgtga

SEQ ID NO: 7454 - DNA, 330 bp, Zea mays
  unsure at all n locations
  Clone ID: LIB148-062-Q1-E1-D1
gtccgctcgacaacgagaaccgacatcgctcatggangcccggactctgaatcctcatctcaccttcacctgtcgcactgtcagcgggaggttcatcttgcaacattgcattgcacagcgcgcacggcgctcgnaaccttcagaagtgcgagcattgcggagatatggttgccacgaagcttatggatgagcactacgatgagaaacatgctccgatgaattgctcacgttgcaaacacacagtaggaacgcgagctatcggatcttcatacaggcatacaatgcccacaaaggatgctcgcgtgccagtactgtcagtttgaactgcct

SEQ ID NO: 7455 - DNA, 229 bp, Zea mays
  Clone ID: LIB148-062-Q1-E1-D6
gaccggagatctagaggaaccaagtgtactgcaacggcgagctggtgctggtgacggggggcaccaagccggagtacacggtggacgtgtggtccggaaaccacccctactatgtcggcgacacctcggcgctcagtggcatggacagccagatcgagaagttccgcaagaagtggggccacatcaaggagtactggcccgaggaacagtggagggagatgcacccaga

SEQ ID NO: 7456 - DNA, 360 bp, Zea mays
  Clone ID: LIB148-062-Q1-E1-D7
cgcgtcggcccacgcgtcagtcgagatacagatctcgagaagttgcagctccccacaatggaaggtctggctaaaaaactaaaaaagaactctgggagcaagatcgagtctgctagtgttgcatgtcatccatcagaagcaggtactagtgactgccagctggtttaactccaagtcaggaaagaagattcctttgaaatcagtcacttcaatcgtcgatgggctaaagaaatcgtacattgagaagttgaggcccttggaaaaaacgtatcagttccatgacttcgtctcgcgcttgctgactagcagcgatttcgatgcgaaaccaatggtcatgctgttgggtcaatactccacggg

SEQ ID NO: 7457 - DNA, 303 bp, Zea mays
  unsure at all n locations
  Clone ID: LIB148-062-Q1-E1-D8
gcgggcacatctagccgcaagcattcttccttccttcccattcatcggtgaccatggattgaagacattgatcggcttctctggaggtgcgtgtgncagctcggaggtcanccgccgagactcataggcaatggcaaccgcaaggaaggatcctcagcaggttgagaaagtcaacctgaanaccaacgagtctggcaaaggggtagtacggcgtgcaaggtctgtcnncgactctccggatcgcagatcgtccccatccccgggcccagtctcagacaacgcaggccgacggcatcatcagtc

SEQ ID NO: 7458 - DNA, 446 bp, Zea mays
  Clone ID: LIB148-035-Q1-E1-E6
actcgtgggtcgatgcaagcctctacagtgacgtcgtactaacgcgtccgcgtgatggacgcccgtctccgcctcggcttcttcctcctcctcgtggccgcggcgttcgcgccgctggtctccgcgcagctctctgcagatttctacaagacgtcgtgccccgacgccgagaagatcatcttgggcgtcgtcgagaagcggttcaaggcggaccccggcaccgccgccggcctcctccgcctcgtcttccacgactgcttcgcaaacggctgcgacgcgtccatcttgatcgaccccatgtcgaaccaggcctccgagaaggaggcgggccccaacatctccgtcaagggctacgacgtgatcgaggagatcaagacggagctggagaaggagtgccccaacgtggtgtcgtgcgcggacatcatccccggtaacgccggcgactc

SEQ ID NO: 7459 - DNA, 406 bp, Zea mays
  Clone ID: LIB148-035-Q1-E1-E8
actcgcgggtcgatacaagcgtctacactgattcatcataaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaag

SEQ ID NO: 7460 - DNA, 385 bp, Zea mays
  Clone ID: LIB148-035-Q1-E1-E9
ggtcgatggacgcgtctacactaagtcgacgaacagggttaagacccttctatggcttgccttgtcccgccttgccgctgcccgccgtccccgcctcgctcgcaagtcgatttcccgcagcgatgttggacagctactagcactcggacacattgatcgtgctctccaccgtgcagagcagctcatagaggaggacaacatgctggaggcgttcaacataatagagctacactgcaatcgcctcattgagtgcgcaaagcagctagacaagccccatgaatgtggtgatgacattcgggaggcagccgccgggatcatgtttgcagctgggaggtgcggcgacctgccggagctgacgtttgcacgaaccatactgacaaacaag

SEQ ID NO: 7461 - DNA, 408 bp, Zea mays
  Clone ID: LIB148-035-Q1-E1-F10
ggtcgatgcacgcctctagatcgagttctcgaacgggccgcccttttttttttttttttttttaacttgaaattcgtgacacgattcatgtttacattggtaacacaggtacaacatatcacttgagcaagcctgcagaacaatattgtcctaccgtacactgcatacacgcttcgatcaagacaagtttatgtgacgcaatacacgctgtcgctaaggatacaaggcctacatcgcagctgtattctggggccagctcagctggcgtccttgagctttcgcttgagctcgtcgacgaagtcgtcgaagttgcgccgcgacgagccaccgggcgccacggcagcctcgagtgtggccctcagcttcctgacctggtccctgagcttgaggccgtgttccccggccatg

SEQ ID NO: 7462 - DNA, 405 bp, Zea mays
  Clone ID: LIB148-035-Q1-E1-F11
ctcacgggtcgatgcacgcctctacactaagtcgtagtagcgctgcggagctgaccggccgggccgggacgggaccgaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcagtgcagctccggcgtagatgagattgtattgtgaccaagccgggagggaaagcagggaggggaggacaaagatgttttgtcacgtttcaggctccggccatcgccggagtttgtccggggaatatatcgatttcctattagaaatccgcaaaaaaaaaggaagaagaaagagaggaagagtat

SEQ ID NO: 7463 - DNA, 456 bp, Zea mays
  Clone ID: LIB148-035-Q1-E1-F2
ctcacgggtcgatacaagcctctacaatgagtcggtatacacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggaaaaacctggtcatcaccggcaagggaaaccttgacgggcagg

SEQ ID NO: 7464 - DNA, 363 bp, Zea mays
  Clone ID: LIB148-035-Q1-E1-F3
ctctacagtgcatcatcataccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttcgggaccaagacgcagatctacaactgcaccatcgacggcggacaggacacgctgtacgaccacaagggcctgcactacttcaagggctgcctcatccggggcagcgtcgacttcatct

SEQ ID NO: 7465 - DNA, 394 bp, Zea mays
  Clone ID: LIB148-035-Q1-E1-F4
tagcatcagtcgtggtactgacgtgctgtgggtggttctgttgtccatggcgcggaagcatcagcatgttgccatatttaccacagcgtgcttgccgtggatgactgggactgcggtaaacccactgtttcgggctgcataccttgccaaggctggagattgggaggtcacgctggtggtgccttggctgtccaagggggatcaggagctcgtttatccaaacaagatgaggttcagtttgccggcagagcaggaaaactatgtgcggcggtggcttgaggaacggactgggctgttgccgaagtttgacataaagttctatcctgggaagttttcaactgagaaaagaagtattctacctgttggagacatcagtcagacaatatctgatgat

SEQ ID NO: 7466 - DNA, 418 bp, Zea mays
  Clone ID: LIB148-035-Q1-E1-F6
ctcgcgggtcgatacacgcctctagtctgcgtcgtagtaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgccgcccatgaagtgggacaggaagctggcgcggcaggcgcggcgctggtccaaccgcatgcgcaaggactgcgagctcgtccacagcggccacaagtacggcgag

SEQ ID NO: 7467 - DNA, 425 bp, Zea mays
  Clone ID: LIB148-035-Q1-E1-F7
ctcgtgggtcgatacaaccccctagattgagtcgtcattatctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctc

SEQ ID NO: 7468 - DNA, 451 bp, Zea mays
  Clone ID: LIB148-035-Q1-E1-F8
ctcgtgggtcgatacaacaccctacagtgactcgtactaccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggacgtcaccttcaagaacatcaccggcacctcctccaccccggaggccgttagcctgctctgcactgccaagggtcccatgcaccgccgtcacaatgga

SEQ ID NO: 7469 - DNA, 407 bp, Zea mays
  Clone ID: LIB148-035-Q1-E1-E5
tgcaagactctacactgacgtcgtgcgtagccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagttacacat

SEQ ID NO: 7470 - DNA, 406 bp, Zea mays
  Clone ID: LIB148-035-Q1-E1-C9
gtcgatggacgcctctagcctgactcgctccaccctcccaccacccggctctccacgccgccgccgccgccgccacaagcgaccgcgcatccgctcttctccctcccttcgctctcggcggccggcgatgggggagaccgtacgggcgggcgacgttgcaatcacgactcacgagatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggaggtggtggggggcatc

SEQ ID NO: 7471 - DNA, 422 bp, Zea mays
  Clone ID: LIB148-035-Q1-E1-D10
aagactctaaagtgacgtcctatgtacgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaggtgcgcaagccgcactctggccgcgccca

SEQ ID NO: 7472 - DNA, 367 bp, Zea mays
  Clone ID: LIB148-035-Q1-E1-D11
taaagtgagtcgtcatattcttgttgggatatattcctccaattcccctcctcctcccaacaaggcaacaacaatctgttccggccgccaaacaaaacccaaaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgt

SEQ ID NO: 7473 - DNA, 414 bp, Zea mays
  Clone ID: LIB148-035-Q1-E1-D12
ggtcgatgcaagcctctacagtgaatcatattaagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatccagtcacggtgttcatcacagacat

SEQ ID NO: 7474 - DNA, 402 bp, Zea mays
  Clone ID: LIB148-035-Q1-E1-D3
ctcacgggtcgatgcaagcctctaaaatgagtctcacaaccgattcaactacaagcttgcgggcaaaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactcca

SEQ ID NO: 7475 - DNA, 409 bp, Zea mays
  Clone ID: LIB148-035-Q1-E1-D6
ctaggactcgtgggtcgatacaaccctctacactgagtcgtattacacgtacgagctcagaaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggac

SEQ ID NO: 7476 - DNA, 392 bp, Zea mays
  Clone ID: LIB148-035-Q1-E1-D9
tagtctcatgcctctgacgtcctcgcccggtttccccggtttttgagaggggaaagaggaggcggaggagagggatggggagggacgagaggttcccggtgtgggaggccgcgctcggcgccggaatcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctgtttgggcaactgcgtggccttgcgctg

SEQ ID NO: 7477 - DNA, 244 bp, Zea mays
  Clone ID: LIB148-035-Q1-E1-E12
gtcgacgacgcgtctattctcactctcctcactcggccttcttcgcgtgtttccctctttttcttaggccgccctctacacttctcgacataaccatcgagagggcggtcgagagaaacgagagcggcggacaccatggggagctcgaggaccatcgttgcgtcccgcctgctcctcctcgccctcctcctcctggctttcgcggccaccgccgaggcgcgcgttgtccgcgagctgtccgggg

SEQ ID NO: 7478 - DNA, 384 bp, Zea mays
  Clone ID: LIB148-035-Q1-E1-E2
ctcacgggtcgatgcaagcctctagactgagtcgtattacgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgcgaatcaggagtactgggcggagcgcgcggaggcggcgcacgcgtaca

SEQ ID NO: 7479 - DNA, 394 bp, Zea mays
  Clone ID: LIB148-035-Q1-E1-C7
tacaagcctctagatggagtcttaatagcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtga

SEQ ID NO: 7480 - DNA, 417 bp, Zea mays
  Clone ID: LIB148-035-Q1-E1-E4
gggtcgacgcacgcctctaaactgattcatagaatacagcaatggcggccaaggtgttcctcctcctccgactcagcatggtcgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatgg

SEQ ID NO: 7481 - DNA, 327 bp, Zea mays
  Clone ID: LIB148-061-Q1-E1-G12
aaattgaatcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgac

SEQ ID NO: 7482 - DNA, 408 bp, Zea mays
  Clone ID: LIB148-061-Q1-E1-G2
ccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctgggcg

SEQ ID NO: 7483 - DNA, 448 bp, Zea mays
  Clone ID: LIB148-061-Q1-E1-G3
ctcacgggtcgacgcacgcctctacaattggtccctcaacgacgctaatcaagaagggcggaggtgaaggaaggaagactccaaatggtaaaacaggaaccaagaagtaagcaatccagatgaaacttggttttgctgtgaccaacttcaccttggttagggacagataaacatgttgatactatcgggtgatacattgatatttgccacacgaatacgtcagtcctcttaagggaggaggtcgctagatcttcgggcatctgctgtaaatcactcgttgatttgttgtagtacgaacagaaaacggaccacaaaaaactcgaggatgggaggaagatcatcatcacaaggacgtttttgttagatgtatatgttgcttagcttatttttctcgctgtgtgtaagggcttctatgccctgcccatgtacatgtttggcttcctgcccc

SEQ ID NO: 7484 - DNA, 453 bp, Zea mays
  Clone ID: LIB148-061-Q1-E1-G4
ctcacgggtcgatgcacgcgtctagcatgccacccctcttcgcttccgttcctgtcctctcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctct

SEQ ID NO: 7485 - DNA, 426 bp, Zea mays
  Clone ID: LIB148-061-Q1-E1-G5
agccgcgttcctccgcccggggaagcccctgcgccgccgctacggcgcctgggccgtcgtgacgggcgccaccgacggcatcggccgcgccgtcgcgttccgcctcgccgcggccgggctcgggctcgtcctcgtcggccgcaacccggagaagctggccgccgtggccgccgagatcagggccaagcaccccaaggtccccgaggtgcgcaccttcgtgctcgacttcgccagcgatgggctcgcggccggcgtcgaggcgctcaaggactccatccggggcctcgacgtcggcgtgctcgtcaacaacgccgggctgtcctacccgtacgcgcgctacttccacgaggtggacgaggagctgatgcgcagcctcatccgggtcaacgtcgagggcgtcacgcgggtcacgcacgccgtgctgcc

SEQ ID NO: 7486 - DNA, 425 bp, Zea mays
  Clone ID: LIB148-061-Q1-E1-G6
atcgatcggtcgtggctgtttccacagccggaccgaatagcggcgcggccgggaaatggggagaaaaggcaagtggttcgacaccgtgcagaggatcctgatcacctctgaacctgatcccgtggagacgcagaacgatgatgccgccaaggactggaagctcgatcatcacgagaaggctgcgaagctgagagacaataagtcggccatcaggaggatatggcagttcggcaaatcaaactcgtccggtgcttccgcctccgcgacggcgccggaggacgcggaggttcttcagtttccgaagtcgccaaggtcggacaacgagtaccatgtcgtccaggacctcaccgaggaggtgccgttcatggagacgagaggcgaggaagaagaagaagaagacggcgagcgcatgaaccctggggatg

SEQ ID NO: 7487 - DNA, 421 bp, Zea mays
  Clone ID: LIB148-061-Q1-E1-G8
gcgcggaccacgcccgtggacccaaagacgcacggcacgggtctccccttcaacaggtactcatggctgacgacgcacaactcgtttgcggtggtgggcaccaagtcgccgctggggtccgccatcatctctccgcccaaccaggaggactcggtgaccgaccaactgaagaacggtgtgcggggcctgatgctggatgcctatgacttcaacgacgccgtgtggttctgccactccttccacggccgttgcctgaccttcaccgcctacgtgccggcgctgagcgtgcttacggaggtccgggtgttcctggacgccaacccgtccgaggtggtcaccatcttcctcgaggactatgcagcgccggggtcactcagcaacactttcaacgccgccggactgtccaagtactggttccccg

SEQ ID NO: 7488 - DNA, 424 bp, Zea mays
  Clone ID: LIB148-061-Q1-E1-G9
atcaattgcaagaggagcaagataccaccaccgtagcaccacacgcaggtacgaagaaggcgacgaacatggcgaggctggccttggtagcggcggtggttctgtgccttctattagcgacagggccgcagggggccgtcagcgccgaggggatggtgtcatttgacaatttgatcagctgcaaggtactgggcaactgcgataagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggccttagcgtgtggtgcggcgtgtgtgtatatattacacacatgcattatacattggtcgtccatcgttac

SEQ ID NO: 7489 - DNA, 401 bp, Zea mays
  unsure at all n locations
  Clone ID: LIB148-061-Q1-E1-H1
aattattacctggtcgtaagcatgaatcgacgattggacatgatagacaacatcgacggccgtcgggtaaccaagaacaaggcgcgcatccaagttggcgactcctcttcgtcggacgaaagcgacagggagaaggaggaagatgaagaagaagcacatgaggaagtggccaaggcgcccccgctgggttggaatcatcacaatcaccacgaagcggccggcggcattggcagcaacagcaacaggaggcggcttctgtcgaagcagctgtccatgaagaagaccaccagggagatcaaatgggagaagcgccggcggcagataatgcggcgcagcagcctggtggtgtcgttaaacgacgacggaggaagangangctgcggcagcatgaagagcgccgc

SEQ ID NO: 7490 - DNA, 424 bp, Zea mays
  Clone ID: LIB148-061-Q1-E1-H10
cacgcgtccggaaggccggcatcgtgcccatctcctaccgcagggtggcgtgcgcgaagcagggcggcatccggtacaccatcaccgggaacaagtacttcaacatggtgacgatcaccaatgtgggcggcgccggcgacatcgcggcggtgtcggtgaaggggagcaagcgtgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggtgtcacgtaccaggcatccaagaacttctaagtagccacttttcctcctcttcttcaacctgcatatgcccacaagcaaccatgcaaatgataacatgcaat

SEQ ID NO: 7491 - DNA, 411 bp, Zea mays
  Clone ID: LIB148-061-Q1-E1-H11
cacctcctcttcccacgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaaga

SEQ ID NO: 7492 - DNA, 364 bp, Zea mays
  Clone ID: LIB148-061-Q1-E1-H12
ggccaccccaacgtcgtcggactcgagggcctcgtcacctcccgctcctccccctccatctacctcgtcttcgagtacctcgagcatgacctcgccggactcagctcctcccccgacatcaccttcaccgagtcgcaggtcacattgttggagatgctcttagctttagcttgtctgcctcgcgcgggcaaacatgtcagaaactgcggtacgcatcagtcggacaccgcgatcgcgggggccatgcatgctgtcagctcttgacccttgtcaccatccaatccaatggcgatcggtcgatcgtcttgtcacgattcacaaccgttgcctgatgacgcgcgcgcgataacatgccgtgcgtgcg

SEQ ID NO: 7493 - DNA, 381 bp, Zea mays
  Clone ID: LIB148-061-Q1-E1-H2
tggactctgtcggagcaggagacgtgccgcgccgcggacttctcgcgcgatgcctggtcaggacggtgggcgcggctcgccaacaacgacagctgcgaggacgtcaacgcatcggggcggtaccggtgcctgtagccggaccacgcgtgcgatgcaccgtggtgcgacgggccgctcggcacgctggcgagcaacgggtgggtgtagtcagcgcagtgctccttcaagctctttacggccgatgcgtcctggcggtgccttgacgggaagtggctcttcttctggggcgactctaaccacgtcgactgcatccggaaactcctcaccttcgtcctcggcatcacggacacgtctgctgtgacacgccggtttgatgcagtg

SEQ ID NO: 7494 - DNA, 427 bp, Zea mays
  Clone ID: LIB148-061-Q1-E1-H3
acaacaatccgttccagccgccaaacaaaacccaaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaagaggtcgtccggcgtgccggtgttcctcatgatgccgctggacaccgtc

SEQ ID NO: 7495 - DNA, 409 bp, Zea mays
  Clone ID: LIB148-061-Q1-E1-H4
gggacgactcagacgtgtacaagtgctacgacagctgctcggacgacgtcgaggaggccgtcgcccacctcaacggcctcgtccgggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatcaccgaggcatccggatccatgtccgcaggcatcgccctgccaccctccaacgccggagcgccctcctacggggcggcggcgccgttcggaggtgccgcggacgcacccgccggcacctccgagggccctgccagcgccagcgggccatc

SEQ ID NO: 7496 - DNA, 420 bp, Zea mays
  Clone ID: LIB148-061-Q1-E1-G11
gacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatctcccacgagtccgcctcttccgacaacgccgagtccgccgcgttcaccgtgaactcggacaacgtcatcgt

SEQ ID NO: 7497 - DNA, 346 bp, Zea mays
  Clone ID: LIB148-061-Q1-E1-E8
ggcactcatgacagtcataacttcacaacaccagcattgcctctgcacacaggtccacatggtaagaggaagcgcagtgcctcgcgggattaggtgtgacgacatattgcgcatctaatgcaacaacagacacgcagactacaaaacaacagtgtcatactaccatccaatgcgcgatgggttcataggatcacgacacgtctctttccaccaggaccaggacatcgtcgtcgtgaccacagccctctccggcgccaatatgatcgacatcaactgaaaacagcaagcagagatatctcatgtgcgactcctcagcagacgccacgtagactgatcagacattcaa

SEQ ID NO: 7498 - DNA, 397 bp, Zea mays
  Clone ID: LIB148-061-Q1-E1-E9
cgccatcactccactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacga

SEQ ID NO: 7499 - DNA, 403 bp, Zea mays
  Clone ID: LIB148-061-Q1-E1-F1
acagaccacataggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaagacat

SEQ ID NO: 7500 - DNA, 433 bp, Zea mays
  Clone ID: LIB148-061-Q1-E1-F10
atccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgacatcctc

SEQ ID NO: 7501 - DNA, 407 bp, Zea mays
  unsure at all n locations
  Clone ID: LIB148-061-Q1-E1-F11
ctgaactagacctccacaatacgcaaaatggcttttttaggtataatgggtccagtgcatcaatagatgagcatctgagctatgaaggcataagcagtggccatgatatgcaaataattccacttgatggggctgattctggttttgaagggcaccagacatcttacagagaaataccagtggagcctcctgagatgtttcttgcaggcttaattgttcacatagtgcggcaaagaagaagtctctttcctctttggaaatgctggagcatccaggaaactgaaccaccatacaaagctgttttagcgaaaagggagaacttcanggatatagtggttactccttacatgtttacagatcacttaccatggaggtgccactttgctatgcagaagattgttgaagct

SEQ ID NO: 7502 - DNA, 406 bp, Zea mays
  Clone ID: LIB148-061-Q1-E1-F2
ggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcg

SEQ ID NO: 7503 - DNA, 51 bp, Zea mays
  Clone ID: LIB148-061-Q1-E1-F3
aacagccgtatcatggtatcacccgcagaactcttggagcgaaccgtcgcg

SEQ ID NO: 7504 - DNA, 403 bp, Zea mays
  Clone ID: LIB148-061-Q1-E1-F4
accctcgtctcaccctccctccctcacacaaataataaggaaaggtcccgcccttttcctccgacatccacaaggggggaagggaaaacacgtacattcaaccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagcca

SEQ ID NO: 7505 - DNA, 418 bp, Zea mays
  Clone ID: LIB148-061-Q1-E1-F5
cccacgcgtccgcccacgcgtccgcccacgcgtccgcccacgcgtccgcccacgcgtccgggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaagtgtccggggtc

SEQ ID NO: 7506 - DNA, 412 bp, Zea mays
  unsure at all n locations
  Clone ID: LIB148-061-Q1-E1-F6
aagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcncgctcacccgcaacgacggcatcaagcagagcggcgtccgctac

SEQ ID NO: 7507 - DNA, 377 bp, Zea mays
  Clone ID: LIB148-061-Q1-E1-F7
cggacgcgtgggctgcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccgggcatg

SEQ ID NO: 7508 - DNA, 424 bp, Zea mays
  Clone ID: LIB148-061-Q1-E1-F8
ataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggtgactgtcatgtatattctgatgactgtcatgtatcttgttcatgt

SEQ ID NO: 7509 - DNA, 429 bp, Zea mays
  Clone ID: LIB148-061-Q1-E1-F9
gtttgatttccagaagtacatcaagcggtctctggaggatgacttcaaggtgatcgtggggatcagtcctcctctgtgggcttctgctctcatcttcctcttcctcaacgtcaatggatggcacaccatgctctggatctccatcatgccggtggtgatcatcctgtcggtggggacgaagctgcagggcatcatctgccgcatggcgatcgacatcacggagcgccacgccgtcatccagggcatcccgatggtgcaagtcagcgactcctacttctggttcgcacgccccaccttcgtgctcttcctcatccacttcaccctcttccagaatggcttccagatcatctacttcctctggattctgtatgagtacggcatggactcgtgcttcaacgactccgaagaattcgtctttgcacgactctg

SEQ ID NO: 7510 - DNA, 360 bp, Zea mays
  Clone ID: LIB148-061-Q1-E1-G1
tatactgactcctggaattgtaccacatgcaccacttaggcatcgtacatggggacgaacgaacattcaatggggatctatgcaacagcgtcctagcctggtgcgtccttctaaatcaccaaatggggcgcctccggtattggtaatatagacatcaagaaggctgttcaagatgtatgggcatcggcatgagacggtactggtaagcagacaatcgtcagacttacgggtgacttccttgtctgacaggtcaacttcacaggcccttgcatgggggacgtgacgatccagctggatgtcaaactgctgacgaccacggccgtactccattacaaggaccataggatatggatcaagatt

SEQ ID NO: 7511 - DNA, 428 bp, Zea mays
  Clone ID: LIB148-061-Q1-E1-G10
ggctttaccgtggatttaacatatcttgtgttggaattattgtttatcgtggcctgtatttcggactttacgattctatcaagccagttgtcctcactggcagcctccaggacaacttctttgccagttttgctctgggttggctgatcaccaacggtgctggtcttgcatcttaccccattgatactgtccgcagaaggatgatgatgacttctggtgaggctgtcaagtacaagagctcattggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccgggggtgcttaaatggagaaaaatgatgacgaa

SEQ ID NO: 7512 - DNA, 301 bp, Zea mays
  Clone ID: LIB148-061-Q1-E1-E7
gtcttgagctccatctcaagccttcatgcgactgtttttggagcgttttaagagagaaccttgtaccatgttaagatactgttgagcttgtgacgatgcgcacggtagaagaggaacctttttttttttgcggttggattgtgcaaactgcgagcagtagtgagtgtggtatatttgtgccttcagtttcctgttgggtggagtgttcttgtcgtttggcacggcacactagtattatcagcgctctgttgaaggatggatcggaatggatgcccagatagtctgggacttgtggtgatgc

SEQ ID NO: 7513 - DNA, 417 bp, Zea mays
  Clone ID: LIB148-061-Q1-E1-D2
cccacgcgtccgcccacgcgtccgcccacgcgtccgcctgggcaccatgctcgtggccggcggcctggccggggtcgccagctgggtgtgctgctacccgctggacgtggtcaagtcgcggctccaggcgcagggcgcggcgtcggcgcccaggtaccgcggcgtcgtcgactgcttccagaggagcgtccgggaggaaggcctccccgtgctgtggcgcggcctcggcaccgccgtcgcccgcgcgttcgtcgtcaacggcgccatcttctccgcctacgagctggccctgcgcttcattgccagcggcggcggccccaggctggtcatggaggacaagtgagtcagactggaccatgttgtacataggctagtataagtatccattccagtggttggtggagagtaccatgccac

SEQ ID NO: 7514 - DNA, 433 bp, Zea mays
  Clone ID: LIB148-061-Q1-E1-D3
cgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctcaaagattcactaccagaatatcaag

SEQ ID NO: 7515 - DNA, 401 bp, Zea mays
  Clone ID: LIB148-061-Q1-E1-D4
gttatcctcctcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacat

SEQ ID NO: 7516 - DNA, 420 bp, Zea mays
  Clone ID: LIB148-061-Q1-E1-D7
cccacgcgtccgcccacgcgtccgcccacgcgtccgcccacgcgtccggaagggcatcaccgcgccgcagatgaaggtgtgccaagaggcgtgcgacaaggactacgtggtcaaggcggctgaggtcaccaaggcctgcaacaccacctgcgccaaggagaagcagcctctgctcagcgagaactgcaggaggtcctgcacccctcctccttcctgaacgcagagcacgcccgccggtcgtcgtcttctgcctgcttgcgtgacactgaatcactgatacatcatacatgcatgcatgggatgcgatgacgatttgatgcatgcatgcatgggtatacctaccaatttgatgaccgacgatgtatagtttcgtcgactgcttcatacacatatatagcagcccaattaatgtaacgtcac

SEQ ID NO: 7517 - DNA, 421 bp, Zea mays
  Clone ID: LIB148-061-Q1-E1-D8
cccacgcgtccgcggacgcgtgggccacccgccacccgtcgacgccggcctctctcctcacccgctcggagagtcggagcccggcggccggagggcgacgtcgtccctaataaatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaacgcctccgtgcgcgccgagaaccccaacgagatg

SEQ ID NO: 7518 - DNA, 409 bp, Zea mays
  unsure at all n locations
  Clone ID: LIB148-061-Q1-E1-E1
cacacgcgtccgcaagcaagggcgcaaccaataatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcgganggagaggctgctggctgccattgcctgtattcggttggattccgtttatatatatatttaag

SEQ ID NO: 7519 - DNA, 403 bp, Zea mays
  Clone ID: LIB148-061-Q1-E1-E10
caatttccgcccaaggccaatgccagagatcccggtggcttctgttgaagcacggtgatcccggggcggtgaagaccacccaggcgagctacaggctgactccgcgtgggcggttgccgggcagctcggattcgttgcgaggttcacggcgtgggttgcacatcaaaacggcattccgatctctacggcctccaccgcgttcatggtggaaggaggcttctgcgcgacagggcccaaacggcagagaccgggtcagtgctgtttttctgcggatggtccaaggagtggggtcgatccggtagcgttcggcccgtgattcctggtggcagcaacacattcagccgagcctgcgtgactttcgcgcgagatggggaagacgcacccgaccagcgggtcccacacg

SEQ ID NO: 7520 - DNA, 413 bp, Zea mays
  Clone ID: LIB148-061-Q1-E1-E11
actcctacagttacttaaactggaatgacgattcgctgggtcccaatggagaccttcgtgtgtatctgcagaacctagccgctgcagataatgttcagcattttgttcgtgataatccgtttggtcaacctttcattactgagagcgatccgcattggaacttctatgctcagattgctgatagagggcgtgcacccttgacatgttgtgcttgaactcccaagggtcgtgcttttttctgggagttctgtggttatccatgatcaaaagatcatgatcagtatacagtgatcttctctgagtagtttgcttgtatccctgtactgaagattacagagtttctgctatgggtttaaattgcaggctctacgaaaggtatcagaccaaatgaatgaattgtctgacattatctc

SEQ ID NO: 7521 - DNA, 366 bp, Zea mays
  Clone ID: LIB148-061-Q1-E1-E2
cacacacgcagtctgcccaacgcgtgccgcttattttcttgtttttttttatttttattttttgtttttgtatttttttattatttttgtttctttgtttttgttattttttatttatttcttttttctttttatttttgttatttatttgtttcttttattttgtttaaaaaagaaaaaagcgggacttcaaaaggggaaacaaatgagtatcaaacagggcaacaatggcctcgacaaaagtcacattcaaacattggtgacttagacgggataatttaggtgaaaacacatttgggggccgggaaattcacaaatttggcgaggttttaaccttgcttctaaccaaaggaaaacatctgtggt

SEQ ID NO: 7522 - DNA, 415 bp, Zea mays
  unsure at all n locations
  Clone ID: LIB148-061-Q1-E1-E4
gaagacgacacgtatcctaagaaacaagctttgtttgatggggaaacacaattagctggagacgagcattctcagtcacagaaaatttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgngaaggttctcggtgctgccataggtggagctaccctctcag

SEQ ID NO: 7523 - DNA, 332 bp, Zea mays
  Clone ID: LIB148-061-Q1-E1-E5
gcacgcgtccgatcatcatctccgatgcatcaacaatcgccgatagcgatcgagagatacgtcaagatgagtaaagtggcatcatcgtcagccgttctcttcgtgctagccctgacgctaatgtgtgccgcgctgatagcagaggcagagcagaagacattcgcagccgccgccgccgaggagaagtaggtgcatgacaacttctgctcgacgctgtacgatggcacgaatgggatggacctgatggtgtgcaaggagtcctgcgacctctcacagcgctccaagttgatgttgtaccgtaggatccaatgcaatggcaagtgcaccgagca

SEQ ID NO: 7524 - DNA, 398 bp, Zea mays
  Clone ID: LIB148-061-Q1-E1-E6
cgcggcctgcggcgggtgctacgaggtgcgctgcgtggacagccccagcgggtgcaagcccagcgcggcggcgctggtggtgacggcgaccgacctgtgcccgcccaacgaccagcagtccgcggacagcggcgggtggtgcaacccgccgcgggagcacttcgacctcagcatgcccgcgttcctccagatcgcgcaggagaaggccggcatcgtgcccatctcctaccgcagggtggcgtgcacgaagcagggcggcattcggtacaccatcaccgggaacaagtacttcaacatggtgacgatcaccaacgtgggcggcgccggcgacatcgcggcagtgtcggtgaaggggagcaagcgcgttaagtggacggagatgaagcgcaactgggggc

SEQ ID NO: 7525 - DNA, 402 bp, Zea mays
  Clone ID: LIB148-061-Q1-E1-D12
agggagagtacttttgtgatatatgcaaattttatgatgatgatacagacaaagggcagtaccattgcatcgattgtggcatatgcagggttggtggcaaggaaaacttcttccactgtgtgaagtgtgggtcctgctattctgttatactccgtgataaccatcagtgtgtggagaactcaatgaggcagaattgcccaatctgttatgagtatctatttgactcattacaaggaacaagagttctgaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcctgtgt

SEQ ID NO: 7526 - DNA, 388 bp, Zea mays
  Clone ID: LIB148-035-Q1-E1-B3
gtcgatgcaagcctctacagtgactcgtattatgttcggcgtccgcatcaatgcgtacgaggacgccgcctccgtgctcatcgtctccaagatccactacgagaatatcaagatggaggactcagccaaccccatcttcatcgacatgaagtactgccccaacaagttgtgtactgccaacggcgcctccaaggtcatcgtcaaggacgtcaccttcaagaacatcaccggcacctcctccaccccggaggccgttagcctgctctgcactgccaaggtcgcatgcaccggagtcaccatggatgacgtcaacgtcgagtatagcggcaccaacaacaagaccatggctatatgcacgaacgccaagggcagcaccaagggttgcctc

SEQ ID NO: 7527 - DNA, 446 bp, Zea mays
  Clone ID: LIB148-035-Q1-E1-B6
actcgtgggtcgatacaagactctacactgattcatcataaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcgggctgaggtcacaaggcctgcaacaacaactgcgccaa

SEQ ID NO: 7528 - DNA, 399 bp, Zea mays
  unsure at all n locations
  Clone ID: LIB148-035-Q1-E1-B9
gtcgatggacgactctacagtgactcctcacatgtttcctctcgtgcgttctccgcaggagcgaggagggctcgcggcagcggcagggtctccggtgtttttgttccagaatctgtagcaaatggctgacggcgaggacatccagccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatggagaagatctggcancacaccttcta

SEQ ID NO: 7529 - DNA, 408 bp, Zea mays
  Clone ID: LIB148-035-Q1-E1-C10
gtcgatgcacgcctctacactgagtcctattaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcg

SEQ ID NO: 7530 - DNA, 418 bp, Zea mays
  Clone ID: LIB148-035-Q1-E1-C11
gtcgatgcacgcctctagaatgaatcgtactagactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggagagatttggagattttacaatatcatggctaccgttttactcagaagcaaaggtgttgttctttgtatatttgtggtaccctaagacaaagggaactacgtatgttt

SEQ ID NO: 7531 - DNA, 427 bp, Zea mays
  unsure at all n locations
  Clone ID: LIB148-035-Q1-E1-C2
ggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaacatctcacggcaagggagccctgntgtggaccaagaa

SEQ ID NO: 7532 - DNA, 393 bp, Zea mays
  Clone ID: LIB148-035-Q1-E1-C3
ctcacgggtcgatgcacgcctctaggatgagtcataataatgcatctcccctgcctcatgcccatcaaatcgttaaacttgttagatcggtacgcatacagaagccagactgatgggaatggcagcgaaggagcactttgtgcatgttcatggtgaagggcatggagcctggtgctggatcaagctccgctggctccttgagggtgctggctaccatgttacatgcattgacctaatcggatgcggcgtcgatcctactgaccccaacacaatccggtcgttccagcagtacgataagccactcatatacctcatttcaaccttgccggagggggagaaggtgattctaatcggacatggtgctggatggctgactgtgattcatgcaatgca

SEQ ID NO: 7533 - DNA, 385 bp, Zea mays
  Clone ID: LIB148-035-Q1-E1-C4
agggcaactccacagacgcgcgcttgcactctactcgtgtgctggggacctttgggtaccatgctccagaatacgccatgacaggccagatcaaccagaagagcgacgtctacagtttcggtgtgatccttctggagctactcaccgggcggaagccagtcgaccacaccatgccgaaaggccagcaaagccttgttacctgggccactccaaggttgagcgaagacaaagtgaagcagtgtgtcgatccgaagctcaacagcgactaccctccaaaggcggttgcaaagctggcggcggttgcagcgctgtgcgttcagtacgagtccgacttccggccaaacatgaccatcgtggtgaaggcgatcacgcctctcctgaacgc

SEQ ID NO: 7534 - DNA, 384 bp, Zea mays
  Clone ID: LIB148-035-Q1-E1-C5
tacactgatgtcgtcatgatcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgca

SEQ ID NO: 7535 - DNA, 454 bp, Zea mays
  Clone ID: LIB148-035-Q1-E1-C6
actcaatactaggacgcgtaggtcgttacaacaccctacactgagtcgtactacttctggctcacgacgatagccgaggaattcgaaggaccgaacgagaagctcctgcgtggtgtcaacgtctaccctaccgtaccagctagccaccacacgcgtagcgcgggaaatgccggcggcggcggccatgacgacgaggcgggtggtgctggaggtgctacggtcggcctcccgcgacgccttccaggtggccttctccttcgcggcgaggccgcccgtgtccaccatgctcaagccggccatcaccaagcccctctaccaccaccaccacgacaacgactaatctggcgcagatctacagcacggccgtcggcatgccttcacagcccggtgggtgtgacgactattgatgacgtactaccacatttcgtcgctcctaatccagtaagcaacgcaa

SEQ ID NO: 7536 - DNA, 450 bp, Zea mays
  unsure at all n locations
  Clone ID: LIB148-035-Q1-E1-B2
ctcgcgggtcgatgcaagcctctacactgacgcctggtaaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgncccactcaacggcctcgtccgggagcccaccgacgccaagttcctcg

SEQ ID NO: 7537 - DNA, 96 bp, Zea mays
  Clone ID: LIB148-034-Q1-E1-H8
aattcccaggcaggcaggtccgcgaggatggcaggaacaccgaagaccgatccgtccgggggctctggacaggaacaggacaggacctcaaaatct

SEQ ID NO: 7538 - DNA, 359 bp, Zea mays
  Clone ID: LIB148-034-Q1-E1-H9
gggccgacccaaacgtccaggcagagtcgtgcagctacttccagaagacgcaggacggcaccgtgacgatcggcatctatggcaaggagaaggcgacggtgacggtgtcggacgggcggatggccaggctccccggtctcatcctgagctgctccgtcctggaggccggcggcagcgtggacgcccacgacggcgtgctgtcgctggggaacggcgacatgtccttcgccgtccacgccgccaagcgcttcgggcagcgcttctccttctgcctgctcagcgccaacagctcccgcgacgcctccagctacctcaacttcgggcccaacccggcggtgatcggtccgggcaccatggag

SEQ ID NO: 7539 - DNA, 383 bp, Zea mays
  Clone ID: LIB148-035-Q1-E1-A10
gggtcgatgcacgcccctagactgagtcgtacaacccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaccagctcgtcgtcgtcggccactgaaagctgccgcgcgcgcgcgcgcgccgacccgtggaccatgcgtgcatgaagaagaatgcagggggtgggcctgggcctgtaacctgttaatggatcg

SEQ ID NO: 7540 - DNA, 412 bp, Zea mays
  Clone ID: LIB148-035-Q1-E1-A11
ctcgttggaccacactacactgagtcgtaatacaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagttctccggcaaacccgttggtggtgcacatcacg

SEQ ID NO: 7541 - DNA, 428 bp, Zea mays
  Clone ID: LIB148-035-Q1-E1-A2
cggacacgtgggccagccgcggcctgctcacctcggacaacgccctcatcgaggacccgcagacgagggcgatggtggagaacttcgcccggaacgagccactgtggcagcagaagttttcccaggcgatgcagaaggtcgggatgcttgacgtgctaatcggcgagggcaagggccaggtaaggaagcagtgccgcctggtgaacgggcaggagaaggagcagaagcagcagcagccaccggaggagcaggaggagcagcagccaccggagctggaggaggaggagcagcaacagccgcatcagccacagcttccatggttcctgcagaggcagcgcccgcccgttcttcttccatggctccggccccatccacggccgcgtcgaccgttccggaaacatccggtggccgacctggttaacggattt

SEQ ID NO: 7542 - DNA, 400 bp, Zea mays
  Clone ID: LIB148-035-Q1-E1-A5
ctctagaatgggtcgtacaatatgttggtacagaacgttgatcccagaacagacagttttttgacttgggaaagcctggagtcagtgcgtataaacaaagttggcttgaaaggtcctatggctacacctattggcaagggtcatcgatctttgaatcttacattaaggaaagaacttgggctctatgccaatgtcaggccttgcaacagcctcccaggctacatgaccagatacgatgatgttaaccttgtgacaattcgtgaaaatactgaacgagaatatattggtcttgagcatcacgttgtgacacgtgttgtagaaagtttgaaaattactacccgccaagcaagtttgacagtggcataatatgcttttcattatgccaaggccaatggccggg

SEQ ID NO: 7543 - DNA, 399 bp, Zea mays
  Clone ID: LIB148-035-Q1-E1-A6
agtgacagtcgaacaaggaaatcaagttcaaatgaaccaaagccatccttttataatgacaactgtacagtttttgtgtcaaatattgacttgaaagcaaatgaggatgatctcaggcgattcttctctgatattggtggtgccacagcaataagattgctgagggacagattcaccaaaaaatcaagggggttggcctatgtggactttttagacaacaagcatcttgaggcagctattaagaaaaacaagcagaagctgcttggaaagaaagtgagtatcgcgcgatcagatccaagcaagggtaagaagagccgtgaagcaggtcaaacaatccaggataatttacctccgagtggtggtgatgatgcaaaagcaacaggatccagtggaccagac

SEQ ID NO: 7544 - DNA, 399 bp, Zea mays
  unsure at all n locations
  Clone ID: LIB148-035-Q1-E1-A7
ctcgcgggtcgatacaagcctctacagtgagtcgtagtacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaaggggggaaggtanggccgaaccggtgcagcgcctgcaggaagagggttggacttacgggattcaactgccggtgtgggaac

SEQ ID NO: 7545 - DNA, 408 bp, Zea mays
  Clone ID: LIB148-035-Q1-E1-A9
acgcgcgggtcgatacaagactctagactgattcgtagtatctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcg

SEQ ID NO: 7546 - DNA, 352 bp, Zea mays
  Clone ID: LIB148-035-Q1-E1-B1
tacccgttgccaaatgaatagtcgcttcgtgcggtcccgtcccctcgccggccggcggagctcacggcttgccgctgcattgccatcgtgtcacttgtacacaatccaccaatctgattggattcgggggaatgcttgggcaaattcgaatttgctcaggcattcgttccgattgcggctagctagctgatcgcttaatcacccgacgcgggcaaatttgcacggcgacgacgatgggcatcttgtgttgtttccagtcccacaccagcgatcacgctgttgcttcgtccccggctacctcttcgtcctctgccccctcgtcgtgccgaaacaacgatcgccgttgctcccc

SEQ ID NO: 7547 - DNA, 397 bp, Zea mays
  Clone ID: LIB148-035-Q1-E1-B11
acaacactctagattcagtcatattatatgcgatgtttacatccctcacaattttggcaagtgccataatgttcaaggactggtctgggcagagtataagcagtattgcctctgagatttgtgggtttcttactgtgcttactggtactgttgtactgcattctacaagagaacatgatccaacccttacttcagatctgtatgctcctctttccccaatatattggcatatccaaggtaacggtgaaacaggaggaaagctgaaagaggatgatttactctctggcaatttcatcactgtggtgcgacaagactactttgtctagagaccttccacgatgctcaatgttctggattaaaagaaaagagaacaacactacggaaggatcctactgat

SEQ ID NO: 7548 - DNA, 387 bp, Zea mays
  Clone ID: LIB148-034-Q1-E1-H6
acaaaactcaaatctgagtcgtacaacaatcatgtctggtcgttcctcgacaataatggcgcctctcctggcgtcgatgctgctcgtctggctcgccgtgggctccgaagagggggaggactgcggcggcaaatagaaaccccaagtcaggcactgcaagtttaaggcggagccgtggatggacgggcacgctacgtactacggcgggcgcgacgggttaactgacaccacggactgcggcacgtgcggctacaagggcgagctggggaaagactacggcaccctgacagcggccgtgggcccgtcgctgtacaccaacggcaccgggtgccgcgcgtgctatgagctcaagggccccaacggcaccgttgttgtgacggccaccaa

SEQ ID NO: 7549 - DNA, 423 bp, Zea mays
  Clone ID: LIB148-034-Q1-E1-F2
gggccgagcacgcgtccagaatcagccatcctctccaacacgaagatggcgttcatcagcaatgtcgcagtgaaggcggcggccgtggccgcgctgctgctggtcgcagcggtgtcgcctgccgcgcgcgcggcggcggtggcggtggcaggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccagaggaactggatcgag

SEQ ID NO: 7550 - DNA, 410 bp, Zea mays
  Clone ID: LIB148-034-Q1-E1-F4
actcgactccgcccagtttttccaccaggcgctgtacctggggggcgtcaccgccgcccccgctcggcccacgctccgcctcatgaagcagaacctcgcgttcctctcgagcggggtcaccgagcaggcccagctgccggccgtgctcgaggtgatgagggcctccgtggaggccttcctgacggtcgtcctcgctggcggcagcgggcgggccttcgcccgcggggaccacgccgccgtggccgcggacttcgcgagcttgaagcgcctgttctgcagtttcggggtcggggaggaggcggtcgagagggagacggtgcgggcggaaggggtgctggcgctcatggccgttccgacggaacagctcatccatgagttgctcggccactatgcttccactccgatgagag

SEQ ID NO: 7551 - DNA, 404 bp, Zea mays
  Clone ID: LIB148-034-Q1-E1-F5
accacgcgtccggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatgga

SEQ ID NO: 7552 - DNA, 391 bp, Zea mays
  Clone ID: LIB148-034-Q1-E1-F6
acccacgcgtccggtgcaccaccccgctcaccttccaggttggcaagggatccaagcctggccacctgatcctcacccccaatgttgcaaccatatctgacgtggagatgaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcatcacctacaagaccacactcagcatctaatcagcctctgatgatgaattatatttcaaaagagctcacctggcgctcacgttagcaagacaatattttttctatggtta

SEQ ID NO: 7553 - DNA, 369 bp, Zea mays
  Clone ID: LIB148-034-Q1-E1-G1
caggccggtctgaattacgggtcgagacacgcgtccagaaagaagtcgcctaattctttcgatcgaattaggcgccttcttcgtcccacgctccgtctttatttgtaatctgaagcttacaggaacatttgagtggatcatggggggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgtt

SEQ ID NO: 7554 - DNA, 176 bp, Zea mays
  unsure at all n locations
  Clone ID: LIB148-034-Q1-E1-G10
agaacgtacccgttcaatgtaatgatctgtacagggaaattactcaaagtcgtgtcattaagctagattacaagcagagcgaaagcaagtgtgctcttttttagggtcggggtaattancccccgggttctcatgctcgggtttggtttactggtttgactgttgcgtaacatttc

SEQ ID NO: 7555 - DNA, 361 bp, Zea mays
  Clone ID: LIB148-034-Q1-E1-G11
acccacgcgtccgattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgttcgccatgcatcgacaacctattcttaataacgttcattatctcgttcttatttatgacgaatgtcatgtatgttctggtgactgtc

SEQ ID NO: 7556 - DNA, 222 bp, Zea mays
  Clone ID: LIB148-034-Q1-E1-G2
ggggaattctgacatctatagatatcctgatgcctgttatcgcccaaaatattcctcctgattccactacattctataaggtcatgactcagtgtcctgggtgtggctcagtatacaccccaattcttgatgctcgtcacacaatgcattatggaaaatttttacattttcctgttcttgacatggatggaaatcttgtgactgtttttgatgttcttcaca

SEQ ID NO: 7557 - DNA, 378 bp, Zea mays
  unsure at all n locations
  Clone ID: LIB148-034-Q1-E1-G3
gcgtccagttcatacggcatggatcagaacgacggctcgttcctcgccgtgcgacgcctctccggcggcgccatccaccaccatcgccaccactcttcgccggctgaggtcgtgggcgtggccacggcgtcgatcgggaaggggcttacgtcgtgcgtgtgcgcgcaggggacggagagcgacgggcgcctctccttcgatttgagtcccattcaggaagagtgcttgcatangttgcagaacccgatagaggtgcagtatgatggttcaaatctagagcatcagaaagcactggtgggcctttggcatgcttcttttcctggaactgaacttctaggattagtatcagaccaatgggaggagatgggattgcaaggg

SEQ ID NO: 7558 - DNA, 121 bp, Zea mays
  Clone ID: LIB148-034-Q1-E1-G4
aaaaaaaaaaaaaaaaataaaaaaaaaaaaaaaaaaaaaaaaaacaaaaagggcggacgcacaaaaaagatcaaaaacttaaataaacatgcatgcaaaaatcaataactcttcggtaggg

SEQ ID NO: 7559 - DNA, 187 bp, Zea mays
  Clone ID: LIB148-034-Q1-E1-G5
aggcacgtcacgccccgcgactggcagttcggcaaaacgtaccaggccaccaagaacttctagggtcggatcggggagctgagccgcgcccttctttatatgtagatatatgcatgaagcggattatattggactgttgtactgtgtactaccttgtttattccatgattaacatattgttatattg

SEQ ID NO: 7560 - DNA, 415 bp, Zea mays
  Clone ID: LIB148-034-Q1-E1-G6
caagcctctggctgtctccctcgcatttggtgataaactcttgaagcagtatgttgtcgctgaccctgaaatcaaggatgaggtggtcgacagctcccttgaattcctcatcgtggcgagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattgcctcctgtagggatccatcatgcgtgtgttttcttctggctgttgtatctgatgctcaaagtagatgctccgtgtgtc

SEQ ID NO: 7561 - DNA, 354 bp, Zea mays
  unsure at all n locations
  Clone ID: LIB148-034-Q1-E1-H1
acgcgcatgccgcagcatataggcatagccacgcccacgggcacgggccatgtgatgactgtcacgatgggcatgatgaggagccgtcccaagctcgtcatgttgtcgggtcggagattcttgancttgggattgtatcgcactcagtgatcatccggctatctttgggcgtctcacagaatccttgcaccatcaaacctctaagtgctgctctctccttccaccagttttttgagggctttgcatttggcggctgcatttccgaggctcagttcaagagtttctctgcactccttatggctttcttcttcgctatcaaaagacctgctgggattaccgtggggtctggtatcg

SEQ ID NO: 7562 - DNA, 413 bp, Zea mays
  Clone ID: LIB148-034-Q1-E1-H10
tttttttttttttttttttttttttttttttttgttattttttgggttttgttggttttttttttttattttaaaattttttttgttttttttattttatttttttatttttgtttttttttttgtttttttttttttttttttttttttttttttttttttttttttttgttttttttttttttttttttttttttttttttttttttttttttttttttctttgtttttttttttttttttttttattatttttttttttttttttatttttttttgtcttttttttttttttctgtattttttttttttgtttttttttttttttttttttttttttttgtttattttttcttttttttttttttttttttttttttttttttttttttttttttttttttttttttttt

SEQ ID NO: 7563 - DNA, 328 bp, Zea mays
  Clone ID: LIB148-034-Q1-E1-H11
aatcccttgtcgatgttccacacacatgcaggggaactgacgaatggcggcgcgctggacccggcgggcctggtggcgatcgcgatcgcgcacgcgctggcgcggttggtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgcgggcatcagcgagctggagggcg

SEQ ID NO: 7564 - DNA, 307 bp, Zea mays
  Clone ID: LIB148-034-Q1-E1-H3
acaagaacctcctcgcctcctccattgaccaacaattaagcctccccgaccgccacatctattaggtgcagccatgggtgcctgtgcaacgaagcctaagacgcttgaggggagggccccagctgaggccaccatctccacacccaaggttgcacctgagaccactaccatccacattgaggttgcggcaaaacatgcagtagttcagaaggtggaggaggacaaggaggaggcactaacagtggcggcgaaacaagagccagcagccaccattgagcctcagcagattgctagtcaggtgaccact

SEQ ID NO: 7565 - DNA, 406 bp, Zea mays
  Clone ID: LIB148-034-Q1-E1-H4
agccagatcaacatcacccgcaccatcaagctcgccatgggccgcggcaaggtggacggcaaggagcggttcggcttcaacggcgtgtcgcacgtcgaccccgagacccgcgtcgggctcgccgagtacttcaacaccaccgacggggtgttccagtacgacatcatcggcgacgtgccgccctccaagtccgcgcccaccaagatggcccccaacgtcatccgcgccgagttccgcaccttcatcgaggtggtcttcgagaaccccgagaagagcatcgacaccatccacatcgacggctacgccttcttcgccgtcggcatgggcccgggcaaatggacgccagcgtcccggagcacgtacaacctcctggacacggtgagccggcacacgatccaggtgtacc

SEQ ID NO: 7566 - DNA, 391 bp, Zea mays
  Clone ID: LIB148-034-Q1-E1-H5
atcaaaccatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgcc

SEQ ID NO: 7567 - DNA, 366 bp, Zea mays
  Clone ID: LIB148-034-Q1-E1-F12
gttcggtgcctttttctagcggggaggaggcaggcggcgcaatctggcaccggccatcacgttccctccggccgcttccccctccctgccctccctttccccagatgggaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacacggctggcgcggattccgggcagtcacgggaaggatgatgctggact

SEQ ID NO: 7568 - DNA, 426 bp, Zea mays
  Clone ID: LIB148-061-Q1-E1-B9
gcaggtccagagatctcgatcggtcctcttgcagaaacgaggaaagaaaacatgtcttctcgctgggttagggcggaggtgtacccgctgttcgcgacgacaggggtggcggtggggatctgcgtgatgcagctggtgcgcaacatcaccaccaacccggaggtgcgggtgaccaaggagaagcgggcggccggggtgctggacaaccacgacgaggggcggcgctactcgcagcacggcgtgcgcaggttctggctctccaagcgccgcgactacatgcaggccatggacaaggtgcccacggaccctaataagtagacgacgacgatataccccaatgcatggcaagaagatatatatatcagcacaacgcaactgcatgcgatgctgcttgttgctgcaattaatccactatactatatacta

SEQ ID NO: 7569 - DNA, 418 bp, Zea mays
  Clone ID: LIB148-061-Q1-E1-C1
cgaccacatctccatgtccaactgcgaggacggcctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatg

SEQ ID NO: 7570 - DNA, 412 bp, Zea mays
  Clone ID: LIB148-061-Q1-E1-C10
cccacgcgtccgcccacgcgtccgcccacgcgtccggtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggt

SEQ ID NO: 7571 - DNA, 410 bp, Zea mays
  Clone ID: LIB148-061-Q1-E1-C11
agcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcct

SEQ ID NO: 7572 - DNA, 453 bp, Zea mays
  Clone ID: LIB148-061-Q1-E1-C12
ctcgcgggtcgacacacgcctctacagtgatgcacgataaggaggtggcgatgcggagattcctgggcagccgggtgaagacagcgatggagccgcggtcagagtcggagcagccgcggcgccgggaggtggctcggagcaacgacgtgatcgaggcggcacgcaccaagctgatgcagaagcgccagtgcagcagggtcaaggcgctcgtcggcgccttcgagactgtcatagacacccagaaggacgccgccgccggcaggccacaacacatctaccgcaagtcagcttaaaacatactgcggcggcggggacgcatcgatcctccacgcttcgtgtcttcgccttaattaattaattaattgttatgatcatgtcggccagcccaacgccgtatgcatgcatgcacacggcgctaattaatccctgtttatttactactccgtgaaatgt

SEQ ID NO: 7573 - DNA, 324 bp, Zea mays
  Clone ID: LIB148-061-Q1-E1-C2
actcacgggtcgacacacgcctctagagggactcacattagagacaggatgtccaccgcgcacgcgctgcacaccctcccgccgctgccgctgcagaacggcaccgccggtgacgacgaccgcgacgaagacgttgatgaggacgaagtgggcgatggcgaagccatggaggaggatgacaacgaccatgaggacgatccgccggtcaagtatcagcggctaagctgcaacgtggcgcgaatggtctccatggacgcagctgttgacatcgccgtcgccgaacgcattgtcgcgctcggcactcacagaggaactctccacatc

SEQ ID NO: 7574 - DNA, 427 bp, Zea mays
  Clone ID: LIB148-061-Q1-E1-C3
gcgaccctttacctcaaattgttaggtggggaagctacagtgggtgagacagagaaggatgtgaatgagtttctcttcggctcacttgatgttccattagtaaacttggagacgagtctgcggaattatgaaccttcggatgtaccttttgatatttcatctgtttcgaaggaaacaaaatcccaaccccttgcggagaaaaagtctacaggcaagaaatcagcaggtccagcatctgctgtcagtggctctgtttctacagttgatgcttcgtatgagaagcttctttcgtctattccggaattcgctgattttggaaagctttttaagtcatctgcacctgtagaattgactgaagctgagaccgaatactcagtgaatgttgtgaagcatatttttgatcgacatgttgtgctccaatacaact

SEQ ID NO: 7575 - DNA, 316 bp, Zea mays
  Clone ID: LIB148-061-Q1-E1-C4
cgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacaccttttgtcctctttttctttgttccctctttctccttaatttaacgaattgatgcatgccgctgatgttcttcccctgagagagggattaacacttgtatcatttcatcgcttgccatttgtttgaatccattcaacaattcattca

SEQ ID NO: 7576 - DNA, 417 bp, Zea mays
  Clone ID: LIB148-061-Q1-E1-C6
gaaaaactggatcaaggcaatggccatgacagcatcacttttcccatttatgtgctttggaatcggcttggtgcttaacactattgctattttctatggatcgttagctgccataccatttggtacgatggtggttgttttcatcctgtgggccttcatctctttccctcttgcacttttgggaactgttgtcggtagaaattggagtggtgctccaaacaatccctgtagggtgaagactattcctcgccctattcctgagaagaaatggtacctcacaccatctgtcattgcgcttatgggaggactgcttccttttggtagtatctttattgagatgtactttgtcttcacatcgttctggaactataaggtctactatgtttacgggttcatgttgctggtctttctgatact

SEQ ID NO: 7577 - DNA, 432 bp, Zea mays
  Clone ID: LIB148-061-Q1-E1-C7
gaaccctacctcacgtcccggatcccatccggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgcgaagctctctggcctatttttcgtatttctcatcaaaggagccgctacatatatgatctttactac

SEQ ID NO: 7578 - DNA, 403 bp, Zea mays
  Clone ID: LIB148-061-Q1-E1-C8
cttcctccccgtccccacccacatgccctgcctccgccccgccccgccctgcccaagctgagttcccccacccccaacaaacaattactagagtagctgcattggcggggaaattaaagcgctagaagctcagcagcaatggcggagcaggcgggcgtcggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgcggtggctcaggtgcaccccggcgccgaccgcccgagctccatctgggcgcacgctatcctcagcacggtcgacagctccgcccgtcgccgccgca

SEQ ID NO: 7579 - DNA, 424 bp, Zea mays
  Clone ID: LIB148-061-Q1-E1-C9
gaatgatgtcctcagctccatgcacaaggatgctggagaggcaggagaagtaaagagcgcagaaggagagttcttattgcgtgttgatggtggtgctactgttaataatcttctaatgcagatccaggctgatttattaggcagccctgttgtcagaccagctgacatagagaccacagccctcggagctgcatatgctgctgggttggctgcaggagtttggaccaaggagaaggtttttgcaggtttgcacaaggagaacacgacagtcttccgcccgaaactggatgaggcgcacaggaaaaagagggcggattcatggtacaaggcggtttcaagatcattcgatctggctgatctttctctgtaaatttatcctgccagcgctcctctatctggttttggaagctgcaaatgaataaat

SEQ ID NO: 7580 - DNA, 434 bp, Zea mays
  Clone ID: LIB148-061-Q1-E1-D1
agagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgtattgtaaattgttttgtaagcgatgcgcctcctggtttgtgtgccctgtc

SEQ ID NO: 7581 - DNA, 194 bp, Zea mays
  Clone ID: LIB148-061-Q1-E1-D10
caatgtgtttggttgttggatgctgagagattggttctcagctcagatgcaagctgcgcctagcctgtgtaggtttgtgctggtacattgagagctcttatttatttgctttgattgcaattaaccaggatgaccatagcccttgtttggtttgctgtttttataagttgcatgaacacaacttctgtttggtt

SEQ ID NO: 7582 - DNA, 428 bp, Zea mays
  Clone ID: LIB148-061-Q1-E1-B8
caaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgcatgcct

SEQ ID NO: 7583 - DNA, 427 bp, Zea mays
  Clone ID: LIB148-061-Q1-E1-A2
cacacacatcaggtaccatctcggtaatgatgtctggacgggccacttatgacagacctgcaccgccgtcgtcaagaagggcgaccacagaggccatacagtggccgtcatgatcatctctaaagctaacatgacatccggcatttccagtgcagatgttcgtatggacgtcaagattttgaaatccctatcagggcaacataatctcgtcatattccatgatgcatgtgattgacccctcaatgtctacaatgtcatagtactaagtgcaggtgaagacttgctagacagaattttaccaaaatgtgggagatatccatgggaatatgccatagctatcattgtacagattttgagcgtacaggccttcagtcatcatcatggagtaatgcatcgtgatttgaagccagagaattttctcgtcaca

SEQ ID NO: 7584 - DNA, 427 bp, Zea mays
  Clone ID: LIB148-061-Q1-E1-A3
gggtcgagggacgagtcacgtggtccagctcaatattacagtcgtgaaaggtactaacttagccgttagagacatgctaacaagtgatccatatgttgttttaacactcggagggcagaaagctcaatcgacagttaaaaaaagtgatcttaatccggtatggaatgaaatgcttaagatttctgttcctcgaaattacggacctctaaaacttgaagtgtatgaccatgatacgttctcagccgatgatatcatgggtgaagcagagatagatctccaaccaatgatcacagccgccatggcctttggagatacttcacgtcttggtgacatgcaaattgggcggtggttcacgaccaaagacaacgccctgatgaaagatagcacagtgaatgtcgttgcaggcaaggtaaaacaggaggtgcac

SEQ ID NO: 7585 - DNA, 404 bp, Zea mays
  unsure at all n locations
  Clone ID: LIB148-061-Q1-E1-A4
gtgaccatcaccaagactatgaagaacgtgaccctcttangtgacggctccaagaagtccatcgtcaccggcaagaagagcttcgccgacgggatcacgactttcaagacagcaaccttcactgcgcaaggcgacgggttcatggcgatcgggatggggttccagaacacggccggcgcggagaagcaccaggcggttgcgctgctggtgcagtcggacaagtccatcttcctcaactgcaagatggacgggttccaggacacgctgtacgcgcactccaaggcgcagttctaccgcaactgcatcatctccggcacggtggacttcatcttcggcgacgcggcggcggtgttccagaactgcatcctggtgctgcggcggcccatggacaaccagcagaacat

SEQ ID NO: 7586 - DNA, 405 bp, Zea mays
  Clone ID: LIB148-061-Q1-E1-A5
ggcgtggcgctgggcgactacttcctcggccccagcctcgacgctctggtgcagcagctcgccgagaacgacgcgggacggcacgggacgccgccggccaagaaggaggccgtggaggcaatgccgaccgtggaaatcgccggtggcaatggcaacgatgacgacacggccagctgccccgtctgcctggaggactacgcggccggcgagcgcgctcgggagatgccctgcaggcacaggttccactccaattgcatcgttccgtggctcgagatgcacagctcctgccctgtctgccggttccagctgccggccaccgacgacaagggctcatgcagcagcggcgacggtggttttgtcagtgtcgacgcggatggtgaaggcaatgacaacggcggcggcgat

SEQ ID NO: 7587 - DNA, 398 bp, Zea mays
  Clone ID: LIB148-061-Q1-E1-A6
gccatgaccttgagcaggccaccatgctggcctctgactgcctaacaaccagatggtgtgattctctgtcgccatgtgatacgtgacggaacagtcgaggtagaggaggaggatgcacggccggcattctcctccttcctgttgcaccgccgtttattaatccctaacttttcatccctttctatcaggccatcctactagcctcaatattgctagtcgttgccgttgtggcgtagatctaacagtactattggtaataaatttgtaatacattgaggtcgatgataatatatatatatatattatatagtcgttgtgcactaatattttattaaatatttatgtgccgtcgtaatgacgggcactttactagtaacaaattaacacacgtctttgtg

SEQ ID NO: 7588 - DNA, 434 bp, Zea mays
  Clone ID: LIB148-061-Q1-E1-A9
cgggtcgacccaaacgtccagcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatg

SEQ ID NO: 7589 - DNA, 413 bp, Zea mays
  Clone ID: LIB148-061-Q1-E1-B1
ggtcgatacacgcgtctacacacgcgtctgctcgtttctcattcagcgcccgtacagccaccactctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtctgagccggggatctcctgctgctcggtgctggccggagtcgtgcagaccgacccccgctgcctctgcatggtactggacggcactgccacgtccttcggcatcgccatcaaccag

SEQ ID NO: 7590 - DNA, 414 bp, Zea mays
  Clone ID: LIB148-061-Q1-E1-B10
gcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatc

SEQ ID NO: 7591 - DNA, 108 bp, Zea mays
  Clone ID: LIB148-061-Q1-E1-B11
aaatgagtcgtattaaaaaaaaaaaaaaaagggaagaagaacaaaaagagaaaaaaaaataaataaacaagaaagaaaaaatcaaaaatcaacaaaaaaggtcaaaaa

SEQ ID NO: 7592 - DNA, 420 bp, Zea mays
  Clone ID: LIB148-061-Q1-E1-B12
tcgcgggtcgatacaagactctacatcgcttcgcagaatctcgtcgtcgccttggcgacgtgtacaaacaagtctgttgatgcccgcgtggtccaccccatcgtcaccctcgaggccgatggctcatctcccacctctggcgatggtcgtcgcctgatcagctccaccaaccaagatgaacttggagcgttatgccaacagatgcactacaagacgttgtgctccacgatgacgacactgcctggggtgactacgccagagcaactcttagatgcatccctgcggattacagcggtgaaggcagcgatggcggagatgaagctagacaatgcaataaaatcaggcagtgctcagggtaacccgatgatgtcgtcgctaaagacatgcaaggagagctacgcgtcgctggtagactccatc

SEQ ID NO: 7593 - DNA, 376 bp, Zea mays
  unsure at all n locations
  Clone ID: LIB148-061-Q1-E1-B3
tggctcaacatcagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccangaggagtgcgacaaggcgtacgtggtga

SEQ ID NO: 7594 - DNA, 433 bp, Zea mays
  Clone ID: LIB148-061-Q1-E1-B4
gtgacatcaagccagacaacttccttatgggcttaagtcggaaagctaatcaggtctatatcattgattatggacttgctaagaaatacaaggaccttcatactcataaacacatcccgtacagggagaacaaaaatctgactggaacagcacgttatgctagtgtgaatactcatcttggaatagaacaaagtaggagagatgatctggagtctgctggctatcttctgctatattttttaagaggaagcctcccatggcagggtcttaaagctggcactaagaaacagaagtatgacaaaattagtgaaaagaaaatgcttacgtcagcagaggttctttgcaaatcttacccgtcggagttcgtctcatatttcaactattgtcgctccctgcgatttgaagacaggccagactactcttttctgaagaa

SEQ ID NO: 7595 - DNA, 430 bp, Zea mays
  Clone ID: LIB148-061-Q1-E1-B6
ctagcgatggctggagcctgggcactgctcatcgtcctcgcggctgccgtcgcggtcctggccgcgcggccggcgtctgcaggcgggggagccgcggcggtggcggagatctgcatgaagactccgtcacgcgacctgtgcaccaggacggcggggaagcacgccaacaagtacaacgtggtggacgcggtgacggtgctagagatgcacgtggacgcgttcaagaagcgcgtgaaggcggcgcggaggctcgccaaggatgaggtcaagacggccgcgacgcccgaggcgcggacggcgctgaacctctgcaagacctactacctggacgccgccgacaacctcggcgcctgcaagcgcgccatcggcttccgcgactccgtcaccatcagcgccacgatgagcatggtggcgcaggacacgcagaact

SEQ ID NO: 7596 - DNA, 377 bp, Zea mays
  Clone ID: LIB148-061-Q1-E1-B7
caaacctgagctcgagaagaaagtgctagcagccgctgatgccagtacgtcctagtgacacaagtggaagtgggcaaacgatctgtgatggcttcccggtgtatagtttccatggttcatttgtgtgcttgtcccatgtttgcctggggacgatgacgttttacaattttggcccccatcgcgcgcactcgtctgtttctctcatggaagccgtgtgaacctgtgcgtgtgtgtgacgaatgaacggaactttatatggaccagtgcttaagagtctttgcaacataattatgaaggtttgtttgcaaaaaaaaaaacagaaaagtaaagaataaaaaaaagaagtaaaaaaaaaagtaaagaaaggggggccgctc

SEQ ID NO: 7597 - DNA, 435 bp, Zea mays
  Clone ID: LIB148-061-Q1-E1-A11
cgggtcgatccaaacctccaggcaagggcgcaataaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaaaatg

SEQ ID NO: 7598 - DNA, 425 bp, Zea mays
  Clone ID: LIB148-060-Q1-E1-G7
gaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaaccatcagcagtccatgcagaggaaaatattgccaccaac

SEQ ID NO: 7599 - DNA, 395 bp, Zea mays
  Clone ID: LIB148-060-Q1-E1-G9
aggtgcaagcccagcgcggcggcgctggtggtgacggcgaccgacctgtgcccgcccaacgaccagcagtccgcggacagcggcgggtggtgcaacccgccgcgggagcacttcgacctcagcatgcccgcgttcctccagatcgcgcaggagaaggccggcatcgtgcccatctcctaccgcagggtggcgtgcacgaagcagggcggcattcggtacaccatcaccgggaacaagtacttcaacatggtgacgatcaccaacgtgggcggcgccggcgacatcgcggcagtgtcggtgaaggggagcaagcgcgttaagtggacggagatgaatcgcaactgggggcaagtgtggcagaccggggaggacctcacatgcgaatcgctgacgtt

SEQ ID NO: 7600 - DNA, 315 bp, Zea mays
  Clone ID: LIB148-060-Q1-E1-H1
ggggggaacccaggctgagaagcccgctgggggggcctaaggcgaagtcgccaccgaacaagattgacgttgtgaaggacaacgacatgtggcagtgcctgaaccagtgcgccggggagatcgatgaggcgctggaccacctggacgacaccgaaggctgcctcgacgacggcaagctccacgacgtgaagctgttcctggacacggcggaggaggacacgtggtcctgcgacgtctgctgcaagcacgccccatccacgcccgtcaaaaccacgctgctcgccaagaaaaaggacttcgaggcgctcatgcgcg

SEQ ID NO: 7601 - DNA, 435 bp, Zea mays
  unsure at all n locations
  Clone ID: LIB148-060-Q1-E1-H10
ggtccagggtccacccacccgtccgcggacgcatgggcgggagcacagagctagctagccagccagccagcagccagcttgctcgccgcgcncgtccttcttcctcgcctccgttccattccgtcncgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacac

SEQ ID NO: 7602 - DNA, 446 bp, Zea mays
  Clone ID: LIB148-060-Q1-E1-H11
gtcgatacacgcctctacacacacttctgttaatatactaactcgacccaagatttaataaagtcaaggtacccaaaaacaaacccatgggatataatgcttggcatgaacctctgggggaccatatataatgctgtaattatgtttgttgcgccattactattcagtaactggccatatgcaaatggttttgaggcattgagattttgccaggagaacccagaggtggcctgggacattttcctattctgcctatgtggcgccgtggggcagaacttcatcttcttaaccatcagccggtttggctctcttactaacacaacaatcactaccacccgtaaattcatgagcattgtggtttcatccgtcatcagtggcaatccattatctttgaagcaatggggtagtgttgtgatggtcttcttaagcctctctatccaaatata

SEQ ID NO: 7603 - DNA, 407 bp, Zea mays
  Clone ID: LIB148-060-Q1-E1-H2
gggtcgagcacgcgtccgctctcactgtctcgcggcccggggaaaaaggagggctccgcggtccccggggaaaaccccgcaattgcggcggccgccctgacgggggaaaatggttgccaagaattcaaaattgatctcaacagcccccttgttttccaagtttgccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcatactgttcaggacgtagctatgatggctctgtttgggatatttatttggacgctgatcgaatacac

SEQ ID NO: 7604 - DNA, 427 bp, Zea mays
  unsure at all n locations
  Clone ID: LIB148-060-Q1-E1-H3
cccacgcgtccgcggacgcgtgggcgatcaccaatgtgggcggcgccggcgacatcccggcggtgtcngtgaaggggagcaagcgtgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggtgtcacgtaccaggcatccanagaacttctaagtagccacttttcctcctcttcttcaacctgcatatgcccacaagcaaccatgcagatgataacatgcatcatgcatgcatattcattctttcgctcatgcattccgatatggtgccggagttaanaaaatgtaaatcaatgtgcaaactcaaatgacat

SEQ ID NO: 7605 - DNA, 273 bp, Zea mays
  unsure at all n locations
  Clone ID: LIB148-060-Q1-E1-H4
cacgccaaagcccctgacgcctggcgggcgcgtggtacacgacaaccacggcaagttcacggccgggccgtggaaaccntgccacgcgaccttctacngcgggcgggacgggtccggcaacacggcgggcgcgtgcgggtacaaggacacgcgcgagcaagggtacngcgtgcagacggtggctgtgagcacggtgttgtttggcgatggcgcggcctgcggcgggtgctacgaagtgcggtgcgtggacagccccagcgggtgcaagcccga

SEQ ID NO: 7606 - DNA, 412 bp, Zea mays
  Clone ID: LIB148-060-Q1-E1-H5
gcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggaggaggacacgtggtcctgcgacgtctgctgcaagcacgccccatccacgcccgtcaaaaccacgctgctcgccaagaacaaggacttcgaggcgctcatgcgcgtcgcccacgcgctcatcaagc

SEQ ID NO: 7607 - DNA, 425 bp, Zea mays
  Clone ID: LIB148-060-Q1-E1-H6
agccggccgggcggcaccgccatcggagtacgtacacacgtcctgctgtcccgcatgccaccggccgggggagaaaaccaacagccaagccaagcccacattgtttccgcagctaggtagaggggcaaaggaggagtatagcggagaggttgatgcgtgacggaggaggcgccatggacgtcgacatgcaagcccgcggtggcggtgctagccatggcggcgaacttgacgacgacggcaaggagaagaggacagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaacgactgcctacgc

SEQ ID NO: 7608 - DNA, 414 bp, Zea mays
  Clone ID: LIB148-060-Q1-E1-H7
ctgctcgccacgcccctcgcagacggagcttccgaggcagaggcggcgggcctcgcgcagggcgcgtccgaggcggcggcgccggacgcgggcgcggacgcgcagcagcagcacctcctgccgcggcccctcgtcatcgagctcccgtcgtcgcgggccgaggacgaggacgagcccggcgccgacgccgtgccgccggacgtgcgctgcgccagctggcggctggcggcggaggccaacaacctcgcgccgtggagggcggtgccgccggagtgcgcgccgcacgtgcgggactacgtcaccggcgtcgcctaccgctccgacctcgacctcgtggcgcgggagtccgccgcctacgcgcgcgccgctgcgccgctcggggccgacgggcgcgacgcctgggtcttcgacgtc

SEQ ID NO: 7609 - DNA, 403 bp, Zea mays
  Clone ID: LIB148-060-Q1-E1-H8
atcaggctggagcagctggacgtgtcgcggaaccagctcgccggcgccgtggcggagaacgtgtgcaagctcccggctctcgccaacttcagcttcgcgcacaacttcttcagcgtcgaggcagaggcgtgcgtgccgtccgaggactcgccggtggcgctggacgatagcggcaactgcctcgatggcggacgcccggggcagaagccgttgcctgagtgcgcgcttgtgctcgcgcaccccgtcgactgccgcacgaacgtctgttccaagatgcctgcgccaccagcgaagaaggttcctaggccaccagacgttagtccacatccgttgccaccagcgccatcaccgggagaacaaccaccaaagaagtccccagcaccacagccagtgagcccaaaag

SEQ ID NO: 7610 - DNA, 418 bp, Zea mays
  Clone ID: LIB148-061-Q1-E1-A10
acaatatatttcgggatttagctcaggcaacatagtttttggtggcagcgggaattctgtagggcaaacgaaaagcaaccaaatgagctggtcaaacacgtctaatctaatgggcacgaactcaactgacagctatttgaatcagagcattgcagctctaggtttcggaaatccaaatggaggattgagcacaggtctctccaatccaagtagttccagtacaggcctgagcatgatgcaaccaaaatctgattctggatcactgtcgacgtcggtcaacaatgccgcacatgggctgctaagacttgcccctcctccatccacatcggttggaagagggcgcggtagaaatcaaggacagtccgcactctcccgagcaacaaggcctcatgccaactcggcatcaggacaacaacct

SEQ ID NO: 7611 - DNA, 424 bp, Zea mays
  Clone ID: LIB148-060-Q1-E1-G6
accacgcgtccgctttcgttcctctgttcctcaacctgactgcatctgtgcggcgctacaaccagtttgaaacccagtctgctgctagcatggcacctcgtgtggaccctctgcaagctgtgcagactcctgttgatgacatgatgcgtcatgcgtatgttgacccaaacgatcctaccaagatcttccttcagcaacctgcgccagaatcgcagctgaggaggaggaactaccacggcccagctgatgcaaattagcgcttggctggattggcagaactcatgctcaattaagtgctgtgtccattttagcatttcacctatccttgtcgtttaccacaactgacttccatattcgggtacccctgtttcctgtgaccttacatatataggacataatgttgcgagttctcgcaatatggtat

SEQ ID NO: 7612 - DNA, 401 bp, Zea mays
  Clone ID: LIB148-034-Q1-E1-D4
agttcaacagcagtgcggcgatgaaggcagccgtggccgctctgctggtgttcgccgcggtgtcgcctgccgcgcgcgcggtggcggcggaggcggaggcgaaggcgaagggggtgggaggcgcgccgtcggtgcccgctggcgcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaactggatcgagatccagaacgtc

SEQ ID NO: 7613 - DNA, 408 bp, Zea mays
  Clone ID: LIB148-034-Q1-E1-D5
acccacgcgtccggcatgatgccttcttccctccctcattctcgctcgcccccattccaccttcgacgacccctttctccttctccctcctcaatcacctgcagcgaaaaggaaaagggtgtcagaccgtaactaagagctatttagcaataatacatacatagctataccctctttaggtcaagagggtggagttctccttattcggaggaagagctccatcctcattctacaagaccaaaccaataaatggcctctagcccacagtcctcgccatcatcctccaagaagtcgccgccaccacaagaagcatcagctttggcgccaaaatcatcttcaaagtcaccctcgccaccaaagggtgaatcaaattcatctcccagtcccgcatcgaaatcgtccctggtc

SEQ ID NO: 7614 - DNA, 405 bp, Zea mays
  Clone ID: LIB148-034-Q1-E1-D6
acctcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacaccgatggcatccacatgggcgactcatccggga

SEQ ID NO: 7615 - DNA, 386 bp, Zea mays
  Clone ID: LIB148-034-Q1-E1-D7
accctccccctcttatctctttctcttctcccattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtggagttgttcggatcgggtgacgacgagggggcgggtgagttggtggatgaccattccgtagacgtctcagccgctgt

SEQ ID NO: 7616 - DNA, 200 bp, Zea mays
  Clone ID: LIB148-034-Q1-E1-D8
aacaagagctacgcaaactcacagcgatgcacaagcacgagataccagccaccatgcgcctgtccctcctcatcgtcatcgtggcagccatctcggcgcgcaccgctggggatactccgctggcaggcggcggctgtggagccctgaagccggacttctatagccagtcatgcccgcgcgctgatcggatcattgcggag

SEQ ID NO: 7617 - DNA, 376 bp, Zea mays
  Clone ID: LIB148-034-Q1-E1-D9
ggcaaaggctctcctaggtggcctatcggcgatcctcgtcgtggcggtggtcgtcggtgtggtcgccaccgtcacccgctccggcaagaaggccggcgacggggtcacggtcccgggggaggcttcacttgccacgtccggcaagtcggtcaagtccctgtgcgcgcccaccctatacaaggagtcgtgcgagaagacactgtcccaggccaccaatggcaccgagaaccccaaggatgtgttccacagcgtggccaacgtggcgctggagtcggtccagacggcggtcgagcagtccaagtcgatcggcgaggccaaggccagcgactccatgaccgagagcgcgcccgaggactgcaagaagctcctggaagac

SEQ ID NO: 7618 - DNA, 397 bp, Zea mays
  unsure at all n locations
  Clone ID: LIB148-034-Q1-E1-E1
agcgtcatcccgcacgaatccgcgctccggccaacgggccaagccctagccacccccgcccattcatggtgggcgggccgtgagatctctanggaggcttgtcggcttcgtcgggcgggaggggaggagatgggcgcccggaacagcgctgccgccacgccggtgctgctcaacgtgtacgaccttacggccgcgaacgattacctctactggctcggcttcggcgtcttccactccggaatcgaagtccatggcacggaatatgggtttggagcccacgactacccatccagtggtgtgtttgaggtggaatcaaagagttgccctggctttatctacagaagaacagtgtggctaggcacaacagacatgtctcaagaagaattccgctcgttta

SEQ ID NO: 7619 - DNA, 405 bp, Zea mays
  Clone ID: LIB148-034-Q1-E1-E11
acggacgcgtggggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccatccagtctaactaatccattcctgtgctgctcggcgaaataaaatcatcaaaaagaacaaagacgaaagaagcctatggaaaggaaaaaggaactttggttggg

SEQ ID NO: 7620 - DNA, 413 bp, Zea mays
  unsure at all n locations
  Clone ID: LIB148-034-Q1-E1-E2
agcccgcacctcctatgggcacgaccggcgacgctccggctccggcgggggatccgcaggaccgccaccgtacccaccccccggcgacgaagcagcggacgacgctggtgttcacgtacgggacgctgaagcgcggcttctccaaccaccgcctcctggaggagctcttcgcgagcggggacgcgtcgctggtgggccccgcggtgacgtcggcgcggctgccgctggtgtgcgggccgtaccgggtgccgttccttctgaacctccccggcgccggcgccggggcgcaccgcgtgcgcggggaggcgtacgcggtgacggcccgcgggcttgcgcggctggacgagctggagggcgtggagacggggcactacgagcggctggccgtggccgtggacctcganggcggcggg

SEQ ID NO: 7621 - DNA, 410 bp, Zea mays
  Clone ID: LIB148-034-Q1-E1-E3
acggacacgtgggcgcgcgcacgcacgtatggtcgaacaatattaggagagaagctgagagaccggttcctgaccttccaaaaaagaagtaggcataagatagatctctccgcgtcttctcgcccaaccccctccaacaagtaacattgaccgcaaacggatcatcgtccgctgcggtcaatgtaattaattaagcttctgaatcatacatagcttggcaaatgcctgagggctagctagctagacaaggtccattgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcagatacaat

SEQ ID NO: 7622 - DNA, 410 bp, Zea mays
  Clone ID: LIB148-034-Q1-E1-E4
actcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctctaccgttccgagtac

SEQ ID NO: 7623 - DNA, 401 bp, Zea mays
  Clone ID: LIB148-034-Q1-E1-E5
agtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgccgggtaacacttcg

SEQ ID NO: 7624 - DNA, 107 bp, Zea mays
  unsure at all n locations
  Clone ID: LIB148-034-Q1-E1-E8
acccacacgtccaagcacggcaacctcaatgtctccgacttcggcctcagctcgctcagggantcccagaagcatgacgggctgctgcacaccacctgccgcacccc

SEQ ID NO: 7625 - DNA, 173 bp, Zea mays
  Clone ID: LIB148-034-Q1-E1-E9
ccggaaggggagagacagtcccatggctgcgcacattccgatgcgtcggcatgttttttgattccacacaccttttgtccgggttggcgttgttccctctttctcaaaaatttagcgaattgattcattccgcttatgttcttcccctgacagatggattaacacttgtatca

SEQ ID NO: 7626 - DNA, 413 bp, Zea mays
  Clone ID: LIB148-034-Q1-E1-F1
agcgggacggggtcgtcccgcttgcagggcgtgaagcgccgtttcccgagaagacgggctcaaggacagcgtggtggtctccggcgaaggagcgggcgcgaagggacaagggggcgtggacaagctccggtgaggacggcgctgaatcgaccttcgacccttggctcggggaaacgcgagcacgcagcgactcggggaagcgctggggatcggaagcgcggaccggcacggggaatgtcgagcgaccggcgacgacggggaggccccagcgaccgggtgggctgtgggcggcggcgaatctacccgccgaggtcgcgataaacaatgttatgtgcaaggataatattcttactaagagctgatttggtgattaggtatcccaaggggatccatgggggaggaatcccttccaa

SEQ ID NO: 7627 - DNA, 404 bp, Zea mays
  Clone ID: LIB148-034-Q1-E1-F10
aatctgcccccagaaggtctgccccggcaagcgaagcaactcctcgcatgtctccatcaagaacgtcaccttccgcaacatctccggcacgtcgtccacgcccggggccgtcagcctgctctgctccgagacgcagccgtgcagcggcgtctcgctcatcgatgtcaacgtcgagtacgccggcaagaacaacaagaccatggctgtgtgcagcaacgccaagggaaccgccaagggaagcctccaggccctggattgcctcgtctgatcgatgaccttgcatttgcatgcattcttcttccgtttcacttttccatattctattgcgttccagccaagcatcttgtttcttttatatatatatatatatatatatatgcatggaaataaatttatgggggggg

SEQ ID NO: 7628 - DNA, 359 bp, Zea mays
  Clone ID: LIB148-034-Q1-E1-F11
aaagactgacagcgacgatgatgccacagctgcgtagcctcgtcgcgctggtcctcgtggccacggccatagccgccgctcccggcgttgggtttgtcgtcaggggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgc

SEQ ID NO: 7629 - DNA, 341 bp, Zea mays
  Clone ID: LIB148-034-Q1-E1-D3
agaaccgagacggcttgcggccggtggcggcgagcgccacgcggatcgtgatctacatccaccggaggaggaaggggaaaaaagagaggctcaccgggtgattgccgttgatgccgaggcgagcaaggcgagacgatcggtacaattagctcataggcctatgtaagttaggatttttttttttgcaggtaaagaattgcatagaggcgtgtagatcatatagcgtagatagatggcactggtagccatgccgatgaagatcttttgtgctgaactagaacaaaattaaagaggatgcattaagtcttgtgggtgtataaactagaggtgtctatatggtg

SEQ ID NO: 7630 - DNA, 409 bp, Zea mays
  Clone ID: LIB148-034-Q1-E1-C1
agtactcgcagatgctgctggagcacggcgacctcatcctgtcgggcgccacgtccgtgttcggcgccgcgcccgtggaggtctccgtgaaggtggccggcatccactggcactacggcagccggtcccacgcaccggagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcg

SEQ ID NO: 7631 - DNA, 330 bp, Zea mays
  Clone ID: LIB148-034-Q1-E1-C10
aaggctgcctaggccgctacaaggatgagaaggacgtgagcgacgtgacggtgtgggattgcgtgcttaggaacaccaccaacggcgtgcgcatcaagtcgtaggaggaggccgagtctgtgctcacggcgtcccatctcaccttcgagaacatcaggatggaggaggtggccaaccccatcatcatcgaccagtacttctgcccccagaaggtctgccccggcaagcgaagcaactcctcgcatgtctccatcaagaacgtcaccttccgcaacatctccggcacgtcgtccacgcccgaagccgtcagcctgctctgctccgagacgc

SEQ ID NO: 7632 - DNA, 372 bp, Zea mays
  Clone ID: LIB148-034-Q1-E1-C11
agagaactgctccacctcaaatgattgcacccatgaatgtgcactcctttttctatcgaagagattactgaaagggaaatgtgcccttgggccatttctaagtattttgggattgagtgccaacacaagtgcttaaatgtgaatttatgctcatggatggataaagtgcaaatcaatagtaaaggtatgtttctaagccttagtacattggttttgtgtactaatatacttgtctaagtgttagaaacagaaagaagaagaaaagaaaagaggtgaaaaagacttggctgtgtacagctaaaactcagctcagtctggcacaccggactgtccggtggtgcaccggacagtgtccggtgcgccaggctgact

SEQ ID NO: 7633 - DNA, 349 bp, Zea mays
  Clone ID: LIB148-034-Q1-E1-C12
acccacgcgtccgcccacgcgtccgcacgaatctgccatcctctccaacacgaagatggcgttcatcagcaatgtcgcagtgaaggcggcggccgtggccgcggtgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccc

SEQ ID NO: 7634 - DNA, 389 bp, Zea mays
  Clone ID: LIB148-034-Q1-E1-C2
cctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatc

SEQ ID NO: 7635 - DNA, 412 bp, Zea mays
  Clone ID: LIB148-034-Q1-E1-C3
acgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcagagctgatcgactgtccgtgcatg

SEQ ID NO: 7636 - DNA, 409 bp, Zea mays
  Clone ID: LIB148-034-Q1-E1-C4
acgaggcctccaccgtgatctggaagcgcaagatgcagaccaaggactccaagtcctcgtggagctccatcgtcagcttcgagaagcgcgagcagttcgaggagcgcgccgagaccatcctccacctgctcaagctccagttccccggcacgccgcagtcgcagctcgacatctccaagatacagtacaacagggacgtcgggtacgccctcctggagagctactcgcgcgtgctcgagagcctggcgtacagcgtcatgtcccgcatcgaggacgtgctgagcgcggacgcggcggcgcagaacctgacggcgagcgaggcggcgcggcgagcgctggagtcgacgtcgggggagctgcccgcgggcgcggaagcttgacgccaaggaggagctggagaagctgaacg

SEQ ID NO: 7637 - DNA, 404 bp, Zea mays
  Clone ID: LIB148-034-Q1-E1-C5
acgccaggatgctggcggaggcgagcatggcgaccaagtgccccgaggggaaagtgccgctcatctccatcaacgccctgcaccagctgcacatcttcatcttcgtcctcgccgtcttccacgtctcctacagcgcaatcaccatggcgctcggcagggccaagatacgtgcatggaaagagtgggagaaagaagctgcaggacaagactacgagttctcacatgacccgacgcggttcaggttcacccacgagacttccttcgtgaggcagcatatgaatgtgctgaacaagttcccagcatcattctacatcagcaacttcttccggcagttcttcaggtccgtgaggcaggcagactactgcgcgctgcgccacagctttgtcaacgtccatctggcccct

SEQ ID NO: 7638 - DNA, 384 bp, Zea mays
  Clone ID: LIB148-034-Q1-E1-C6
acccacccctccccttcccctgctcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccc

SEQ ID NO: 7639 - DNA, 363 bp, Zea mays
  Clone ID: LIB148-034-Q1-E1-C7
aggagctgctcaactccagggtggtgtccagccacttcagcccggcgtgccccacgtacagcccgcacaagaagtgatgacctaatagcattggccgtcggagctcggaggctggggttcacggtcacggcccagactgagctactacacttctgctagtactatatattgctacttgttgctctctacagtgcgtgtctttcggttccttctcgtcatctcgtgtgcaaggcagaggagtgaattagtcacgctcctgccagattctgcctggctctgtgataactcttactccactgctagttgttacatatacttgtgcgtcatgtcatttctcgaggagatgactagtgtttgtacctg

SEQ ID NO: 7640 - DNA, 407 bp, Zea mays
  Clone ID: LIB148-034-Q1-E1-C8
gttcgatctcacgagccgctgcacgcttaataacattgtagattggtacgacagggcgaggaaatggaataagacggctattccaatcctaatcgggacaaagttcgatgactttgcccagcttcctcttgaaatgcaatggaccattgttaaccaggccagagcatacgcaagagcgatgaaggcgaccctcttcttctcgagcgcgacgcacaacatcaacgtgaacaagatcttcaagttcatcacggccaagttcttcgacctgccgtggacggtggagcgcaacctcaccatcggcgagcccatcatagacttctgacgacctcctcctctagctaagtaattatgcagcacacacgacgacccttgtcggtatgatgggttgacagggtcgtcgcctcctc

SEQ ID NO: 7641 - DNA, 307 bp, Zea mays
  Clone ID: LIB148-034-Q1-E1-C9
acccaaacgtcaagagaaaggcaaggaaattgggaaggtaggagagagagggagacagggaaagctctcttcatcctcatcatcatctcgaattccgtctcttgtccctgtcgtgggcggggggtttccacggtttttgaaaggggaaagaggatgcggaggagagggatggggagggacgagaggttcccggtgtgggaggccgcgctcggcgcctgagtcgccgccgccttcgccgctggactcgtctgtgtctagctttccatgccggactcacactacagattcctcaagtttccacgtaatc

SEQ ID NO: 7642 - DNA, 397 bp, Zea mays
  unsure at all n locations
  Clone ID: LIB148-034-Q1-E1-D1
actggtacaccaaggaccacgaggtgctagcccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccgggatcaaggcgtcgctcaacttccgcatccagggccactacatgaagctggtcgagctgganggctcccacaccctgcagaacacgtacgactcgctcgacgtccacgtcggccactgcctctccgtgctcgtcggcgccgaccagaagcccggcgactactacatggtggcctccacgcggttcatccacgacgccaagtccgcgtccgccgtcatccgctacgc

SEQ ID NO: 7643 - DNA, 252 bp, Zea mays
  Clone ID: LIB148-034-Q1-E1-D10
agcgccttcttcgtcccacgctccgtctttatttgtaatctcaagcttacaggaacatatcagtcgatcatggacggattcgtaggcctcttgaaagtccggggtagggggggcatcaaccttgcctaacgcgacgcaggatgcagcgatccgtatgtcgtcctacgacttggcaagaagaaacttaagacgagcgtcaagaagagatctgtcaaccccatctggcacgaggagctaaccccgaccgtcaca

SEQ ID NO: 7644 - DNA, 380 bp, Zea mays
  Clone ID: LIB148-034-Q1-E1-D11
agacgacgagtcgatcatggatagaagaggctgtcgtcctataatgcatctccatgagcgtactcttggtgttcttgcctgccgttatgttgatgaagtcagggttggtgcaccatgggaagtttcaaaggacatgatcactacgtttaacatttcattggttgtccatgggactgtagctgagggcaattcagctggtgaaattgatccttatgctgttccaaagagcatggggattttccagacaatcaggagcccaaaatctataacaacattgtcagtggcgacaagaatagttgacaatcatgaagcttacaagaagaggaacctgaaaaagaaggctagcgaagaccggtactacacacaaaagaaattccttt

SEQ ID NO: 7645 - DNA, 264 bp, Zea mays
  Clone ID: LIB148-034-Q1-E1-D12
aaacctcaagcataaatcatattagtatcatagtattagcatcgatcaagcaggattacagaaacgaaacccccttggcgacccacacatcaccaaggaaggaacgaaggggggaggagcagacgatcacataattaagcaaccgcaggcaataaataaataaataaaacaacgattaattaattattaatcgggtgaaccaaacacgatgctccatcccaggtttccagcactccgcgcggtacgtcgctcagtcgaggaagg

SEQ ID NO: 7646 - DNA, 411 bp, Zea mays
  Clone ID: LIB148-034-Q1-E1-D2
ctccaatccccgcagaaaccaccggcgccgtcgaccgcaaccagcagtggttccgtcgccggcgcgggattgggccaccagccgcggttgtcgatcggccgattgattgattgatcgatcgatcgatcagtccaccgcggcaaggccggggagggagccgtcgtcggtggttcctggcggttgcatgtatgcgggcggggagagccggcccaatggtgggggcggaggcggagacgcgctcaggcggcggaggcagcccggcccgtccgcgtctcccgctgcgtcgtcgtccggcaggggagcggaggaggaaggcggggaggagcgtgggcgaggccagaagcaaccgcggcgcaagaagcagcaggggaggcgcgaggcggtggccagggcgatccggggcgggctgcc

SEQ ID NO: 7647 - DNA, 406 bp, Zea mays
  Clone ID: LIB148-034-Q1-E1-B9
ccgggccgacccaagcgtccggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacg

SEQ ID NO: 7648 - DNA, 276 bp, Zea mays
  Clone ID: LIB148-034-Q1-E1-A3
gcgtccagtctcattctagacggtgcatgagcaatcgacgtaggccgtcgggtccagcatgtcgatatactccgttctgatggacacatggacatcgcagcctctgcggttcagccggacatgctgtatgctcgggagaacactggcatgacgtattcgactggacactttccacacggcatcaacgatatctacagtctggtacagtccacgatgactgccaagcctaacggaagcagtgttaagcacagcaacatatcatccatcagtatgcgc

SEQ ID NO: 7649 - DNA, 404 bp, Zea mays
  Clone ID: LIB148-034-Q1-E1-A4
atgtccatctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctacctgggggtgctctctaccgtgtcgagtac

SEQ ID NO: 7650 - DNA, 385 bp, Zea mays
  unsure at all n locations
  Clone ID: LIB148-034-Q1-E1-A5
agctataccttcgggtacgaagattgacttctgtcaaacatcagatgggaagcttataacagaaattgatgggaaacaaattggtgctgttcggagcaaagatctttgcaaggctttcttcgacatgtatattggtgattcaccggtttcactggaggccaaaaaagtcgttgcccagaacgtggctgggctcattggaagacgctgaggatagcgagaggatggttatttcattcttctgtacagttagagaggattcatatgagcgggaaaataggccaagtatgtagagtgatctgtcttgtatagaaagcaggcaaaaaggtccaatgtatatgtggaaggtancatcttcagttgtgctangcctccattcttttttttt

SEQ ID NO: 7651 - DNA, 382 bp, Zea mays
  Clone ID: LIB148-034-Q1-E1-A7
aggggaatatccctttgctgtagctggtgtaaatattacattcatgctgattcagatgcttgaccttcaagcagctaagccaacgtcgttggttggagcggttttcctaaatctactcttagaaaatgatcgagcgttcgacattctttactgcataaccttcaaactgatggatcagaaatggcttgaaatgcacgccagttacatggatttcaatacggttattaaatcaacacggcgccagctcgagagggagctgttgctagaagatatccagagaatcgaggacatgccatcgtacaggtttctcgcctgctagcaattgaacctcctggtcgtaccgaacattgccacaagatagtgcagctccatacactcgaag

SEQ ID NO: 7652 - DNA, 248 bp, Zea mays
  Clone ID: LIB148-034-Q1-E1-A8
agcaaaccgagaggtgaaccagcagcctccaataaaagccagcacatccaaataaaaccgagagacctcagccctcaggcaagccgaccgccgacgtaccaccgcgccaggccgagagaaagatggagattatcaagaggatcctcatcgccgcgctcctcgtaatcgccgtctctgacaccgcagtgctggcctccaccgaggccgccgcctccggtaccccagccgcctcagaatcgtcagcgtcc

SEQ ID NO: 7653 - DNA, 119 bp, Zea mays
  Clone ID: LIB148-034-Q1-E1-A9
acccacgcgtccggtgaccgcgcattattaatattatgaaaaatggcaaccgggtgtcggttattcttgtctgcatgtcgttactcggatgttatagtagaacgaactgttcgtactgc

SEQ ID NO: 7654 - DNA, 340 bp, Zea mays
  Clone ID: LIB148-034-Q1-E1-B1
gggccgagccccgcgtccagaaccacctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtc

SEQ ID NO: 7655 - DNA, 387 bp, Zea mays
  Clone ID: LIB148-034-Q1-E1-B10
acccacgcgtccgggatcctaataaaatctacttgatgggccaatcagcaggagcacatatcgcggcctgcgctctcttagagcaagcaattaaggaatctaagggagagaatacctattggaatgtggctcaaataaaagcatattttggtttatctggaggatacaatatccaaaatttggtcgatcactttcatgagcgtggtctttatcgttcaatatttctcagcataatggagggagaggaatcactgccacattactcacctgaaattgtcgccaaaaaattaagtgcagaaaccatatctctactacctcagattgtactattgcatggaacagcagattactccataccatcatctgccagcgaaacttttgctgatg

SEQ ID NO: 7656 - DNA, 388 bp, Zea mays
  Clone ID: LIB148-034-Q1-E1-B11
aacccacgcgtccgatgatacagagggtggaagtgtatgatgctatctcacatttgaagacattgcaaaagaagaagctaaagccttccaaaggaaaaaatgatggtcaaggggagcagacttatgttattgtggaggcatccaagttcaagagggttggcaggaagactaccttgcggcaggatttggccaatgctctagatataagggccttcgagaggatgacgaagctaggccactgcgatgtggagcttcttagaaaagagatgaatgagactgatgtccccgtatcttactcaggcactggcatccctgagaagtcaatacgcaaagcagctcttgaggttattctccgcaggctcctctcttttctcaagccagacacctt

SEQ ID NO: 7657 - DNA, 394 bp, Zea mays
  Clone ID: LIB148-034-Q1-E1-B12
actcggcgagcgcccttgagtgctccgctaacgtaacggaaatagcaaaggcgcgcaagctgatcgatgtccatggccacgggctgtgcccggtgcggttcgagcacacgcgcgggatcagcgcggtggccagcagctgcaaggaccgcccgctgccgtcgccggagcgctgctgcggggcgctcaaggcctacgcgtgcccctacagcgagctcatcaacgacaacgccaacaacggctgcgccagcgagatgttctacgtcatcatgacacgcggcaggctgcggccgggcctcttctcgcagctgtgcgtcgaaggcccgctgggcctccagtgctgatcaacactggcctgctgccgcccaacgcccggaatccaaccatccaaccaacc

SEQ ID NO: 7658 - DNA, 414 bp, Zea mays
  Clone ID: LIB148-034-Q1-E1-B3
aggcgcagaaggccgccaacccctaccgccgcggctgctccgccatcacgcgctgcgcccgcaacatgaactgagcccagcgctagctgctgccggggcgcgccgtcgtcgccgagccggtcggtctggtctggtctggtctgcctgcctgccaggtcacgcagcctggctccaccgatcgcacaccatacattgacgtcgtcgtcgcggccgtacgtgccgttggacggtggaggaggcggtggcgctacgacagtatatatatacacaattacacatacacaccccaaaaagaaaagaaaaaaactactgccattgctgtcgttgtgcgtagcttctctctatatatatacccgtatttaaattctcgacaaaatttgtttgaccacggtgatctgtcatatatgtcgtcca

SEQ ID NO: 7659 - DNA, 270 bp, Zea mays
  Clone ID: LIB148-034-Q1-E1-B4
tcacctgcgtcaccccaccatatccggccaccccaactaatatgtctcgcgccacagctgcggtcctcttctacatcctctccgtcgctgccctcggggcgggcaaggcaccggcagagtcaccgaaggcaggtagtcctgccattgcaccggccgattcaccgagtgcatgcactcctgcagctccttccaatgcacccgagtctgctgccactagaactgcccccgctcaggcatctcgagccgcctccaaccccggcgcttccgctg

SEQ ID NO: 7660 - DNA, 408 bp, Zea mays
  Clone ID: LIB148-034-Q1-E1-B5
atgctgcatagccacgagcagcaggtccggcaagctggtcgccggccatggttcaagaaaggcagcaagaaggagcagcacagatggcagaggcacggcatgatcacattgaaacggcgtgatcaaaacaggagatgctgcgagcagatgaaagggatggaacgagttgggccatgagctctcctgatgagcaggtgtttttttcagggctggacagacagacagccccatgccatcagggaaagctgagatggaagtggaagctgttgtagtggggttttcaggtttcatgcaaccagattttgctctacctgaactagacaacaatgttgttgctgctgctgttgtacaagatctttttttgtgctcgcttgtgatgataatatgcatggcaagctccaaaatgtg

SEQ ID NO: 7661 - DNA, 409 bp, Zea mays
  unsure at all n locations
  Clone ID: LIB148-034-Q1-E1-B6
agcaccccggcgaatattcgaccacggaagccgcataacctccgtccatcccatccccgctcgcctctccagtctcctctcctcgccccgctctagacgatcgatggccgcgacggcggcggaggagatggagaggatggtggaggcggagtgggaggaggggatgagggangggaagcggtacgggctggtggagtaccgggcgctgccggcttacctgcgggacaacgagtacatccaccgccactaccgctgcgagtggccgctcccgcaggttctgctctccgccttctccatccacaacgagaccctcaacgtctggacgcatcttataggatttttcatctttctcgctctgaccatatacacagcagcacaagttccaaatgcagtagatatcgggagcttg

SEQ ID NO: 7662 - DNA, 411 bp, Zea mays
  Clone ID: LIB148-034-Q1-E1-B7
acccacacgtcaacagcctttgtttcctgttgaaagtggtgttgaccaactggtggaaataataaagattttgggtactccaacaagagaggagatcaggtgcatgaatccaagtggttccgaattcaagttccctcagataaaagcccatccatggcacaagctttttggtaagcgcatgccacccgaggctgtcgatctcgtgtcaaggctgctccagtactcaccgaacctgcgctgcactgctgtcgacgcctgtgcccatccgttcttcgatgagctgcgggaccccaaggcttgcctgccgaacggacggccaatgccaccgttgttcgacttcacagcagccgaactcgaaaggctccccgccgagcttgttcaccggatcgttcctgaacacatgaggaagga

SEQ ID NO: 7663 - DNA, 391 bp, Zea mays
  Clone ID: LIB148-034-Q1-E1-B8
agccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagag

SEQ ID NO: 7664 - DNA, 413 bp, Zea mays
  Clone ID: LIB148-034-Q1-E1-A2
acagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaat

SEQ ID NO: 7665 - DNA, 399 bp, Zea mays
  unsure at all n locations
  Clone ID: LIB148-060-Q1-E1-F11
cacaccttctataacgaactccgtgttgcgcctgaagagcaccctgtgctgctgaccgaagccccactcaacccaaaggctaacaaggagaagatgacccaaatcatgtttgagactttcaatgttcctgccatgtatgtcgccatccaggctgtgctttccctgtacgccagtggacgtacaactggtattgtattggactctggtgatggtgtcagccacacagtgccaatctatgaaggttatgcccttcctcatgccatcctgcgccttgaccttgctgggcgtgacctgactgacagcctgatgaagatcctcactgagagaggttactccttcaccacctctgctgaacgcganattgtaagagacatcaaggaaaagcttgcatatgtggct

SEQ ID NO: 7666 - DNA, 410 bp, Zea mays
  unsure at all n locations
  Clone ID: LIB148-060-Q1-E1-F12
acacgcgaccgctgcagttcaacctctgacagatgcagctaaggattttctcgctgtaaagtacaaggatttgattaagttccaagatgaagtgatgaacatccctcgtgctggaatcgaagccatcttgtcaagtaatgacctccaggtggcatctgaagataccatctatgacttcttactcagatgggcccgtgcacaatacccgaaatcagaagagagacgtgaggtccttagttctcggctgctccctcttgtgcgattcagtcatatgacgtgtangaagctgcggaaggtcctagcctgcacagatatagaccacgagcaagcaaccaagtgtgtcaccgaggctcttctgttcaaagctgatgcaccacaccggcaacgagctcttgcagcggacgcaataa

SEQ ID NO: 7667 - DNA, 387 bp, Zea mays
  Clone ID: LIB148-060-Q1-E1-F2
accacgcctccgggggcaaggccaagttcaagggccaaaagaaaatacaagaaccgggtgattcaatcaaaaagaaaggataacctggcaaaaccttgaaacaagtgggccccaagggtgccaagttctttcaaggaaaaggacccgttccaacggctgatggccacgtcgtcatgacgctaggcttcctcacggcgatgccgcctgacccaccggcccctgccgctccaccacctgccgccgccccggagtcgaaggaagacaaagaatcggaccattcagactcctcgtcatcttcttcttcagacgacgacgaagataacgaggaggaggaaaccgaggagcaatgataagggcgggtgtgttcaacttcgaaggcttcaaacg

SEQ ID NO: 7668 - DNA, 408 bp, Zea mays
  unsure at all n locations
  Clone ID: LIB148-060-Q1-E1-F3
gtggacgtgaagccggcgtacgggcccttggtgacgggcatcttcgtgggcggggagcgcctggacatcncgcaggagatctgggatgccgagaaggtggtcggcggcggcgtcatcctggacacgagcacgtcggtgacgtcgctggtgccggaggcgtacgcggcggtgacgagcgcattggacaggcacctgtcccacctgccgcgggtgtacgagctggacggcttcgagtactgctacaggtggaccttcgccggcgacggcgtggacctggcgcacaacgtgacggtgcccaggttgacggtggagatggccggtggcgcgaggctagagccggaagccaagagcgtggtgatgccggaggtagtgcccggggtggcgtgcctggcctttaagaagctgccg

SEQ ID NO: 7669 - DNA, 399 bp, Zea mays
  unsure at all n locations
  Clone ID: LIB148-060-Q1-E1-F4
gccatcagcgtggtcagccgctcctcatcccggtcccgtccaacaaccccccgccggaaaacaacaacgtggtgctcatcggagactggtacaccaaggaccacaaggtgctagcccgccagattcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccgggatcaaggcgtcgctcaacttccgcatccagggccactacatgaagctggtcgagctggagggctcccacaccctgcagaacacgtacgactcgctcgacgtccacgtcggncactgcctctccgtgctcgtcgacgccgac

SEQ ID NO: 7670 - DNA, 413 bp, Zea mays
  unsure at all n locations
  Clone ID: LIB148-060-Q1-E1-F5
ggaagcgtgggccggggccgggaggagcggtacgtgctccccttcgaccccaccacggagttccaccgctactccatcctgtggacgcccgccgccgtggccttctacgtggacgacgtgccggtgcgcgaggtgcggcagtcggccgccatgggcggggacttcccctccaagcccatgtccgtgtacgccaccgtgtgggacgcctccacctgggccaccgccgggggccggtaccgcgtcaactaccgctacgggcccttcgtcgcctccttcaccgacctggccctcctcggctgccgcgttgacgggcccatccagcagacgacggcggagcggtgcgccgcagccgccgaggcactcanggcgtcggacgtggccgtcatgacggtggagaagcagcaagccatgcg

SEQ ID NO: 7671 - DNA, 408 bp, Zea mays
  Clone ID: LIB148-060-Q1-E1-F6
cccacgcgtccgcccacgcgtccgcccacgcgtccgccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagcatcagcag

SEQ ID NO: 7672 - DNA, 421 bp, Zea mays
  Clone ID: LIB148-060-Q1-E1-F7
cggcccttttttttttttttttttggaacaaatacatagagttactcaatatatataactcataatttcaatgaattcttaattaaatgaaaaatgaatgcaagcattccctgcatgcgatggcacctcacgctggggttgcatgcgtggttcatatcatgtttgcaagagccatgcagttgttggccatctggttgagctccttgtcaaacttccccatggggttggggacgccggcctgggtgaaggggcggtcgcacgagtcgaagtcctggacggcgagctgcagcatgatcttggcggtgccggtgtccttgaacgtgatggcccgctgcgccgcgccgatggtgtcctgcgtgttcatgtacatggtgtcgcagaacgtgagcgcctgcgtctgctgcggcgggatggtgcgggc

SEQ ID NO: 7673 - DNA, 367 bp, Zea mays
  unsure at all n locations
  Clone ID: LIB148-060-Q1-E1-F9
cggacgcgtgggggatccccccacaccttgagacctgcgttgtcacccacccatcaaggttggggccgccagcaggttcagccgttcctgttcttgctaaaacgagagaaggatggcagtgtctcanggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagc

SEQ ID NO: 7674 - DNA, 208 bp, Zea mays
  Clone ID: LIB148-060-Q1-E1-G1
ggaatgctagaagttcagtgagcgatttgttggggcatgcatgatcgcagacagctgcgccaatgtgtgccgcggtgagggcttcttggccggcaggtgcagcaccttccgccgccgctgcatctgcactacgcaatgctaaacaagatcgctcgatcgcttgccatgcatcgacaacctattcttaataacgttcattatctcgttc

SEQ ID NO: 7675 - DNA, 381 bp, Zea mays
  Clone ID: LIB148-060-Q1-E1-G10
cccacgcgtccgctctcctcgccccgctctagacgatcgatggccgcgacggcggcggaggagatggagaggatggtggaggcggagtgggaggaggggatgaggaagaggaagcggtacgggctggtggagtaccgggcgctgccggcttacctgcgggacaacgagtacatccaccgccactaccgctgcgagtggccgctcccgcaggttctgctctccgccttctccatccacaacgagaccctcaacgtctggacgcatcttataggatttttcatctttctcgctctgaccatatacacagcaacacaagttccaaatgcagtagatatccggagcttgcagcatttgccagatgtactgagaaaggctgatatt

SEQ ID NO: 7676 - DNA, 421 bp, Zea mays
  Clone ID: LIB148-060-Q1-E1-G11
accacgcgtccgcggacgcgtgggcggacgcgtggggcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcatgccataattatatatagatacg

SEQ ID NO: 7677 - DNA, 361 bp, Zea mays
  unsure at all n locations
  Clone ID: LIB148-060-Q1-E1-G12
tagatgtaataatcatgaataaccagtgggagatgttctcagaaacgatcccaaagtatcgtgatactaaagtcaggacaaaggaacccctagagcaatattaccaaaccaaggacgatactgactacttatggtacaccacaagcttttcgcttgagtccgacgatttgcccttttagaaatgacatccggcctgtgcttcaagtcaaaagtagtgcacacgcaatgatgggatttgctaatgatgctttcgtangatgcgcgcgcggaaacaagcaagtgaagggtttcatgtttgaaaaaccggttgatctgaaagtangtgtgaaccatgtcgtattgctgtcgtcaactatgggaa

SEQ ID NO: 7678 - DNA, 417 bp, Zea mays
  unsure at all n locations
  Clone ID: LIB148-060-Q1-E1-G3
ctccgacttcacaacctttaacaacctcctgtctcagacgaagctcgcggaggatatcaaccgccggcagaccatcaccgtgctcgccgtggacaacggcgccgccggtggcatctcctccctcccatcagacgtccagcggaaggtgctctccatgcacgttgtcctcgactactacgacaccgccaagctggaggccatcaagaaccactccgccctgctgacgactatgttccagtcctccggccaggccaccgaccgcatgggcttcctcaacttcaccaagcgctccgacggtgtcatggtgttcggctccgctcagcccggagcgcagatgacctcccatatggtcaagtccgtcacttcncgcccgtacaacatctcagtgctgcaggtcagcgcccccatcgtgccgcc

SEQ ID NO: 7679 - DNA, 428 bp, Zea mays
  Clone ID: LIB148-060-Q1-E1-G4
ctccctgggcccaacaagttcaatggccaccaaaggcaaccccgggccgtcaacccccggaaaaaaggattctgaaggcataccggtgaaaaaaaccggaaaggccctggtaatcggaatctacaacaagcccatgacccctgaacattgcaacatggtggttgaaaggctcggtgactacctcttaaagcaaggcctgtgaatgcatcaaaacaacgacaccaacgccaaaattaattaattagtagtctcaatgccctgggattgtgcgtggccgctccgttgaacaccacccatccttcgttcggcattttttcccccctttgtttatataatttattgtatcgttttggcaaataattttgtgattcgaccccaaagcaagtttggttgtcctacgaattgtaaacctgggacaatatataatg

SEQ ID NO: 7680 - DNA, 424 bp, Zea mays
  Clone ID: LIB148-060-Q1-E1-G5
atttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaagcagtgctaaacaagatcgctcgatcgcttgccatgcatcgacaacctattcttaataacgttcattatctcgttcttatttatgacgaatgtcatgtatgttctggtgactgtcatgtatattctgatgactgtc

SEQ ID NO: 7681 - DNA, 399 bp, Zea mays
  Clone ID: LIB148-060-Q1-E1-F10
gtgaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcctcgcctactacctgcactaagcggacggacggacggacgcgcg

SEQ ID NO: 7682 - DNA, 412 bp, Zea mays
  Clone ID: LIB148-060-Q1-E1-D7
atcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtgga

SEQ ID NO: 7683 - DNA, 414 bp, Zea mays
  Clone ID: LIB148-060-Q1-E1-D8
accacccccgactcgtggaagctcaacgagatcttcgccaccggcatcgtgctcggcacctacatggccatcatcaccgccgtcttcttctacctcgcccacgacaccgacttcttcacggacgtgttcggcgtgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcagctacatcccgctcgacgtg

SEQ ID NO: 7684 - DNA, 390 bp, Zea mays
  Clone ID: LIB148-060-Q1-E1-E1
cccacgcgtccgccacgcgtccgatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacactgtgcgagggcaggaaggggatggacctggtggtgtgcaaggagtcctgcgacctctcacagcgctccaacctggtgctgtacggccggattcagtgcaagggcaagtgcaccgagcagaagggcatcaccgcgccgcagatgaaggtgtgccaagaggcgtgcgac

SEQ ID NO: 7685 - DNA, 405 bp, Zea mays
  Clone ID: LIB148-060-Q1-E1-E10
accaccacaaggtggagtcggaggacacgctgtggaagaagggcatcatcctcggggagaagtgcaggatcccgggcgagagggaggcggagaccggcgagcccgtcgaccccgccgacgagatcgccgccggcagcttccgccggtccagctactcccggcccgtgtcgcggtcgagctcgttcgccgtgtaccaccaccaacagcagcagcaccagcacgacaccccggccgccttgcatgcctcggattcttgacagcccctcgagacccgagtataaatgtataatactattacgtacgtgtgtaggcgtcgaaggggagaaggatgctactatgcctacgggatgtaatgtgcattcaaattcagatgtaattgctctataattctactaggtgtgtgcc

SEQ ID NO: 7686 - DNA, 356 bp, Zea mays
  Clone ID: LIB148-060-Q1-E1-E11
cgcaggcccatcggatccgtttcgagttccacaagggagcagcggagcacacgttcatgaggatcgacggggagccatggaagcagcctctccccaaggaggacgacaccgtggtggtggagatctccaacctccgtcaggtggccatgctggccaacgacccgtgcaggtccaagagcgtgaacgagccgtcctccccgtcgtgccacggccatgaggacgacgacagcaacagcctggaggacgaggacgaggacgagtgggaggacgggaggaagaagttcggtgcggcggccaccttcaagatccccgacgaggtggacatcgctcatctcagttagaacctaaaaaccccg

SEQ ID NO: 7687 - DNA, 368 bp, Zea mays
  Clone ID: LIB148-060-Q1-E1-E12
gagtgcccttcgttctcgtctcgatcccgacgacgctcccttcggctcggcaaacacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcatt

SEQ ID NO: 7688 - DNA, 422 bp, Zea mays
  Clone ID: LIB148-060-Q1-E1-E2
cccaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaattttttttcct

SEQ ID NO: 7689 - DNA, 398 bp, Zea mays
  unsure at all n locations
  Clone ID: LIB148-060-Q1-E1-E3
gttatcctcctcttacattacaggtcatagctaagcaggtctgacangatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccaatgaccccgggccagtgcaaca

SEQ ID NO: 7690 - DNA, 427 bp, Zea mays
  Clone ID: LIB148-060-Q1-E1-E4
cctccatccgcgcgcatctcgcggtggtgctcctcctcctcctcccccggctcccggggcgggcgctctcctgttcctcctcctcctgctgctggtgccagggccgggagggcggcgcggaggtggcgctcatggggctcgccggggacgggtcggcggacaccgccaacctcagtaatagtgaaaatggtcggttcagttatggagttgcaagttctcccgggaaaagagcatcgatggaggacttctatgaggcaaggatagacgacgttgacggagagaaagttggaatgtttggtgtgtatgatggtcatggaggagtcagagcagctgagtacgttaagcagcatcttttcagcaatttaatcaaacacccaaagttcatcactgattacaagggcgctattgctgaaactttacaacgcac

SEQ ID NO: 7691 - DNA, 395 bp, Zea mays
  Clone ID: LIB148-060-Q1-E1-E5
ggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttt

SEQ ID NO: 7692 - DNA, 420 bp, Zea mays
  Clone ID: LIB148-060-Q1-E1-E6
cggacgcgtgggcggacgcgtgggcgccgccggccaagctgccggagggccccagcgggtgggcgtggtccatcaaccagtgcaggtccttccgctggaacctgacggccagcgcggcgcggcccaacccgcaggggtcgtaccactacggccagatcaacatcacccgcaccatcaagctcgccatgggccgcggcaaggtcgacggcaaggagaggttcgccttcaacggcgtgtcgcacgtggacccggaaacccccgtcaagctcgccgagtacttcaacgccagcgacggcgtgttcaagtacaacctcatcggggacgtgccgccctccaacacggcccccaccaagatggcacccaacgtcatcagcgccgagttccgcacgttcattgaggtggtcctcgagaaccccgaga

SEQ ID NO: 7693 - DNA, 423 bp, Zea mays
  Clone ID: LIB148-060-Q1-E1-E7
gcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcctcgcctactacctgcactaagcggacggacggacggacgcgcgcatggcattggcatgcatggactgttgaacat

SEQ ID NO: 7694 - DNA, 419 bp, Zea mays
  Clone ID: LIB148-060-Q1-E1-E8
cttcctccccgtccccacccacatgccctgcctccgccccgccccgccctgcccaagctgagttcccccacccccaacaaacaattactagagtagctgcattggcggggaaattaaagcgctagaagctcagcagcaatggcggagcaggcgggcgtcggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgcggtggctcaggtgcaccccggcgccgaccgcccgagctccatctgggcgcacgctatcctcagcacggtcgacagctccgcccgtcgccgccgcaaccggggggagcagga

SEQ ID NO: 7695 - DNA, 393 bp, Zea mays
  Clone ID: LIB148-060-Q1-E1-E9
acggaatggggtggaagtatccgaggtagtattggaagaggcagacgtgtccaaagccattcgaggttacatcactgcaaacaagatccagagcattgcgctcggcggagccaacagaaatgcgtgcaccaagaaattcaagaacgcggacgtgccgtcgaccctgatgaagtgcgctccagactactgcaacatctacgtcgtgggcaagggcaagtccgtcaatgtcaggctcgccaagtgcggcgtcccgccgatgcacactggcgccgacatcgcttcggacaccgactcactccgggaatcggtgctctacatgcgacgcggctccagtggggcactgccgcgggtgacgccatgacgcctggcgctccattgacaggcgcacaccgc

SEQ ID NO: 7696 - DNA, 425 bp, Zea mays
  Clone ID: LIB148-060-Q1-E1-F1
ggtcgaaataccgggtcgaccacgcgtcggggggtcattcgccatcctggcccgggggaaaggggggtccccggtttgaatagttgatttccatttcagggtgcgcatctgaagggtgcgccaggtgctcttgctgtgtgatctttgtcgccttgtgacgctggggaccgggttattggcgggagtttgtcagaataatacataaagaactggtgccacgagatcgggggacttcagatcagggaaaccttgagccatgggcacagttgtggatgccgctccagcagttgtggctgaggtcactgagaacatgttgggtggcaagaaagttacagttgtatttgtcctaagtggtcctggaagtggaaaaggcacacagtgtgccaacatcgtggagcactttggattcacccatcttagtgctg

SEQ ID NO: 7697 - DNA, 404 bp, Zea mays
  Clone ID: LIB148-060-Q1-E1-D6
aaagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaacagcg

SEQ ID NO: 7698 - DNA, 412 bp, Zea mays
  Clone ID: LIB148-060-Q1-E1-C2
accacacgtcgggttcttggatggttgcgcaacaactcccctggcggccccgccgggcccccttccaaccgttggcgcccattttcccaaagccgggcaagccaaacccctgaagccttgccggccttttgtacaagaaaaccaagggaagttcaacggcgggccgttgaaaaccgcccaagcgaccttctacggcgggcgggaccggtccggcaccacggcgggcgcgtgcgggtacaaggacacgcgcacgcaggggtacggcgtgcagacggtggccgtgagcacggtgctgttcggtgacggcacggcctgcggcgggtgctacgaagtgcggtgcgtggacagccctagcgggtgcaagcccgacgcggcggcactggtggtgacggtgaccgacctgtgcccgccc

SEQ ID NO: 7699 - DNA, 382 bp, Zea mays
  Clone ID: LIB148-060-Q1-E1-C3
gacgccggtgtggaaggtgatgacgaggcaccccatcttcgtcctctcggacacgctcgccgtcgaggcgctgcagaagatggttcaaggcaagttcaggcacctgccggtggtggacaacggcgaggtggtggccatgctggacatcgccaagtgcctctacgacgccatctcccggatggagagggcgtccgagaaggggaaggcggcgatcgccaacgtcgcggctggcgacgacaagtactccatcgtcgaagctctcaaggagcaaatgttcaggccctgcttgtctgccattgtcggcgaagactcaacggtcgtcatggtgtcgcctggtgattcggtccttgcagcgaccaagaggatggtggaagcgcatgcg

SEQ ID NO: 7700 - DNA, 409 bp, Zea mays
  Clone ID: LIB148-060-Q1-E1-C4
gatccacaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcacc

SEQ ID NO: 7701 - DNA, 398 bp, Zea mays
  Clone ID: LIB148-060-Q1-E1-C5
atccaggtccagggacgccgccctgcacccgcgccatgccgacgctcggcatcgcgcggctgctggacgcctccttccggcgccgcttcgccgcggcgggcctcgtcgaggcctccgtcccgctggacggcggcgcgaccacggtgcactgctggcgcttcccgccgagcgccgacgacggcggcggcgaggacgcccgccccgtcctggtgctcctgcacggctttgggcccccggcgacgtggcagtggcggcgccaggtgggcccgctctcgcgccggttccggctcatcgtcccggacctgctcttcttcggcggctcgtccacgtcgtcggcgcccggcgtctccgaggcccagcaagcggaggcggtggcgaaggtcgtggcggctgtggcg

SEQ ID NO: 7702 - DNA, 410 bp, Zea mays
  Clone ID: LIB148-060-Q1-E1-C6
acgacggacccgcacatgaaggacctcttcgtcccgttccgatgcttctgcacccgcaaagacatcaattgcaaggacgtggtgctggacgagcacgacgtggccaagtccatcatcgagttctcggcgcaggcggccgtggagaagctcgtcctcggcgccacgacgaggggcggcttcgtccggttcaaggcggacatcccgaccaccatctccaagggcgccccagacttctgctcggtgtacatcgtcaacaaggggaaggtctcgtcgcagcgcaactccacccgcgccgcgccgcgggtgtcgccgctccggtcgcagatccagtcgtcgcagattgccgcaacgctcaagcccgagccgccgcagtcgcaccggtggtcctcgtcgtcgagaggccacgagca

SEQ ID NO: 7703 - DNA, 406 bp, Zea mays
  Clone ID: LIB148-060-Q1-E1-C8
aagggccggctcgccgtcgccgggatggtcgtcatatatttttcacgaaattgacggagcatgtctctctacgtgccctgtacgcactcatggcatggtcgtcatggcttttccatttcaatcctagcctgaacagtgagtgaagtaagcattgattgtctccaccagcgaatcaatgtacgcggaacaggggagttttatctcagcaagtgcatggcgcagtctgcggcgtcaatgcaatagtactgaggcttctgtttgcgcgcgttcattgaatccttgtttgccgaaatggcgactgcgccggccccggctgcacttgccatttgccaagcagcaatcaggttcacatgaatggagcggacccccatttgaatccttctaggcacatcaatcattcgctccc

SEQ ID NO: 7704 - DNA, 414 bp, Zea mays
  Clone ID: LIB148-060-Q1-E1-C9
cccgcgctcccgccccacgcacgccctcgcgctcaccggcgccccgcccctcccccacgctggccgcacccgcaatggggtgcgcggcgtcggccgccaacggggccgggccccggcggcgggggtgggcgcgggcgcggatgcggcggtacagcgaggcgtccacctcgggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggccgacgccgacgccgccgacgccgatgactccgtcagggtcagagcga

SEQ ID NO: 7705 - DNA, 384 bp, Zea mays
  Clone ID: LIB148-060-Q1-E1-D1
tcggcaaccaccagaactccaaccgttcggccctggaaccttaagcctcttcgttccggctccggaatccaacggcggcgggaaaaaacgggcaattcccaaaacaggaaccgaaggaacaaggttggaggataaccccccgctaacaaaaacaataaagggtgcggtaaaaggaccccccccggggaacatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggc

SEQ ID NO: 7706 - DNA, 406 bp, Zea mays
  Clone ID: LIB148-060-Q1-E1-D10
ggctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgccc

SEQ ID NO: 7707 - DNA, 404 bp, Zea mays
  unsure at all n locations
  Clone ID: LIB148-060-Q1-E1-D11
caagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctagggctcctangcggtgcggtcggggggatgatgctcggagaggcgatcggtgactatgagaccgacgccgcttatgatgccgggttcaacgatgcattggcattttagattcaggttgtcgtgcagtcat

SEQ ID NO: 7708 - DNA, 386 bp, Zea mays
  unsure at all n locations
  Clone ID: LIB148-060-Q1-E1-D12
caacatcacgctggcgctcganggcaaggttgggacggtgacggtgaacggcaaagcgtacagcttcgagaagctgcactggcactcgccctccgaccacaccatcaacggccagaggttcccgctggagctgcacctggtccacaagagcgccgacggcgcgctggcggtcatcgggatcctctaccagctgggcgccccggactccttctactaccagctgaagcggcagctgggcgagatggcccaggaccggtgcgacttcgccgaggaggaggagtcgcgggtggaggccggcctcatccacctgcgctcgctgcagaagcgcaccggcagctacttccgctacacgggctccctcaccgtgccgccatgcaccgagaacg

SEQ ID NO: 7709 - DNA, 407 bp, Zea mays
  unsure at all n locations
  Clone ID: LIB148-060-Q1-E1-D2
cggacgcgtgggcggcgtcgggcgacggtggcgccatgggtggctgccactccgccatcgcggccaccaagctgaagattctgcgccgcggaggccggggtgccgctgccgtcctccccgtcaccaaccacgacggcccgtgctgctcctccgaccacggcagcaaggagaagaagaagaaaaagaagggcgccaggaagggcaggaaacgcgcctccatcctgggcgacgccggcaccttcgacccggacttctcgcggcggtaccggctcggcgcggagctcgggcgcggcgagttcggcgtcacgaggcggtgcgaggacgccgccacgggggaggccctggcgtgcaagacgatccggcggaagcggctgctcctgcgcctcgccgggcncgacgcgaccgac

SEQ ID NO: 7710 - DNA, 391 bp, Zea mays
  unsure at all n locations
  Clone ID: LIB148-060-Q1-E1-D4
cgggtcgaccagcgtccggatggtggcccggtcgggggccaaaacccggggcttccccaatggaaaggatttcgccaacggcttcaaaaacttcggcaacaagggcggaaacccggagcatttcgacccaagcataaacccgtcctacgccagggngctgcaggacgtgtgcagggactacctcaagggacccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccacagccttcttcgacgacttcggccgcgccatggagaagctc

SEQ ID NO: 7711 - DNA, 379 bp, Zea mays
  unsure at all n locations
  Clone ID: LIB148-060-Q1-E1-D5
gcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcngggacgagctctcggtggaggagcgcancctgctgtccgtcgcctacaagaacgtcatcggcgcccgcagggcctcgtggcggatcatctcctccatcgagcagaaggaggaaggccgcgggaacgaggcgcacgcggcatcca

SEQ ID NO: 7712 - DNA, 366 bp, Zea mays
  unsure at all n locations
  Clone ID: LIB148-060-Q1-E1-C12
agaaaccactgagcttaccacaaagcttgacaaggaaatccactcactgaaggcccagttggaggcagcanagtacgatgtcatcaagtactgcataggtaccattgtttcgatctcagccgtcggcctcgccgtcctccgcatcgtgatgtgaaggcagcaaagcaaatacgttctttggttttacccatattcgtcgcccgtccgtggaaacccgcaagaagagaataggttctaattctgttcctagtttttaaaggggacaaaacgtgctcaggggagggggacacttggtagtagggagatgttgctcaaacttgtaaaaatagattgcccgtggaagaaatgcatccgaaatgattcttt

SEQ ID NO: 7713 - DNA, 384 bp, Zea mays
  Clone ID: LIB148-033-Q1-E1-G9
ggggtgaccgtctggaggtgctggtggacaagacggcaaccatgcaggggaacacggtgcgcttcaagcgccaagctcgccgcttcaggaacaccatgtggtggaggaacgtcaagctcacagctgcagtgatattcatcctcaccgtaatcgtgtacgtcctgctcgcctacatgtgtcgcggcttcaccataccgtcatgctttccgtaatctccatccgtcccggtgccagtgcggaccaccagccctagctctagctgcctcacaacttggttttccgggttctgtaacagcagcagcggtgctgcagttctctctcttgtacgagggaaacaacagctcattctcaagttctgcaacaaccagattctgattttttttt

SEQ ID NO: 7714 - DNA, 378 bp, Zea mays
  unsure at all n locations
  Clone ID: LIB148-033-Q1-E1-H1
gnggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggnggcagaacttccacagttccaaatcac

SEQ ID NO: 7715 - DNA, 392 bp, Zea mays
  Clone ID: LIB148-033-Q1-E1-H10
agcacactgtggcactcagaacagaatccagcctttataacccaactacttctcctagtcttgttgcatctgcacagggtctacagaatgaggacttctccgcaagccagctaagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagaacaattaacagcttgctgaaagcacaatatgtgaagaagggagactac

SEQ ID NO: 7716 - DNA, 400 bp, Zea mays
  Clone ID: LIB148-033-Q1-E1-H11
agagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgac

SEQ ID NO: 7717 - DNA, 371 bp, Zea mays
  Clone ID: LIB148-033-Q1-E1-H12
acggacgcgtccacccacgcatccgccggcgccggatcgggccgccctgactgtgggtccgggcatggacatgccgatcatgcacgacagcgaccggtacgagctcgtgcgcgacatcggctccggcaacttcggcgttgcccgcctcatgcgcgaccgccgcaccaccgaactcgtcgccgtcaagtacatcgagcgtggcgagaagatagatgagaatgtccagcgcgaaataattaaccatagatcattgaaacaccctaacattattaggtttaaagaggttattttaacaccgacccatcttgctattgtcatggaatatgcctctggcggtgagctttttgagagaatatgtaagaacgtgcgat

SEQ ID NO: 7718 - DNA, 380 bp, Zea mays
  unsure at all n locations
  Clone ID: LIB148-033-Q1-E1-H2
aacccctatcgcaccgcagccgccggccatggcctgcctcaccgacctcgtcaacctcaacctctcggacaacaccgagaagatcatcgcggaatacatatggatcggtggatctggcatggatctcaagagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcangaggggcaacaacatccttgtgatgtgcgattgctacaccccagccggcgagccaatccccaccaacaagaggtacaacgccgccaagatcttcagcagccctg

SEQ ID NO: 7719 - DNA, 217 bp, Zea mays
  Clone ID: LIB148-033-Q1-E1-H3
tgtcgtggtactcgcagatgctgctggagcacggcgacctcatcctgtcgggcgccacgtccgtgttcggcgccgcgcccgtggaggtctccgtgaaggtggccggcatccactggcactaccgcagccggtcccacgccccggagctcaacgcgggctactacaacacgcggcgccacgacgggtacctcaccatcgcgcgcctcctggcgcccca

SEQ ID NO: 7720 - DNA, 163 bp, Zea mays
  Clone ID: LIB148-033-Q1-E1-H4
cctccaatgtccaacaattaaacctcccccaacggcaaaaccaataagttcaaccaatggttcctgttcaaccaaacccaaaaacccttaagggaaaaccccaacttaaggcaacaacttcaaaaccaaaggttcaacttaaaacaataacaaccaaaattaa

SEQ ID NO: 7721 - DNA, 431 bp, Zea mays
  Clone ID: LIB148-033-Q1-E1-H5
gtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaaccccgtggtggtgcacatcaacgacatgaactatgaccctatcgcggcgtacaacttcgatttagcaggcacggcgttcggcgccatggc

SEQ ID NO: 7722 - DNA, 422 bp, Zea mays
  Clone ID: LIB148-033-Q1-E1-H6
gagagccttaccctcgaagccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagcccca

SEQ ID NO: 7723 - DNA, 300 bp, Zea mays
  Clone ID: LIB148-033-Q1-E1-H7
aatgagcgtcacggtcgaaaccgatgggttcgtgcattctcttcctcacggacatggaggatataacagctgcgccaaggatagtgtcttcttccgcggtgaaaaccgtgggtgcagcaccggttacggggacttcatcctgtagtggtactcgcagatgctgctggagcacggctacatcatcctgtcgggcaccacttccgtgttcggatccgcgcccgtggacgtctccgtgaatgtgggaggcatccactgggactaaggcagacggtcgcagaccccatgtctcatcgctggcta

SEQ ID NO: 7724 - DNA, 337 bp, Zea mays
  Clone ID: LIB148-033-Q1-E1-H8
acccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaagaagtctggtccagctgccgcgccgaccaccgccgcctct

SEQ ID NO: 7725 - DNA, 401 bp, Zea mays
  Clone ID: LIB148-034-Q1-E1-A1
acccacgcgtccgagggggctcagctgcaagaaagtcccaactgaagggtgcaaaaagttcagacatcagaggagggaatcctgcaaaaaagtcatcgcccttacagaaaaagctgagtgctccctcaccaacggtaactaagaagagcggaactgaaggaaagaaaactccaaatggaaaaacaggagccaagaagtaagcaactcagttgaaacttcgttttgttgggaccaacttcaccatggccggggacagataaacatgttgatcctatctactgggtgatacattggtgttttgacacacggatatgtcagtcctattggttgagagagcatgctggatcttcggccatatgctgtaaatcgcttgttaatttttgttctactagtacacgaag

SEQ ID NO: 7726 - DNA, 377 bp, Zea mays
  Clone ID: LIB148-034-Q1-E1-A10
acgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcg

SEQ ID NO: 7727 - DNA, 429 bp, Zea mays
  unsure at all n locations
  Clone ID: LIB148-034-Q1-E1-A11
cgggccgacccaagcgtccacgaagagctagtaaatttctggagcgttgccttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgcatctacgaaactaatgcacagtcagaagaatgaagccatttctgaaaaccttggcacgacactggtttgttttgggtcagccacacgtttcagttgtcgctgtccctactttgttccgggagtattgagagcttgtgttctgttcacgattgattcangtgttttcctttggtttgcctggttttt

SEQ ID NO: 7728 - DNA, 377 bp, Zea mays
  Clone ID: LIB148-034-Q1-E1-A12
acccacgcgtccgccgtcgatcgcggtcacgcggtgccgtcgacgcgcgccttggtgacgccggcgcaggcgtcgacgaagtcgccgtcgatgaagtcggtggagaagagctggagcttgtcgccgaggcccttggcgaagacctcggcgatgaacatccgcgcgtagccgtggatccgcctcgtcacgggccacacgcacaccaccgggttgtcgggcctgggcgtcaccgtgttctccacccggtacaagaacccgcggcccgccaccggcggctgctgccccaggaacttgaggttgctctcgaacttggtctccggcaggtccgtgtcgatccagttgtccctgaggtacccggcgctccacaagggctcccc

SEQ ID NO: 7729 - DNA, 407 bp, Zea mays
  Clone ID: LIB148-033-Q1-E1-G8
agccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcacggcccaaccg

SEQ ID NO: 7730 - DNA, 365 bp, Zea mays
  Clone ID: LIB148-033-Q1-E1-F10
agaaaaccttggcattttcacaaacaggcttgcttccggtgacgccagaggtagtcaagaagacgtgctgtttgaagagcatgagcatacaacagctgatgggtctccttccaacggtgacaagttgagcggcgtagcgaatcttaaggctgggatttctctgctcaatataagactgagggcacttgaagacgaccaggagtttctcaagcaggtgttgagttccctccaatgcggtagtgatggaatgcagtgtatacaggagataagcggccatccagcagagttgcgaaaagttgtaactcgctaaagaaaatggttttgccccgagtccacactgttaggtcatcgtgaggtcttctcat

SEQ ID NO: 7731 - DNA, 369 bp, Zea mays
  Clone ID: LIB148-033-Q1-E1-F11
acatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtacttt

SEQ ID NO: 7732 - DNA, 354 bp, Zea mays
  Clone ID: LIB148-033-Q1-E1-F12
actcgagggccgacacacgcctctagagcaatccctcaaatccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtagtgcagctggtcctagcgtaagctgcgccgcggctgccgccgtgtccaccgccggggcactcgtcacctccttcttcgcctactaactccagtgatcgacgacgcgcgggg

SEQ ID NO: 7733 - DNA, 401 bp, Zea mays
  Clone ID: LIB148-033-Q1-E1-F2
gggcaagacgtaccgcctccgcgtgtgcaacaccgggatcaaggcgtcgctcaacttccgcatccagggccacgacatgaagctcgtggagctggagggctcacataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgccggcgcccaacatgaccgagccaccggccggctgggcctggtccatcaaccaggccaggtcgttccgctggaacctgacggccagcgccgcgcgccccaacccgcagggctcctaacact

SEQ ID NO: 7734 - DNA, 319 bp, Zea mays
  Clone ID: LIB148-033-Q1-E1-F3
gagcccgcaacatgaactgagcccagcgctagctgctgccgggggcgcgccgtcgtcgccgagccggtcggtctggtctggtctggtctgcctgcctgccaagtcacgcagcctggctccaccgatcgcacaccatacattgacgtcgtcgtcgcggccgtacgtgccgttggacggtggaggaggcggtggcgctacgacagtatatatatacacaattacacatacacaccccaaaaagaaaagaaaaaaactactgccattgctgtcgttgtgcgtagcttctctctatatatatacccgtatttaaattctcgac

SEQ ID NO: 7735 - DNA, 401 bp, Zea mays
  Clone ID: LIB148-033-Q1-E1-F4
ggagcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggc

SEQ ID NO: 7736 - DNA, 116 bp, Zea mays
  Clone ID: LIB148-033-Q1-E1-F5
gctggctatgtcagagccggatgtcctgcgagacctgcggcaccgggttctcgacgaccatcgccgtgtacaccgcggactgccaaggtgacgatcgagtgcatgcagtctctcgc

SEQ ID NO: 7737 - DNA, 206 bp, Zea mays
  Clone ID: LIB148-033-Q1-E1-F7
ggcagccgaggcggcgcagaagctggccgacctggaggcgcagcggcgacgcaacgccgaggtgcgcgcgcgccgggaggccgacgagaaggtgcgcgccctggatgccatctccaaccacgacttccggtaccgcaagtaccacatcgacgagatcgagattgccacggagcgcttctccgacgagcccaggatccgcgagggcg

SEQ ID NO: 7738 - DNA, 373 bp, Zea mays
  Clone ID: LIB148-033-Q1-E1-F8
gccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatcaccgaggcatccggatccatgtccgcaggcatcgccctgccaccctccaacgccggagcgccctcctacggggcggcggcgccgttcggaggtgccgcggacgcacccgccggcacctccgagggccctgccagcgccagcgggccatcagctggtgacgcgccggcgtatggcgccagcgccagcggcccgactgctgatgctccggcga

SEQ ID NO: 7739 - DNA, 365 bp, Zea mays
  Clone ID: LIB148-033-Q1-E1-G10
cggacgcgtggggcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggc

SEQ ID NO: 7740 - DNA, 357 bp, Zea mays
  Clone ID: LIB148-033-Q1-E1-G11
cgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagcca

SEQ ID NO: 7741 - DNA, 364 bp, Zea mays
  Clone ID: LIB148-033-Q1-E1-G12
cttctccaccaccaacactagtcagctcaccaccaccagcacctaagtcattacctccacctactcccgtgagctcgccgcctccagaagtgaagtcctctcctccaccaaccccagttagctcaccaccaccagcgccgaagtcgtcacctccacctactccagtgagctcgccacctccagaactgaagtcctctccaccaccagccccagttagctcaccaccatcagcgccaaagtcgtcacctccacctgctcctgtaagcttgccacctcctgaagtaaagtcttccccaccaccagcaccgattagctctccaccacctccggccaagtcaccacctccaccggcccctatgagctc

SEQ ID NO: 7742 - DNA, 119 bp, Zea mays
  Clone ID: LIB148-033-Q1-E1-G2
attctaaatcgcgagcggggccctttttttttttttttaaaaaaacttgtcaatcaatttcttaactcttcgctgttgtttaaaagagaagagttaagaaatggattgacaagttatat

SEQ ID NO: 7743 - DNA, 423 bp, Zea mays
  Clone ID: LIB148-033-Q1-E1-G3
tagagatacacatctcaagataacagccacatgcgcctgtccctccctcctcgtcatcgtggccgccctctcggcgcgcgccgcggcgcagctgccgccggccggcggcgccctgaagccggacgtctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcagtgctgatcgcgtccacccagttccagaagtcggagcacgacgcggagatcaaccactccctccccggggacgccttcgacgccgtggtgcgcgccaagctggccctggagctggagtgccccggggtggtgtcctgcgccgacatcctcgcactggc

SEQ ID NO: 7744 - DNA, 423 bp, Zea mays
  Clone ID: LIB148-033-Q1-E1-G4
acgcttcggattcttaaaacaaccaccaggaggtacaaccaggaccacctaggaggcctctctctctctctccccagccacccccgtaccaaaaggaagggcggaaaaggataaccgcgtcaaggttcataaattgcgtcacggtcggggacggcgccttcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactgatcagtaaggccagctatgagaatgtttcgaagaagtggataccttaactga

SEQ ID NO: 7745 - DNA, 83 bp, Zea mays
  Clone ID: LIB148-033-Q1-E1-G6
cttcccccgccgggcatcagctcagccgccgtaaccgccacatcagctatgggcgcctgcgctatcagttgcagtagtcttga

SEQ ID NO: 7746 - DNA, 435 bp, Zea mays
  Clone ID: LIB148-033-Q1-E1-G7
actcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgacctccaaggcaagccacaaggaggacatctgcgaggttgtcttggtggagagcccgcgcaaggactgcga

SEQ ID NO: 7747 - DNA, 430 bp, Zea mays
  Clone ID: LIB148-033-Q1-E1-F1
ctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaacagtaaactataacac

SEQ ID NO: 7748 - DNA, 408 bp, Zea mays
  Clone ID: LIB148-033-Q1-E1-D5
agaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgaactcctggccggcgccgac

SEQ ID NO: 7749 - DNA, 395 bp, Zea mays
  Clone ID: LIB148-033-Q1-E1-D6
atcaatcatgtctggtcgttcgtggacaataatggcgcctctcctagcgtcgatgctgctcgtccggctcgccgcgggctccgaggaggaggaggacggcggcggcaaaaagaagccccacgtcaaccacggcaagtttaaggcggagccgtggacggacgggcacgcgacgtactacggcgggcgcgacgggttaactgacaccacggacagcggcgcgtgcggctacaaaggcgagctggggaaagactaccgcaccctgactgcggccgtgggcccgtcgctgtacaccaacggcaccgggtgccgcgcgtgctacgagctcaagggccccaagggcaccgtggtggtgacggccaccaacgatgcccccccgccggtgagcgggcagaagg

SEQ ID NO: 7750 - DNA, 338 bp, Zea mays
  Clone ID: LIB148-033-Q1-E1-D7
cccactcgtgcagccagtcacgctatgggaccacatttcacatcacagaaaagacagatcacatcaatgccacacggatcacagtgctgctgtctcacgtcatgaaaggcactgccccgggtatcaactgatgtaagtccaggatgctcgacatcaagatcgagcacgcattatagcatgaccattaaggatatcaccgtaagcacgccatccgaagtagagagcactgacgccttcaacatctgaagctccacgactatgtctatcattacttcgacgatcggtacttgctaatagtgcgtttccagtgaacccgcatgaaactccatcatgctgaa

SEQ ID NO: 7751 - DNA, 422 bp, Zea mays
  Clone ID: LIB148-033-Q1-E1-D8
accacgcgtccgcgaggttctctccgacaatgggtcctctcctccgcgccgccgcgctctccgtcgcgctcctcgccctcgccgccgtgggcgaggcgcacagcgccaccgaattcctcaacatcttcaaaccgcggaatgagcacgactacttccacaacgcgaaccaggaggaggatgtgatgccccgggccagcgaccagcagaacctcataacggcgccggtgaccaagagcggcctcatgaaggtgccgccccggtccgcgcccaccgcggtggcgcaggacacggtggtgctccccgtggacagcgccgcggggttccccggcgcttggtccatcatcagcgagaacgcgggcgtgtccgcgatgcacctggtgatcatgccgagcgacaaggccatcatgttcgacacggtcaac

SEQ ID NO: 7752 - DNA, 388 bp, Zea mays
  Clone ID: LIB148-033-Q1-E1-D9
ccgtccatgatgcacatcgcggtcgccgggtccgtggcgctcgggagcttcacggaggccggcgccatcgtgttcctcttcaccgtcgccgagtggctggagacgctggcgtgcagcaaggccagcgccgggatgctgtccctcatgtccacggtgcccaagactgtcgtgctggccgagacggggcaggtcgtcggcatgggcgacgtcgcggtcggcaccgtcgtcgcggtcagggccggcgacgtggtccccgtggacggcgtggtcgtcggcgggcacagcgaggtcgacgagagcagcctcaccggcgagtccttccccgtgccgaagcagccgcagtcggaggtctgggccggcaccatcaacttagacggctacatctccg

SEQ ID NO: 7753 - DNA, 429 bp, Zea mays
  Clone ID: LIB148-033-Q1-E1-E1
accacgcatccgggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaagagctcgcctgcatctg

SEQ ID NO: 7754 - DNA, 389 bp, Zea mays
  Clone ID: LIB148-033-Q1-E1-E10
gaccgacccgtccacgcgtgatggacgcccgtctccgcctcggcttcttcctcctcctcgtggccgcggcgttcgcgccgctggtctccgcgcagctctctgcagatttctacaagacgtcgtgccccgacgccgagaagatcatcttgggcgtcgtcgagaagcggttcaaggcggaccccggcaccgccgccggcctcctccgcctcgtcttccacgactgcttcgcaaacggctgcgacgcgtccatcttgatcgagcccatgtcgaaccaggcctccgagaaggaggcgggccccaacatctccgtcaagggctacgacgtgatcgaggagattaagacggagctggagaaagagtgccccaacgtggtgtcgtgcgcggacatc

SEQ ID NO: 7755 - DNA, 393 bp, Zea mays
  Clone ID: LIB148-033-Q1-E1-E11
agggataaattacaccaaataccagcctcttttgactcacgctgcctgaaataaacgcttacaagaaccagctaaccgtcatttggaattggatgctgagaggtaaccataccaggacccagactcctggagatttcagaccagagccgctgtcgattatcacagcttctgctgaaacgccatcatccgagcttaggtggggcaggtgactcattgacaactggctgctcccgttcgaatccgtggtgctaatgtagtcgtttctttctgaacacggggggaaaaggcggagactgcggtacatgtaaatctgtaaatcattgctggatagctccggttgcctcccttttactacccaacattctagatttagtaaatataactaattctgac

SEQ ID NO: 7756 - DNA, 293 bp, Zea mays
  unsure at all n locations
  Clone ID: LIB148-033-Q1-E1-E2
cacatactgatattggcaatcactacangagtgacgacggcctttgtggtggtgcagaacatgggttctttggtgaccattgtgacacaaaagagtggggcttcggtttcagtactggttgggagaggcatgattttttgtcaacgaacaatgtcatagaagaggtgttcgggaagggctccagtgaagatggaagtgacactgctactggccaggaccttatctgagccagaggcggaggcttcttttcagctgcgaaacctttagcagctcccccttgttctctgaatctg

SEQ ID NO: 7757 - DNA, 356 bp, Zea mays
  unsure at all n locations
  Clone ID: LIB148-033-Q1-E1-E3
gatactgactacttatggtacaccacaagctttcgcttggagtcagacgatttgccctttagaaatgacatccggcctgtgcttcaggtcaaaagtagtgcacacgcaatgatgggatttgctaatgatgctttcgtatgatgcgcgcgcggaaacaagcatgtgaanggtttcatgtttgaaaaaccggttgatctgaaagtangtgtgaaccatgtcgtattgctgtcgtcaactatgggaatgaaggatagtggtggtgaacttgctgaagtaaacggcggcattcaggagtgcctaatccaaggtctcaacactgggacgttggatttacaagtcaatggctggggccataa

SEQ ID NO: 7758 - DNA, 422 bp, Zea mays
  Clone ID: LIB148-033-Q1-E1-E4
tcacctcccccggtctccctcgggctaggctagctacctaggttaccactctggtacaacatggctggtgatggcatggaggtatctgccagcgggggtggcggcggcaacaagcagccgcagatcagccttttggggctgttcctcgcctgcatggtcgccggcggcgtgcagtacggatgggcgctgcagctctcccttctcaccccctacgtccagacactggggattcctcatgctcttacatcagtcatgtggctctgtggacctattgctggcttacttgtacaaccctgcgtcggcctctatagtgacaaatgcacttctaagcttgggagactgaggccattcatctttacaggatgcatcatcatctgtatatccgtgatagtcatcggtttctcctcagacatcggttacgc

SEQ ID NO: 7759 - DNA, 429 bp, Zea mays
  Clone ID: LIB148-033-Q1-E1-E5
aaccacgcttccgcgtccgactccatcgcctcggtgaagctccgcgtgcagacgtcccggggcgtgagggcgcgcaagcagaagctcgtcttcggcgggcgcgagctggcgcgcgacgacgggcgcatcctggactacggcgtggcggacggcaacgtggtgcacctggtcatccgcgtcccggacgtgcgcctcatcaccgtggagaccgtgcagggcggcaagttcaggttccgcgtggagcccgggcgcaccgtcgggtacgtgaagcagcagatcgccaaggaccaccccgcgggggcgcgccccggcgagcagcggctcgtgctcgagggcgaggacgtcgacgatcgccacctcatccacgaagtgtgcatgggccgacggccccgtgatacacctgctggttcggcgctccgtcttcgcgcg

SEQ ID NO: 7760 - DNA, 176 bp, Zea mays
  Clone ID: LIB148-033-Q1-E1-E6
agcacgtacgagctcagaaggaaggcagaggcaaaagcagccatggcgaactcgtcgtccggccttgcggtcaacgacgagtgcaaggtgaacttccgggagctgaagtcgcggcggagcttccggttcatcgtgttcaggatcgacgacacggagatcgagatccgggtggagcg

SEQ ID NO: 7761 - DNA, 301 bp, Zea mays
  Clone ID: LIB148-033-Q1-E1-E7
aggcgaggggcccggcggtcttcgccgccgcggtcgtggtgtttctgccggtcttattccccgggttgttctcccctcttggccacgctttcccttctgtcctctcggagtggaatgcccctaatccaatgcatccttcacttttgaatgatgccttgcgatggacatctatagaccgacatgataaagatctatagtcacccttgccatagcaggggtggaaaccatgcttaagtgcatgagtttctcacaaattacccctggaatcacgttgatacgtccaagtatttcctgatggtgg

SEQ ID NO: 7762 - DNA, 320 bp, Zea mays
  Clone ID: LIB148-033-Q1-E1-E8
acgtaacgcctccgcgtgtgcaagaccaggatgaacgcgtcgctcagcttccgcatccagggtcacgacatgaacctcatggagctggaaggctcacataccctgcatgacgtgtacgactcgctggacgtgcacgtcgggcactggctctccgtgctggtcgacgccgaccaggcgcccggcgactactacatggtgggctccacgcggttcatccacgaagccaagtccgcctcggccgtcatccgcgacgccggctctagcggcgtcccgccggggccgaacatgaccgagccagcggccgcggtgggcctggtcca

SEQ ID NO: 7763 - DNA, 376 bp, Zea mays
  Clone ID: LIB148-033-Q1-E1-E9
ctctgaacgtcgccggcggcgggcagcccaacgagccggcggcggggaggccgccgaagctgtcgatggagacgttctcggggatgatcaagaggccgttcgccaagttcctgagcccggtgatcaagggcgtgtgcgccaagacggagtacccggaggactgcgagtcgtcgatcgggggcctcccgggggccgcgtcggcggcggccacggacagcgtgggcgtgctgaagctggccatggaggcggtgcggcagaaggccatcgaggcgatgaacgcggccacggacaggatgaacgcgccgggcacggacccgacgaccaaggaggcgctcgactcgtgcacgtcgtcgtacagcgacatcaagacgagcct

SEQ ID NO: 7764 - DNA, 417 bp, Zea mays
  Clone ID: LIB148-033-Q1-E1-D4
gccgggttggaagaacccccaagtaagaaaataaccgaaccaaaaggttgggcaaaggtgaataatgctcaaccaaaaggttccaaggttcccaagaaaccaattcctcctttccaatccttaaaaacactttaagaaaaattgcaaattgaaacaacacttgaagctgacatggagaagaaaaatgggacaacaatccacatgaagcttgtaaaaaagaaattaaactaataatttattctagtgtcaaagttcataatgactggacttgtactctgttattatgctataataatttgttgaatattagatgatcatgtcatgtgctgttttttttacatttttagtgatgtttcattgtgtttttgtttttctaaatatttcctatttttctttgatttttatgattttttgaag

SEQ ID NO: 7765 - DNA, 371 bp, Zea mays
  Clone ID: LIB148-060-Q1-E1-A7
agaccatcaccgaggccatcaccgccgtgcccaacaccttcgaggggcgcttcgtcatctacgtgaaggccggcacgtataaggagtacgtcaccgttcccaagaacatggccaacatcttcatgtacggcgacgggccgacacagacggtggtcaccggcgacaagagcaacgcaggcggcttcgccaccttcgcctcagccaccttctctgctgagggcaacgggttcatctgcaagtcgatggggttcgtcaacacggcggggccggaggggcaccaggcggtggcgatgcacgtgcagggcgacaagtcggtgttctacaactgccggttcgaggggtaccaggacacgctgtacgtgcacgccaac

SEQ ID NO: 7766 - DNA, 411 bp, Zea mays
  Clone ID: LIB148-060-Q1-E1-A8
accacgcgtccgctttcgcggatttaaggatacaaagacgcctctatacgcaactgtggctggagatgcgatcaatatagttttggatccaatatttatgtttgtgttccaatatggtgttagtggtgccgccatcgctcatgttatatcacaatatttcattgcatccatactcttatggagattaaggttgcatgttgatttgttgccacctagcttcaaacatctgcagtttggccgatttcttaaaaatggttttctgctacttgcacgagttattgccgcaacttgttgtgtgacactatccgcttcaatggccgcacggctaggttcaactccaatggctgcattccagatctgcttgcaaacctggttggcttgctcacttcttgccgatggattggcttttgc

SEQ ID NO: 7767 - DNA, 403 bp, Zea mays
  unsure at all n locations
  Clone ID: LIB148-060-Q1-E1-B1
ctccaactaatcccgttggagtggcggcttcaaaagtggagttctccccttcaacaaacccaagttggttaacaacaacaagggcggagttggtaacgtcaacttatccaattgaggtcggcaacttcaagaacggaagtcctctcaacacaagcccaagttagctcacacatcagcggcaagtcgtcanctcaactgctcctgtaagcttgccacctcctgaagtaaagtcttccccaccaccagcaccgattagctctccaccacctccggccaagtcaccacctccaccgggccctatgagctcacttcctccccctgtgaagtctccanctccaccagcgccggtcagttcgccancanctccaatgaagtcccaacggcggcaggcacaattagctct

SEQ ID NO: 7768 - DNA, 409 bp, Zea mays
  Clone ID: LIB148-060-Q1-E1-B10
acctcagtctgtaccgcgccaaggtggagcaggtccggcagcaccgggcgcagctcaagcgggagatctccgactccgtcgccgaggtcgccgccatctgcgccaccatcggcgagcctccctccaccgtgcacacggcctgctcctcgctccagggcacagggagcctcaaggaggagctgggcctgatcgcgccggagctggcggagatgaggcggaggagggacgagaggcggcgcgagttcgcagacgtcacccagcgggtcgccaggatccaggaggagttgaacctgcagctaggtggcgggcagggccagtctgaagctcacgccgccgccgtcatcgtcgacgtcgacggctccgacctgacgacgaccaagctcgacgagctccgagcctatctgcagca

SEQ ID NO: 7769 - DNA, 421 bp, Zea mays
  Clone ID: LIB148-060-Q1-E1-B11
gtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgtt

SEQ ID NO: 7770 - DNA, 193 bp, Zea mays
  Clone ID: LIB148-060-Q1-E1-B12
atttggaatttgtggaaaacattcacaattatggcagtagaatttatttggtttggcgctggcgatggggtcgggagttgtcgcgtgggctagttgggccgcggttggtgattcggcccactattcctcccaaaccctagccgccctccctcctcacccctccccctttgtgcagccgcccccccacttcccc

SEQ ID NO: 7771 - DNA, 409 bp, Zea mays
  unsure at all n locations
  Clone ID: LIB148-060-Q1-E1-B2
gattcatcgtgttcaagatcaacgagaacgtgcagcaggtggtggtggacaggcttgggggaccaggtgaaagctacgatgcgttcagggcctgctttcncgccaacgagtgccgctacgcggtgtttgattttgactttgtcactgatgagaactgccagaagagcaagatcttcttcatctcttgggccccagatgcatcgagggtgagaagcaagatgttgtacgcaagctccaaggaccggttcaagagggagctcgacggcattcaagtggagctacaagcaactgagccgagcgaaatgagcatggacatcatcaagtcgcgagccctctgaaacagcccggcatcagctcctgcatgcccgtcgattccttcggtgttggtaacggtcatccgttttcgtgt

SEQ ID NO: 7772 - DNA, 57 bp, Zea mays
  Clone ID: LIB148-060-Q1-E1-B3
gggtccgagcacgcgtccgaagtcacgtgggcggacgcgtggggttctagatcgcga

SEQ ID NO: 7773 - DNA, 406 bp, Zea mays
  Clone ID: LIB148-060-Q1-E1-B4
aaaaaacgttgccaatcccatggagcatccgcttcaggatcgccgctgacatcgcaactggactcctcttcctcgaccaagcgaagccagaaccacttgtccaccgggacctgaagcccgccaacatcctcctcgaccacaacttcgtcagcaagatcagcgacgtcgggctcgcgaggctggtgccacagtccgcggccgacgtcacgcagtacaggatgacatcgacggccggcaccttctgctacatcgacccggagtaccaacagactggcatgctcaccaccaagtccgacgtgtactcgctcggcatcatgctgctccagatcatcacggcgaggtcgcccatggggctcacgcaccatgtggagaacgccatagagagaggagccttccaggagatcct

SEQ ID NO: 7774 - DNA, 406 bp, Zea mays
  Clone ID: LIB148-060-Q1-E1-B5
ggcgccgctcgggcctgtcccacgccgccgtcttccgcccgcagcaaccttacccgagccgactccgggacaccttcgccgcgtccatgcccgaccacgcgttccgactcctcgccatgctcctctccctcgaccctgccgcccgcggcaccgctgccgccgccctcgacgccgagtacttcacgacggcaccgtacgcatgcgaccccgggagcctgcccaagtacgcgcccaacaaggagatggacgccaagttccgggaagaatctagaaggaggagcaacctccggagccaaggcggcgagggggcgaagcggctgtcctgggggcacaagagcatgcagctgcaggacacgaaccagagccacgtgcacgccgaggaatcgctgcccgttgtggccaaaag

SEQ ID NO: 7775 - DNA, 411 bp, Zea mays
  Clone ID: LIB148-060-Q1-E1-B6
aaccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgaggaccggatggtggccttcacgtacctgcgcatgggccccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccggccgggactggaccggacggaacggaagcctacgatcgactgtacatac

SEQ ID NO: 7776 - DNA, 404 bp, Zea mays
  Clone ID: LIB148-060-Q1-E1-B7
aatctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctctaccgtttcgag

SEQ ID NO: 7777 - DNA, 382 bp, Zea mays
  Clone ID: LIB148-060-Q1-E1-B8
accgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcat

SEQ ID NO: 7778 - DNA, 419 bp, Zea mays
  Clone ID: LIB148-060-Q1-E1-B9
acgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaagctggtgcccgtgtcattgtgaccgag

SEQ ID NO: 7779 - DNA, 389 bp, Zea mays
  unsure at all n locations
  Clone ID: LIB148-060-Q1-E1-C1
actcctccccaagaaaactggaattaaccggcaattttattgaaaagggaaatgaaaaggaaggccaaccaaaaattaagcggtacatgacaatgatggactccatgaccgatgcagagcttgacgggacggacccaaagctgatgaaccagtcacgaatcaaccggatcgctcggngatccggcangcgcgtggaggaagtggtgcacatgctggacgagtacaagcgaattgccaaggtgtggaagaaattgccagtgttgaacaacaacaggagatcggatatgaaccgcgacattangcgcataagcgatgcgattcctcccaatatgctgactcagcttggtggcatcgctgggctgcagaatatgatcaaacaaatgggcggg

SEQ ID NO: 7780 - DNA, 419 bp, Zea mays
  Clone ID: LIB148-060-Q1-E1-C10
gttggaccgtccacacgggctatggcccctcctagaatcaattgttagggatatggccatggttcgtaagtaaaaccgtggctgcgccgtgtcccacgcatttagagggccgggatcgtcctggagattcgtcggcacaatcagatacgccgaatcctaaaacggtccaggatttttgagttggaaactgtgggaaatgcgggatatgatggtgagcagatatttgcaaatgtatccttggaaagatgtttcggaagatttcattgcaatgggttttcaaaattctccgtttattattctatgtttgttagctgttaaccgttgcctagtgtctacgtattgtcaaaccttcttacagtagaagtcaacgctatgcaccaagcagattaaattagtggacagtagtcaaatattgtgag

SEQ ID NO: 7781 - DNA, 389 bp, Zea mays
  unsure at all n locations
  Clone ID: LIB148-060-Q1-E1-C11
agcccgcgccggcatcaaggaggtccacttcctccccttcaacccggttgagaagcgcacggccatcacctacatcgacggcaacggcgactggcacagggtcagcaagggcgcccccgagcagatcatcgagctgtgccggatgagcaaggatgccgagaagaagatccacgccctcatcgacggctacgccgaccgcggcctccgctccctgggcgtgtcgtaccagctggtccccgagaagagcaaggagagcgccggcgagccgtggcagttcatcggtctcctcccgctgttcgacccgccgcggcacgacagcgcggagaccatccgccgcgcgctccacctgngcgtgaacgtgaagatgatcaccggcgaccagctggcca

SEQ ID NO: 7782 - DNA, 429 bp, Zea mays
  Clone ID: LIB148-060-Q1-E1-A6
atccgaccacgcgtccgctttcgcggatttaaggatacaaagacgcctctatacgcaactgtggctggagatgcgatcaatatagttttggatccaatatttatgtttgtgttccaatatggtgttagtggtgccgccatcgctcatgttatatcacaatatttcattgcatccatactcttatggagattaaggttgcatgttgatttgttgccacctagcttcaaacatctgcagtttggccgatttcttaaaaatggttttctgctacttgcacgagttattgccgcaacttgttgtgtgacactatccgcttcaatggccgcacggctaggttcaactccaatggctgcattccagatctgcttgcaaacctggttggcttgctcacttcttgccgatggattggcttttgctggacaaatgcat

SEQ ID NO: 7783 - DNA, 308 bp, Zea mays
  Clone ID: LIB148-059-Q1-E1-H12
gtgagtcgtattaatacgtggtctgagtagcactcctcgggtcctgggttcgacttcccgtgggagcgaattttagactgtggttaaaaaactctcctcgtctgtctcacgctaaagcacaggtctaaggcttacctccggtcgtggtcgttctcacatgggcttcaatgccgctgtcgtacccccccactccccagcgtacgtcatcgtcaatttggtcacacatgcgactatccatgctgatatggacggcgctcatgtagtctattcctactaagtctggcattttccagggctaagtgtttttt

SEQ ID NO: 7784 - DNA, 362 bp, Zea mays
  Clone ID: LIB148-059-Q1-E1-H2
ggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattgga

SEQ ID NO: 7785 - DNA, 426 bp, Zea mays
  Clone ID: LIB148-059-Q1-E1-H3
acgcgtccacccaagcgtccgcgctggccgccgccgtcatgtcgctcacctaccccaccatcgcgtggggcgcgtcggtggacaagggcaggatggcgggcgtggactaccacctgcgcgcgaccacgacccccggcaaggtgttcggcttcttcggcgcgctgggcgacgtggcgttcgcgtacgccgggcacaacgtggtgctggagatccaggccaccatcccgtcgactcccgagaagccgtccaagaagcccatgtggaagggcgtcgtcgtcgcctacgtcgtcgtcgcgctctgctacttccccgtcgcgctcatcggctactgggcgttcggcaacagcgtccaggacaacatcctcatcacgctcagcaagcccaggtgggtcaacgcgctcgccaacatgatggtcgtcatccacg

SEQ ID NO: 7786 - DNA, 373 bp, Zea mays
  Clone ID: LIB148-059-Q1-E1-H4
gcgtccacccacacgtccgaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatggggga

SEQ ID NO: 7787 - DNA, 414 bp, Zea mays
  unsure at all n locations
  Clone ID: LIB148-059-Q1-E1-H5
cccacgcgtccgctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggttncccgcccgcgtcaggacggtcaaggacc

SEQ ID NO: 7788 - DNA, 401 bp, Zea mays
  unsure at all n locations
  Clone ID: LIB148-059-Q1-E1-H6
gaccatccctgcaaattaccgcgatggctcccaagatcctagtcatccttgtgttcctcgccgtggcctcaccggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcancgacaagaaactcggcgtcctcaactacaccagggccgac

SEQ ID NO: 7789 - DNA, 405 bp, Zea mays
  unsure at all n locations
  Clone ID: LIB148-059-Q1-E1-H7
cccacgcgtccgcccacgcgtccgcccacgcgtccggttgtgctccacgatgacgacactgcctggggtgactacgccagagcaactcttagatgcatccctgcggattacagcggtgaaggcagcgatggcggagatgaagctagacaatgcaataaaatcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcggggacaccttcgacgagcgaacagacctcaactcacccatacccggtgcacagcgccacgtcanaccgctcat

SEQ ID NO: 7790 - DNA, 405 bp, Zea mays
  unsure at all n locations
  Clone ID: LIB148-059-Q1-E1-H8
cgcgcccataccgcacccgagtcgctaggacgcggcacgcacccttctcgcgggcgcgggcgctggcgcggggcgcgggagcaggcatggcgtcgcaggtcgctgggtcaaccccggcggtggcggcgcttgggttccttctcccgaccttctgggagatcgaggtcacgtgcgccgccgcgatgatcctcgtggcgctttacgttgcctacgagctcctcaacccgcgctcctcgcaggcggcagcggcgggcgacgccgacgagctcctcgtgcgggggctggacggcgccgacaagttcaaggggggtgtgagccgcccctctgcctatgtantgaagctcgaattgttggctgcacaaaatttgatggcggcgaacttaaatgggacatctgacccatatg

SEQ ID NO: 7791 - DNA, 405 bp, Zea mays
  Clone ID: LIB148-059-Q1-E1-H9
ccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcagcaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttccc

SEQ ID NO: 7792 - DNA, 416 bp, Zea mays
  unsure at all n locations
  Clone ID: LIB148-060-Q1-E1-A10
aaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcgccggcactgggaagcagacaatcctcatacccaagggcgacttccttgtcggacaactcaactttacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcaaggcc

SEQ ID NO: 7793 - DNA, 440 bp, Zea mays
  Clone ID: LIB148-060-Q1-E1-A11
cgtccgaagaagcaggatcgagccgaatcctccggaactcgccgccggggccaaccgacctcacactattgatcgaggatgtcgtacgcctacctcttcaagtacatcatcatcggcgacacaggcgtggggaagtcatgcctgctgctgcagttcacggataagcgcttccagcccgtgcacgatctcaccatcggcgttgaatttggcgcccgcatgatcaccatcgacaacaagcccatcaaactccagatttgggacacggctggccaagaatcattcagatctattactaggtcatactacagaggagctgctggagcccttttggtttatgatatcactaggagggagaccttcaatcatctcgcaagttggctagaagatgccaggcaacatgcaaatgctaacatgacagtgatgccgattgggaacaaatg

SEQ ID NO: 7794 - DNA, 410 bp, Zea mays
  Clone ID: LIB148-060-Q1-E1-A12
agattgagttcgctcaacatggtagtctctcacagcaccttcacgtcaaagagtttgagcatctggactgggctgcgaggatgagggtcatcatgggcgtcgcatactgccttcaatacatgcaccatgagctcagtccacctatggcgatccacgacgtgcggtctgacacaaccttcatttcagatgattatgctgccaagattgcagatgttggtgtatggaacgagcttgctgccaaagcgaaggctggaaaggaggacggcagcagccgtgctgaagctcctccggatctcccaagcaacgcctactgcttcggcgcgctcatgatcgagaccatatccgggagggttcctgacccgtatgatcacaaacccatatgcagctgggcttctgagcatctgaaagac

SEQ ID NO: 7795 - DNA, 401 bp, Zea mays
  unsure at all n locations
  Clone ID: LIB148-060-Q1-E1-A2
agccatcgcgcaccgctccccgtgtcccctccttctcgcccggcaacgtcgaactcggctgtggnaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgatttcgacttcaccaccgacgagaactgccagaagagcaagatcttgttcatctcctggtccccggacacctcgagggtcangagcaagatgctgtacgcgagc

SEQ ID NO: 7796 - DNA, 414 bp, Zea mays
  unsure at all n locations
  Clone ID: LIB148-060-Q1-E1-A3
gggtcgagcacgcgtccgaccacacgtccgacagcaattccacgacccagcaagaagtgaaggcgctcctctctcagatgtcatctgtgcggggcctcgatggttcttccagtgaaggatctcctagccccggtaccagcgctccgaacgaagagagcaaccctgcggcagcgagcaagaggccgtatctcgagaggaactactccgtgctggaaccttcagaagggagccagctcgccgacgacgtggaaggggaaagctctctcgagaacgtgaagaaacagctcgagctcaacaagaaggcaatggccgctctttacaaggagcttgaggaagaacggagcgcttcggcggtcgcggctagccagacgatggccatgatcaataggctgcangangagaaggctgcaatgc

SEQ ID NO: 7797 - DNA, 414 bp, Zea mays
  unsure at all n locations
  Clone ID: LIB148-060-Q1-E1-A4
gatggagctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacataacggacatgaactatgagcctatcgcggcgtaccacttcgatttagcaagcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctgncactgttggtcaagtacgtcgacggcgacggtgacattgtggcagtggacg

SEQ ID NO: 7798 - DNA, 110 bp, Zea mays
  Clone ID: LIB148-060-Q1-E1-A5
tgagtcgtattaaactagttgttcgtcatgttcctcgacttttttgttaagtatcatatgtgatattgactctatagttcatggagttaaggatgtcataatgggggggg

SEQ ID NO: 7799 - DNA, 319 bp, Zea mays
  Clone ID: LIB148-059-Q1-E1-H11
ctctaactcagttggttaggtggtctgagtagcactcctcgggtcctgggttcgacttcccgtgggagcgaattttagactgtggttaaaaaattcccctcgtctgtcccacgccaaagcacaggtctaaggcttagccccggtcgtggtcgttctcacatgggcttcaatgccgctgtcgtacccccccccccccccagtacctgcacgtcaggtttttttttcagcaaattccatctgataaggtaagaaatttataatgtaattcctattaatctggcattttctaagctcattgtcttttttccacatataccgt

SEQ ID NO: 7800 - DNA, 386 bp, Zea mays
  Clone ID: LIB148-059-Q1-E1-F7
gaatccgtacgtcgaggtgcaggtcgtaggtaggatggacgcggaccagcagggcgtggttgcggcggcggtgaagccggcgctggccaaggggacgccgtcggcgtcgttccggctccgcaacgggagcctgaacgcggtgcgcctccgccgcgtgttcgacctgttcgaccgcaacggggacggcgagatcaccgtggacgagctggcgcaggcgctggatgcgctgggcctggacgccgaccgcgccgggctgtccgccaccgtcggcgcctacgtgcccgacggcgccgcgggcctccgcttcgaggacttcgacaagctccaccgcgcgctcggggacgccttcttcggcgcactgggaggccaggacgacgccaccgccg

SEQ ID NO: 7801 - DNA, 374 bp, Zea mays
  Clone ID: LIB148-059-Q1-E1-F8
cgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgccc

SEQ ID NO: 7802 - DNA, 402 bp, Zea mays
  Clone ID: LIB148-059-Q1-E1-F9
agatgcatgtggacacgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgaccccctactacgttcggtaacgtcgtc

SEQ ID NO: 7803 - DNA, 407 bp, Zea mays
  unsure at all n locations
  Clone ID: LIB148-059-Q1-E1-G10
cccacgcgtccggagttaaccacacaacngccttcgcctgtctccgcgctcttcctcggacaaagccggggccgttcggcgggaggcaggggacgcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccacctccacaccgcggaggacgacggcgacgaggaggaggaggacctcgaggaggcccgccgctccttctcccgcccgatccctgagtactactacgaccggtccggctcctccgcctccgtcgccaagatgtgacctgaccggaccgcgcctcccctccgcccaagaaatgcg

SEQ ID NO: 7804 - DNA, 404 bp, Zea mays
  Clone ID: LIB148-059-Q1-E1-G11
tacacacacgtctgggacgatgcagagggggaggagggggtgtccgtggtgatcggcacggacgctgggtggctactgttctactcgctcgcaggcgatctattgcacaagcagagtatatatcctgcaaagatactgaaactcaactttcgtgagaggaaggagaacgcttgggaagattcaggctcagatgaactttctgtagtgtttcctggtgttatcgcgcgctttgatggtgctgaccttcaggctttctgtgcatgttcaaggataagaactgaattcttggttgctcacagaacgttcttaaaaaagcatttcaagatgtaaaatcacgcctgtggaaagataagtttgaagagcaagatgctgaggatgaggaaacttttggacgaatacccttt

SEQ ID NO: 7805 - DNA, 356 bp, Zea mays
  Clone ID: LIB148-059-Q1-E1-G2
agccaacgcagacccagcgatcctcgtcgcgcgtcctcctcccccacggagggaaggatggcggagcccaaagcggcggcggcggcgaggaagacgcgggtgggcccgtacgaggtcggcaagaccatcggcgagggcagcttcgccaaggtcaagcacgcgcgcgactcccgcaccggcgccgtccgcgccatcaaggtgctcgaccgcaaccacgtcctccgccacaggatggtcgagcagatcaagcgggagatttcgactatgaagctgatcaaacatcccaatgtggtacagctgcatgaggttatggcgagcaaaacgaagatatacatggttcttgaatttgttgatgg

SEQ ID NO: 7806 - DNA, 410 bp, Zea mays
  Clone ID: LIB148-059-Q1-E1-G3
aagagagtagtactggacagaagcaacctcctgttcttgtcatagtgttgcagtttataactgcaatggttgttatggacacatggcagtacttcatgcacagatacatgcacattaacaagtttctgtataaacacatccattctaagcaccatactcttgtagtcccttattcctttggagctctatacaaccatcctcttgagggccttattttggacaccattggtggtgcactctcattcctcgtctctggtatgactccacggacatccatattctttttctcctttgcaaccatcaaaactgtggatgatcattgtgggctgtggcttcctggtaatatcctccaggcgctgttcagcaataacagtgcttatcatgaacatcacaatcagctctatggaaac

SEQ ID NO: 7807 - DNA, 435 bp, Zea mays
  Clone ID: LIB148-059-Q1-E1-G4
gggccgagcacgcgtccagtgcaccaggccatcaagtggggcaccgactacctgctgaaatgcgccgccaggaagaacaagctgtgggtgcaggtcggcgatcccaacctggaccaccagtgctgggtgcgtccggagaacatgaaggcgccgcgcacgctgtacgagatcgactcgaagacgcccgggacggagatcgccgccgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacaaggcggcaggtgtacgcggacttc

SEQ ID NO: 7808 - DNA, 397 bp, Zea mays
  Clone ID: LIB148-059-Q1-E1-G5
caagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaacacgacga

SEQ ID NO: 7809 - DNA, 198 bp, Zea mays
  Clone ID: LIB148-059-Q1-E1-G6
caaacctcaacagtgagtcgtactaccccgccgggcaccacctcagccaccgcaggaacgatatcagacatcgacgccgacgcagctgcgacgaagaccctgatgggcacgtacgatgtcaggacgaccatccgacagggcaggttccccaaggtgaaacacgcgcccgactctcacatccggctcatccgcaccatc

SEQ ID NO: 7810 - DNA, 235 bp, Zea mays
  Clone ID: LIB148-059-Q1-E1-G7
ctcgcgggtcgacacaagcctcaacactcagtcctactacccccgccgggcagcacctcagccgccgcaaccgcgagactatccatgggcgcctacgcaaccaatcgcaagactcttgatgggcatgaccgacttgacgccgtcgtctccacacacaaagttgcgcccgacgccattccagtctcagttgaagttgcggctgatgaaaaggtacatcataacgtggtgctggatg

SEQ ID NO: 7811 - DNA, 407 bp, Zea mays
  Clone ID: LIB148-059-Q1-E1-G8
cgggagcacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgacgaagagacgaaggggagagagagtgacatggctgctcgcattccgatgcgttggccaggtttttggatccgacacaccttttgtc

SEQ ID NO: 7812 - DNA, 381 bp, Zea mays
  Clone ID: LIB148-059-Q1-E1-G9
cccacgcgtccgcggacgcgtggggccggcgcgatctgcgggccggcgagcctggtgaacgcgatgatggacctgcaggagggggcgctgatgctgctgggccccacgatgaacgccaaggtggcgttcgagctgtcggagcggctgccgcacctgccgctgcggatgcaggagcactcgcgccgcgcgctggcgttcgccgagcggatgcaggggctgggcctgcgcgtgctgtacccgggcctcccgggccacccgcaccacgcgcgcctggccgccatgggcaacccgggctacggctgcggcggcatgctgtgcctcgacatgggcaccgaggagcgcgccaaccgcctcatgcaccacctccagaacaccacccag

SEQ ID NO: 7813 - DNA, 355 bp, Zea mays
  Clone ID: LIB148-059-Q1-E1-F6
cccacgcgtccgcccagcgctagcgctccgcgcggcctgcgctccccacgccgcagctaggtgccccggccaacgccccctcccaacggcaagccggtgcccctccgcggcgtgcagccatggctgccagcccgcagccgccgcggttcgttaccctgctcgaccggccctagcccttgcgcgcggtcggcctgccagcgcggcggcgcgaccagctagcactatcgtcgtcatgctcgtgtcctcgtcgctcgttcggtgcgtcgtgcacgcaacatgtcgtcgtacctcgcctcgtctcgccgtcgtcgcgaggtacttgatatatgttgggaatgaggggagtagcagcacg

SEQ ID NO: 7814 - DNA, 406 bp, Zea mays
  unsure at all n locations
  Clone ID: LIB148-059-Q1-E1-H10
ggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacgcanatgtgtgtntttcatcgattgaatgggtaataataaaaaggcatgctggcagttacta

SEQ ID NO: 7815 - DNA, 132 bp, Zea mays
  Clone ID: LIB148-033-Q1-E1-C10
tcgtccgggtgcattgattccatggtccaccatggcgcatccagatgtggccactatgacgactaataagcgactcctcctcatctcgctggcgtctgcgggcattcggacggcgcaggcctatgcgatcgc

SEQ ID NO: 7816 - DNA, 412 bp, Zea mays
  Clone ID: LIB148-033-Q1-E1-C11
cggtctggggccgaccgacgcgtccacccacgcgtccgaaccatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacg

SEQ ID NO: 7817 - DNA, 422 bp, Zea mays
  Clone ID: LIB148-033-Q1-E1-C12
attcagggccgacccacgcgtccacccacgcgtccgcgctgacgtcccgcggctcgcagcagtaccgcgcgctgacggtgccggagctgacgcagcagatgtgggatgccaagaacatgatgtgcgcggcggacccgcgccacgggcggtacctgacagcgtccgccatgttccggggcaagatgagcaccaaggaggtggacgagcagatgatcaacgtgcagaacaagaactcctcctacttcgtggagtggatccccaacaacgtcaagtccagcgtgtgcgacatcccgcccgtcgggctgcccatggcctccaccttcgtgggcaactccacctccatccaggagatgttccgccgcgtgagcgagcagttcacggccattgttccggcgcaatgctttcttgcactgatacaccag

SEQ ID NO: 7818 - DNA, 439 bp, Zea mays
  Clone ID: LIB148-033-Q1-E1-C2
cttcgcgccgctgacgtcccgtggctcccagcagtaccgagcactcaccgtccccgagctcacgcagcagatgtgggacgccaagaacatgatgtgcgccgctgaccctcgccacgggcgttacctcaccgcctcggccatgttccgcgggaagatgagcaccaaggaggtcgacgagcagatgatcaacgtgcagaacaagaactcgtcctacttcgtggagtggatccccaacaacgtgaagtccagcgtgtgtgacatcccgccgaggggcctgtccatggcgtccaccttcgtcggcaactcaacttccatccaggagatgttccggagggtgagcgagcagttcactgccatgttcaggaggaaggctttcttgcactggtacacgggcgagggcatggacgagatggagttcaccgaagccgagagcaatatg

SEQ ID NO: 7819 - DNA, 401 bp, Zea mays
  Clone ID: LIB148-033-Q1-E1-C3
accaaggaagaaaacatttcatccccccgggttaaggccgatggttaaccgctgttccccaacaaaagggttgccgttgggaatttccttattcaactggggcccaacaataacaacaaacccgaaggtccggttaccaaaggaaaacgggcggccggggtctggaaaacacgacgaggggcgcgctactcgcagcaccgcgtgcgcaggttctggctctccagacgccccgactacattcaggccatggacaaggtgcccacggaccctaataagtagacgacgaccatataccccaatgcatggcaagaagatatatatatcagcacaacgcaactgcatgcgatgctgcatgttgctgcaattaatccactatactatatactataagagtattatta

SEQ ID NO: 7820 - DNA, 436 bp, Zea mays
  unsure at all n locations
  Clone ID: LIB148-033-Q1-E1-C4
atccccccacatgcgctgcccccgcccggccctgccctgccctgccctgctgcgcccaacctgaatctccgcacagacaattaaattagctgcattggcggggaaagcgcaagaagctcagcagaaatggcggagcaggcaggcgccggaaggtactggtgccacatgtgcgccgcggtcgtgagccccgcggagggcgaggcggangtgaagtgcccgcattgccacagcggcttccttgaggagatggagaccgtccgcggcacgcccgcggccgatgacggcgacggtgacggcgcggtggctcaagtgtaccccggcgccgaccgcccgagctccatctgggcgcacgctatcctcagcacggtcgacagctccgtccgccgccgccgcaaccggcggcagacggaggccgccggcgacgtctacgacggga

SEQ ID NO: 7821 - DNA, 91 bp, Zea mays
  Clone ID: LIB148-033-Q1-E1-C5
aatctgacatcattgccatcaccacagcgatgaccactgtctcgagtggatctatgccccgaatctttgccgcgcaccacgccatctgtga

SEQ ID NO: 7822 - DNA, 391 bp, Zea mays
  unsure at all n locations
  Clone ID: LIB148-033-Q1-E1-C6
gcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaagaaacaggacgggctggtgaagctgcangggtccaagcaagggaggaaggggcagctcgcgatcgacgccgagatcttcgaggtgacaccggcctttcacg

SEQ ID NO: 7823 - DNA, 198 bp, Zea mays
  Clone ID: LIB148-033-Q1-E1-C8
ctatcaccaccccgagatcgtccccgagaagatcatacacgaggacgcgttgccggtcgttgctgcggagaaggagactgccgccgccgccgcaacctcgaaggaggaggaggaggtggagtcgcccacgagaggagcagctctgtctccggtgcctgatgctagcctcgtctcctcagccgcgatctcgactgatga

SEQ ID NO: 7824 - DNA, 395 bp, Zea mays
  Clone ID: LIB148-033-Q1-E1-C9
acccacgcgtccgcccacgcgtccgagggaccccgagacccccgtgaagctcgctgaatacttcaacgtcaccgacggggtgttcagctacaaccagatgggcgacgtgccccccgccgtgaacggtcccctccatgtcatccccaatgtcatcaccgccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgccggcatgtggagcgtgc

SEQ ID NO: 7825 - DNA, 425 bp, Zea mays
  unsure at all n locations
  Clone ID: LIB148-033-Q1-E1-D1
ggaaaaggagcgaagagagagagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaggggtcgacgttccacaggatcatcncggggttcatgattcagggaggcgac

SEQ ID NO: 7826 - DNA, 255 bp, Zea mays
  Clone ID: LIB148-033-Q1-E1-D10
ggaggattctgcaggacgactgatgcatgcagcatgcactagctgcccctgttcgatcgccaagatcacaccacgacgaagatactgtacctagtagtacgtacgtacgtgtacacctgattatccgaagaagatggccagccgattattaaccattggctatcttcgatcggggccaatttcagaaggaatttcctttactttctgtagcaaatgatcgggttcctgcacagttcatcaggaattccattgtat

SEQ ID NO: 7827 - DNA, 397 bp, Zea mays
  Clone ID: LIB148-033-Q1-E1-D11
acaagcgtcaaacttgccaagcagctagcaaccaacccaagaaagctagacaccatacccatggctcgcgctagcgtcgtcttcgtcattgctactctcctcttcgtcgccatggttgtggcaccgatggccgaggcaaagtccgctgatgccccctccgccgacgcccccgcccccgctgctgacgcacctgccgatggacctagcggaccggcgggtgcacctggtccccagggcgtcgagggtctatcgggcaatgaggacgacgatgatgactccaccaactaaggccaagcacgtcggtccggttgcatttggaacaagacatggaagaaaagtgagagcaatgtcgtttaaaaccaaaagtccataataatgtgtggtcattcgtgatatg

SEQ ID NO: 7828 - DNA, 408 bp, Zea mays
  Clone ID: LIB148-033-Q1-E1-D12
agccgccgtgctggcgctcgccgtcgcgtggcgccccgtgctgtgggtggccgtgctcgccgacgtcggcacgtgcctgctcgtcgtcctccacagcatgctgctgctcagggacggcgccgcccgccgcccgaggtgctgcgctagcgctacggcgtgcaagagcaagcaggcgtccaagccgtgctgcgcgacggtgaagccggtggcgacgacgaggcacaggcacgggcacgggcacgggcacgggcacgcaggcgcggggaagcccgggacgctaggaggcgacaagcagggtaaggactgccatggttgctgccagaaggagagcaagccgcccgaggacgccgtcgtgatcgccattccggggaacgggccctggaccaccgggaaggaggcccttccctc

SEQ ID NO: 7829 - DNA, 434 bp, Zea mays
  Clone ID: LIB148-033-Q1-E1-D2
accacgcgtccgcgaataacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaacacttcgacttgag

SEQ ID NO: 7830 - DNA, 434 bp, Zea mays
  Clone ID: LIB148-033-Q1-E1-D3
atccccgcgccgatggatctccgcctcgcccactaggcctccggcgcgaccgggggtgggcacggggatggggctcctcgggcggaggacgttgctgccgctcctcgccctcgcttccgcggccgtcgccgtcgccgtcaccgtggaagcctacgaaggcgacgctgatccgctctacagagcttgtgtggaaggatgccaaaagacaggctccctgaaggagacttctattaaacattgtatggtgccaaccgatggccaacctgttgacaagtcatggtacacgcatgagccactgtacttgcaatggaaggactggaactgcaagagtgaatgcagataccactgtatgatggaaagggagaatgaaagggcacagcttggcctccagcctgttaagtatcatggaaaatggcctttgaagcgtgcctctg

SEQ ID NO: 7831 - DNA, 435 bp, Zea mays
  Clone ID: LIB148-033-Q1-E1-C1
cccacgcatccgggtgaagggcagcttcgggtacctcgacccggagtacttcaggcggcagcagctcacggagaagtccgacgtctactcgtacggcgtggtgctcttcgaggtgctctgcgcacggccggcgctgaacccgagcctgccgagggagcaggtcagcctcgccgaccatgcactgagctgccagaggaaggggacgctggaggacataatcgacccggtgctgaagggcaagatagcgccggactgcctgaagaagtacgccgagacggcggagaagtgcctgtgtgaccatggagtggaccggccgtccatgggcgacgtgctgtggaacctcgagttcgcgttgcagatgcaggacaccttcgagaacggcgggaagccggacggtggaagaggcagctcgagcgacagtggcaccgtgtctat

SEQ ID NO: 7832 - DNA, 395 bp, Zea mays
  unsure at all n locations
  Clone ID: LIB148-033-Q1-E1-A2
agggcccgacctgttccagcccgacaactggcgccgcttcgccgcgttcgtcaagcgcatgacngagccggggcgcgcgggaggcgtgccgggagcaagtggagccggaggcccgaggcgtcgcgcacgccaaccagcccctcgtgcacgaggccgccgtcgcgctcaccaactgaccggaccggccggcgttccccgtcgactgtgttcgatcgctagacggggtggcacgctgcgacgactacctgtatggcgagtccctatacttactcatacataagctgcgccgccgtgtcgtcggtgcgtgcaccgcgcagtagtgtgcgtacagcggaagctgcgactgcgagcgaggtanggtgttggggtggtgactgggtaccaggagtggggta

SEQ ID NO: 7833 - DNA, 250 bp, Zea mays
  Clone ID: LIB148-033-Q1-E1-A3
gtccagggttcaagggacccttcggacaaccatccggcaaaaccccaagggccgggggaactcccctgggctcaatcggctcctcctccaagaatggctcaacaacgggtgccaagcctccaatcccctggaagaatccgccgccggggaagttccaaaaaaaggattctccggcaacgggttcaacctggtccgggtcaaaaacaaccaaatccgcaaattcaacgttaaaggcaagttcccccggaaa

SEQ ID NO: 7834 - DNA, 214 bp, Zea mays
  Clone ID: LIB148-033-Q1-E1-A4
ttttacctgaagttaaaccatgggaacatgaaactgacatgggcaaactccaagaaactgttaagaatgtccaaattgaaaggctgctccggggcgcaaccaaacctggcccaatttggtaagggaaccagaaactggaaatccagaagaacaacctccaacaacctggccccggccaaaatcccaattaagaataaccgttcgcctaaccaat

SEQ ID NO: 7835 - DNA, 434 bp, Zea mays
  Clone ID: LIB148-033-Q1-E1-A5
cagcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaagcggaggagctcgggctgagcggcggcggcctcggctccgacgacgcggtgcggcggacgctggcgcagcgggaagccgacaaacggtacatcagctacgcggcgctgcgcgcgggacaggtgccgtgcaac

SEQ ID NO: 7836 - DNA, 415 bp, Zea mays
  Clone ID: LIB148-033-Q1-E1-A6
gtttcaaagcaccatggggagatgtatgtccgctcgcatgggcatcccgtcaggagctttactctgggcttggttgatggtcgaggagagtctccagagcacaccgaacacgttcgcgacctcacatggcggtattgaggacttgtggagcatggggattgctcgccgacgtcgtgtagtctggggcattccgccgtgcgccgtggtcagggcaccagtgcgcataatccaagcagtgaggacacgtgtcatctgaagatcatcctggtacctagaatctcaagtcccaggtcagaacaagttacggcaggatgatcctcatggaaaatgctgcaataatttcttaattggcctaggtcttcgtctcccagtcaactttgggttgctggaccgttgtctccttataaggtaatta

SEQ ID NO: 7837 - DNA, 413 bp, Zea mays
  Clone ID: LIB148-033-Q1-E1-A8
agaagaggtacctaactctaccctactatagagaaaaagtcagcacattgcaagaaataataatggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgagggaggcgtacaggcccgacccgtacaacgtcaccaacagcttcaacgccgccgtccacagagctgtcagcagcagtcggcgtgagatgcgggagaggccgaggaagcacaagaagaggggcccatgccgggcgacgaaccctatcgacaagtgctggcgctgccgcagggactgggcgacggaccggcagcgcctg

SEQ ID NO: 7838 - DNA, 405 bp, Zea mays
  Clone ID: LIB148-033-Q1-E1-A9
aaccaagccttcgggccttccaaaaggttaaccccggggttaatgttcaagggaggcaacttcacaaccggaaacggaacggggggcgagtcaatctacagcaggcacatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaaggtggtgaaagggatggacgtcgtgcgcaagatcgaagccgagggccagctcaccggcgtgcccaaggccaaggtcgtcatagccaacagcggccagctgccaacgcccgccgccgccggccatcgttacctctga

SEQ ID NO: 7839 - DNA, 432 bp, Zea mays
  Clone ID: LIB148-033-Q1-E1-B1
ggtcaagggttcagggcccgtccgaccacgcatccggctgacgacaccaccgtgtggtcgacaaaataaaaaggagagagagagagatggctctgtcgtctcgccgtatggccgccgcaccattcttcgtcgtcgtccttctcgtcctcgtggcggcagagaggacgatgggcagggtggtggtggaagagacgctctgcttgtcgcagagccatgccttcaaaggcgtgtgcctcagcaacaccaactgcgacaacgtatgcaagacggagaagttcacaggcggcgagtgcaagatggacggcgtcatgcgcaagtgctactgcaagaaggtctgctagggcatgaccggcagcaagccccagccgtacggctggttgatccggttgcacaccgtttgggcacgcggtcatgttccggcttctcggcttt

SEQ ID NO: 7840 - DNA, 368 bp, Zea mays
  Clone ID: LIB148-033-Q1-E1-B10
acggacgagtgggtcctgaactacactctttcctttcagtaccattctttgctgcagatactgaactgtgttgcaggattgcgtgaatatttttcccaaacagatgaaatccatataatcccaagaattcatgtaatggaaaccatgtttgatgtggattcaaagccaaaatttcataagcttcaagaagttgaaaccaaggaaaataaaaacatgggaatcattgatgaagaatcagatgatgatgatgattatcaagttcctgaagctaatatagagaccttgaccaaaaccaatatacaggaagacccaaacacatctgacaatgataacaagcacacagatgagcctccagaaaaaattgattt

SEQ ID NO: 7841 - DNA, 400 bp, Zea mays
  unsure at all n locations
  Clone ID: LIB148-033-Q1-E1-B12
agcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgngcagtgcaacatggtggtggaaaggct

SEQ ID NO: 7842 - DNA, 200 bp, Zea mays
  Clone ID: LIB148-033-Q1-E1-B4
cctccctccctcaaacaaattattaggaaaagtcccgcccttttcctccgacatccacaaagggggaagggaaaacaccttcattcaacccgccggaataattggctccgtttccggtcccggcaacaacaacggcggccttcacccaagcccaatccttcttctcccctgttgccccggttaacaacccaaacttcccc

SEQ ID NO: 7843 - DNA, 416 bp, Zea mays
  Clone ID: LIB148-033-Q1-E1-B5
agatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaagctgctgtctcccgcgttagtgcactggaagaggagcttgcagctacaaagaagaccttgcaggagactc

SEQ ID NO: 7844 - DNA, 424 bp, Zea mays
  Clone ID: LIB148-033-Q1-E1-B6
atcagccaagagctacgcaaacgcacagcgatgcaccagcacgagataccagccaccatgcgcctgtccctcctcctcgtcatcgtggccgccctctcggcgcgcgccgcggcgcagctgccgccggcgggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcctcaaccaatttcaaaagtccgggcaagacgccggaattaaacaattccttcccggggaagcctttcaagccgttggtccccgcaaacctggccctgaagctggagtgccccggggtggtgt

SEQ ID NO: 7845 - DNA, 409 bp, Zea mays
  Clone ID: LIB148-033-Q1-E1-B7
gtctccctcaacatatacggtcgcgcccttttccgacattcagaggggggacaggaaatcagcggctatggcctcgactccggcgacgaccttcgccgtgatcgcacccgtcctcttctgtgccgcggctggcaccgccgtcgacaaggactctccccgactacgtcgtccagggccgcgtcgattgcgacacctggtgcgccgggttcgtgaccaatgtcaccgagtacagcgcgggcgccaaggtgaggctggagtgcaagcagttcggcaccggcaatgctcaagcgctcgagcgactgggtgaccgacgggaacggcgtgtacaccatgaagctcaaagacagccacgaggaggaggtatgcgaggtggtcctggtggagagcccgcgcaaggactgcgactagg

SEQ ID NO: 7846 - DNA, 401 bp, Zea mays
  Clone ID: LIB148-033-Q1-E1-B8
accacgcgtccggcaagcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaacggctcgatcgtgtgtcaggctactactgttcttgccataattatatatagatacg

SEQ ID NO: 7847 - DNA, 386 bp, Zea mays
  Clone ID: LIB148-033-Q1-E1-B9
ggacccgtccactttgcagcagccattactatgtacagagcgcagagggccgtcacctggtccgctcgccgttgtgtccattcggggcaaacacacagacctcgggagcctgccgcagctccagcgatcggaccggaaaaatggtgggagaacagagaaattccaccgccatggtccggcgccgcgcctcctctggtgcactggtaccgctgccatgtgccattcagtgcgttggtgggatcctgtcatcgtggtgggaatccaacggccctgggtaattcgggtgtgctcccacatttggcctcggtgatcagctacaggattccgctcacatccccagtgcaaatcatgtgctcattccgggtggattgattcccgggggaccc

SEQ ID NO: 7848 - DNA, 354 bp, Zea mays
  Clone ID: LIB148-033-Q1-E1-A12
acacgcctctacagtgagtcctgttaacccaaccccaccaccaccagtccccgcggcccgcgtcgaggaagaagaagggataggagacggggacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgcggccggccggggccgtggccgcggccgtggcgtccgatgccgccacggcctccgcgccgggggccagcgggaggaaggggaacgcctcgtcgtcgtcgt

SEQ ID NO: 7849 - DNA, 394 bp, Zea mays
  Clone ID: LIB148-032-Q1-E1-G8
cgagtacttcaacgccagcgacggcgtgttcaagtacaacctcatcggggacgtgccgccctccaacacggcccccaccaagatggcacccaacgtcatcagcgccgagttccgcacgttcattgaggtggtcttcgagaaccccgagaagagcatcgacaccatccacatcgacggctacgccttcttcgccgtcggcatggggcccggcaaatggacgccagcgtcgcggagtacgtacaacctcctggacacggtgagccggcacacgattcaggtgtacccaaggtcgtggacggcggtgatgatgacgttcgacaacgcgggcatgtggagcgtccgctccaacatctgggagatgcagttactcggcgaacagctgtacgtaagcgtc

SEQ ID NO: 7850 - DNA, 391 bp, Zea mays
  Clone ID: LIB148-032-Q1-E1-G9
cgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggatctcgggctgagcggcggccgcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgccaacccctaccgccgcagctgctccgccatcacgcgctgcgcccgcaacat

SEQ ID NO: 7851 - DNA, 446 bp, Zea mays
  unsure at all n locations
  Clone ID: LIB148-032-Q1-E1-H1
gtagcgtctaaattcagggtcgaccacgcgtcaagctgagaagagctacgagctgcctgacggacaggtcatcaccattggtgctgagcgcttcggctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctgncattgctgacaggatgagcagggaaatcaccgccctggctcctagcagcatgaagatcaaggtggttgctcctccagaaaggaagtacagtgtctggattggaggatccatcctggcatcgctcagcaccttccagcatatgtggattgccaaggctgagtacgacgagtctggcccgtccatcgtgcacagga

SEQ ID NO: 7852 - DNA, 399 bp, Zea mays
  unsure at all n locations
  Clone ID: LIB148-032-Q1-E1-H10
agggaaataacatgccgcggcacacgtcgccgttactttttgccttgttggcgaccctgctcagcgtcggcgacgcgttggtcgtcgacggcctgcaggtggggttctatggaaagacgtgcccggcggccgaaggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtanagggcatgtgccccggcaaagtctcgtgcgcagacatcctgggct

SEQ ID NO: 7853 - DNA, 394 bp, Zea mays
  unsure at all n locations
  Clone ID: LIB148-032-Q1-E1-H11
ggagagccaggtagtattaccttgtttgaagtcactgcagatacagtggtgtcctaaactgaaagctctaccagaaggcctgaagcatgtagcgctgtgtgaacttcatgtggagggtgcacatagcctaactgaaatcaaggacctgccaaaactatctgacgagctccatctcaaagataataaggtgctacagaggatctccaacctgcccatgcttcgttccctcattatcgatgactgctcaaagttgaagcatgtggcaggtcttgatgcgctgcagcacctcagacttgtctttcctccgtccaccgagacattttatttcgaagagctagtaattttctggagcgttgccttcncacggtggctggagctactgattcagaagtgc

SEQ ID NO: 7854 - DNA, 401 bp, Zea mays
  Clone ID: LIB148-032-Q1-E1-H12
cgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccacca

SEQ ID NO: 7855 - DNA, 441 bp, Zea mays
  Clone ID: LIB148-032-Q1-E1-H2
ggtcatggaatcccgggtcgatccaggcatcaattcgactaacacagttgaccccaacaatggaatccctcgctaataacatcatggtcttggttgtctcccttgcaccgctcgtcgccggcgggtcatgcgggcccccgaaggtgccgcccggtcacaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccct

SEQ ID NO: 7856 - DNA, 415 bp, Zea mays
  unsure at all n locations
  Clone ID: LIB148-032-Q1-E1-H3
agaaaaaggagacgaccgcgccggcgccgaccattaatttctcgccttctatccgcgatcacctctcctcgctgccgcggcatcttcttctgggtcctggcccgtcctcgtcgcaccattccatggccgattcagccgcgctctccacctccctcccccgctctctggcgtccaggaggcccctctcgtcgcctctccacgccagaacccgggcccgctcgcagcgccgctgccggctcggatcgcgctcgctccaccggttgcgtgctcgggcgggaaaggacgacccggaagacctctacgggccctacccctgggnacagcccttggatctcagcgctgggttcgacattcaatgggtgcctgaagacagagtcacgctattcacttctgatgggctgatccagattggggg

SEQ ID NO: 7857 - DNA, 412 bp, Zea mays
  unsure at all n locations
  Clone ID: LIB148-032-Q1-E1-H4
ccaggcatccgagtctgctgccagtggagagctccccgctcgtgcaggtcagcctgcctcaaccccggccgttgcggctgccccatcgtcgtcgtcgtctaggaagtctggtccagctgccgcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccangggacgtgtcgtcgagggtgggcacgttattggctgtgcgggtaatgctcgtctggtcgggagggacca

SEQ ID NO: 7858 - DNA, 245 bp, Zea mays
  Clone ID: LIB148-032-Q1-E1-H5
agccgacgcgtccggttcagtgcagagggagacatcctcgccgccatctgaacttgccgcggccgtctctacaggcgcaacatgccagccgcatctagtgatgctgatgaagttgattctgtgaggcgtctccgacgacaccacctgcatcatgtcgccggacgccgacgcgatcgtgacgtcctccactataggctcgctcaccgtcgtcttgtaatgcatcatggacgtcgtgcacttgttca

SEQ ID NO: 7859 - DNA, 365 bp, Zea mays
  Clone ID: LIB148-032-Q1-E1-H6
ctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctgcc

SEQ ID NO: 7860 - DNA, 411 bp, Zea mays
  Clone ID: LIB148-032-Q1-E1-H7
agcggacgcgtggggtgaactgacaagggccccaagcaagctgtcgtctgcattttctggtacccaggataagtgcgcagcatgccagaaaacagtgtacccgctggagaagttaactctggaaggcgagtcctaccagaagagctgcttcaagtgctcgcacggcggctgcatcctgaccacctcctcttatgccgcgctcaacggcgtcttgtactgcaagatccacttcgcgcagctgttcatggagaaggggagctagaaccacatgaacaagaagagcccgtctcaggaggttctgccggacgtggctgaccaggagcaaccgccggaaccagcgccaccgcaagatgagaaagaacaggacaactaggatcggagcgaccaacaaccacccatgcatatatatca

SEQ ID NO: 7861 - DNA, 360 bp, Zea mays
  Clone ID: LIB148-032-Q1-E1-H9
caagaggacttgagaccatatttcagtgaaagtgagtactacacatcaccacaggttttccattagcctctctgtctgcctcgtaaagttactcaaccggctgtacatgttgcaaagatcaccttgtagatgctctacacatgttgtcaaataggaaacaaaaaaaaattaatatattatcataccattagagtattagaattgtttcctagaaagaaaatagtatatcagtatagttcattcgttccaacaacttttagtttcgggaaagaaacaatcaaattcattgtttataagtgcaaataataggagtttccttagttcaacacattttctttggaatgaatatacacctcccat

SEQ ID NO: 7862 - DNA, 442 bp, Zea mays
  Clone ID: LIB148-033-Q1-E1-A1
cccacgcgtccgctgggccaagggccactacaccgagggcgccgagctcatcgactccgtcctcgacgtcgtgcgcaaggaggccgagaactgcgactgcctccaagggttccaagtatgccactccctgggtggcggcactggttctggcatgggcacgctgctcatctccaagatccgggaggagtacccagaccgcatgatgctgaccttctccgtgttcccgtcgcccaaggtgtccgacaccgtcgtggagccctacaacgcgacgctgtccgtgcaccagctggtggagaacgccgacgagtgcatggtccttgacaacgaggcgctctatgatatttgcttccgcaccctcaagctcaccaacccttcatttggcgacctgaaccatctgatctcggcgaacatgagcggcgtgacgtgctgcctgcggttcccg

SEQ ID NO: 7863 - DNA, 383 bp, Zea mays
  Clone ID: LIB148-033-Q1-E1-A10
cccacgcgtccggggtgcctgatcttgcacggcggcagcgacctgttccacgggagcaccatcaggaccgtcgagtacgtcttcgggcagggcaacctgacggtggaccacctgaggaacttcgccgacagcttggcggcggcgaaggacatcacgatcaaccagatcttcctcccggccgatgtccagcagaagatcgacgtcgtcgaggagaagctcaactcctccgcgggcgtcttctccactcgcctgcaggagaactccaggaagatcaagggagtgctgaaccacatggagcacgaactgtttgctgttgcagctgttatggctggcctatcaatactcggattcttgttctccgtactggggttgcggtttcttgt

SEQ ID NO: 7864 - DNA, 395 bp, Zea mays
  Clone ID: LIB148-033-Q1-E1-A11
tgcccacgcctttgggcaatgccggcaccaccatgcatggatgagaagtaggcagcaagcgggagacagatctcggcaaggctgaaaaattcaaagtgaggggaaagcaaatggccgtgcttaattattcaaaggctagtttcttgcctgttcaggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttcaatgtgaaaagctcagcagacaagttattgatctatctgacgttttatatcaatattgccttaaaa

SEQ ID NO: 7865 - DNA, 394 bp, Zea mays
  Clone ID: LIB148-059-Q1-E1-E11
attcctggacctggagtgaaggaacagctccagaacctttgcaatgtctatgccctctacattctccacaagcacctgggcgacttcctggcaaccgggtgcatcacacccaagcagggagcgctggcaaacgagcagctgggcaagctttacgcacaggtgcgtccaaatgctgttgcgctggtggatgccttcaactacacagaccactacctggggtctgtgctggggcggtacgatgggaatgtgtacccagcgctgtacgaggaggcgtggaaggaccctctgaacgagacggtggtgcccgaggggtaccacgagtacctccgccccttgctcaagcagcagctcaagctctccaggctctagtctgatcggctaccccccctggaat

SEQ ID NO: 7866 - DNA, 407 bp, Zea mays
  Clone ID: LIB148-059-Q1-E1-E12
aggcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtggcaaggagga

SEQ ID NO: 7867 - DNA, 411 bp, Zea mays
  Clone ID: LIB148-059-Q1-E1-E2
cccacgcgtccgcggacgcgtgggcgaagatggcggcgacgagatcaaggatgctgctgccccgaaagaatccgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgttggttcaacgttgtaagaatgacctacggtgtat

SEQ ID NO: 7868 - DNA, 350 bp, Zea mays
  unsure at all n locations
  Clone ID: LIB148-059-Q1-E1-E3
acccacgcgtccgcttgtattctagcagcanagcanagaggatcggatcagaagaaaagaatagttaggtcccggtggtcgatcgaacgaagctgctgctgctaccggccggccgggcatgacgatgacacggacgatgtgcctaagcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagattccgactgc

SEQ ID NO: 7869 - DNA, 273 bp, Zea mays
  Clone ID: LIB148-059-Q1-E1-E4
aggacgagttccgcacgttcggggttcttcgcagtgtctgggttgctcggaaaccacctggctttgcgtttattgattttgatgataagagggacgcagaggatgcaatccgtgacctagatggtatgtgatcaatgtattgctgtcaacatgttataaacctctattggtatgttgtatcagatgtttatatgacattccatatgttgtcggtgttatttgtgaagaatatctgagttggtactaaattacattcagagctctatttggtat

SEQ ID NO: 7870 - DNA, 364 bp, Zea mays
  Clone ID: LIB148-059-Q1-E1-E6
atccgcagagactcggaagtcggaaagaatccctcctgttcttcgtcaaccctccagaacctgctctctcttcctctacgagactacgaccgtgtaaggacatggccgtcgagcgcttgaagaccgggttcgagcagttcaaggccgacgtctacgacaagaagccggagctgttcgagccactcaaggcgcaccagtcgcccaagtacatggtgttcgcctgctccgactcccgcgtgtgcccgtcggtgaccctgggcctgcaccccggcgaggcctttgccgtccgcaacatcgccagcatggtgccgccctacgacaagaccaagtacgccggcgtcggctccgccatcgagtacgccgt

SEQ ID NO: 7871 - DNA, 410 bp, Zea mays
  unsure at all n locations
  Clone ID: LIB148-059-Q1-E1-E7
cggccgagcaccatgcgaggaaataacatgccgcggcacacgtcgccgttactttttgccttgttggcgaccctgctcagcgtcggcgacgcgttggtcgtcgacggcctgcaggtggggttctatggaaagacgtgcccggcggccgaaggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtcccacgtanagggcatgtgcccgggcaaggtctcgtgcgcagacatcct

SEQ ID NO: 7872 - DNA, 381 bp, Zea mays
  Clone ID: LIB148-059-Q1-E1-E8
cggacgcgtggaaaaaaccagcagctagctagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctg

SEQ ID NO: 7873 - DNA, 398 bp, Zea mays
  Clone ID: LIB148-059-Q1-E1-E9
cggacgcgtgggcagccggccaacgtcgttccaccgcaagtagtggtgtcgaagcttccgccggaggtgctggccaagctcccgcccgacgtgctggccagcatcccgccggagacgctggccaacatcgcggcgtcgcaggggcagctgcagacgagcgagatcctggccaccatcccggcggcgcaggcgcagggccagctgccggcggacctgccgccggaggtgctggccaagctcccggccgtgcagagccaactgccggccaacattacgcccgagatgatgaccagtctcgccgccgtgcagcagcctgcggctgctggccagcctggggcggccccggctctcccggccgacatccctcagatccccaagatgcccgacctctcccggct

SEQ ID NO: 7874 - DNA, 372 bp, Zea mays
  Clone ID: LIB148-059-Q1-E1-F1
ggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccc

SEQ ID NO: 7875 - DNA, 409 bp, Zea mays
  Clone ID: LIB148-059-Q1-E1-F10
agcccacgcgtccgccgacgacacggccctggacgcatcctccccgggcaccgacacgcagcgccgcctgctgtcccgcctcgcctccgactggctcgccctgctcctcttcaagtccgcctacctcctcgcgctcctcctgctctcgctcctctccgtcgccgcctccgtgttctccgtcgcctccgtctactccgccaagcgcgacgcgctcaccttcccgcgcgtgctctccgtcgtgccccgcgtctggcggaggctcgccgccacgttcctcgccgccttcgcgctcctcttcgcctaccacgccgtcgccgtgctcgtcttcgtcggcctcctcgtcgccgcggacaacggctccggcctcgcgggcctgctcgccttcctcgtcgccgtcgcctacctgctc

SEQ ID NO: 7876 - DNA, 400 bp, Zea mays
  Clone ID: LIB148-059-Q1-E1-F11
cccacgcgtccggagccccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgacgtgatgacgcccgccgacgccgagaagcctatctctgtcgagcccaaggcagacgccatcgtggtgatggacgccaagaaagatgatggcaataacaaggtggccgtgga

SEQ ID NO: 7877 - DNA, 431 bp, Zea mays
  unsure at all n locations
  Clone ID: LIB148-059-Q1-E1-F12
ctcgcgggccgacacaagcctcaagcgtcactcatccaagacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgangagatcg

SEQ ID NO: 7878 - DNA, 384 bp, Zea mays
  Clone ID: LIB148-059-Q1-E1-F2
gggtcgagcacgcgtccgacgacgttggcaagagaggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaatgagcaggagatggagaaggcggtcgcggcggagaaggctgcccagcaggagctgctcaagtacgccaaggagaagggcatcgtg

SEQ ID NO: 7879 - DNA, 412 bp, Zea mays
  Clone ID: LIB148-059-Q1-E1-F4
agttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatatataatcactcttcggtacctctccccttctcacgtaatctcaagtctccaccgaatatata

SEQ ID NO: 7880 - DNA, 406 bp, Zea mays
  Clone ID: LIB148-059-Q1-E1-E10
gcaagggcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtc

SEQ ID NO: 7881 - DNA, 382 bp, Zea mays
  Clone ID: LIB148-059-Q1-E1-C6
cccacgcgtccgcccacgcgtccggcggccacgaacggcaaggacggcaagccggtgggcacggtggggagcgccacgctggcggtggagtcggactacttcacggcgtacggcgtggtgttccggaacgacgcgccgctggccaagcccggcgccaagggcggccaggcggtggcggtgcggctgttcgggaccaagacgcagatctacaactgcaccatcgacggcggacaggacacgctgtacgaccacaagggcctgcactacttcaatggctgcctcatccggggcagcgtcgacttcatcttcggcttcggccgcagcttctacgaggactgccgcatcgagtcggtggtcaaggacgtggcagtgctgacggcgc

SEQ ID NO: 7882 - DNA, 389 bp, Zea mays
  Clone ID: LIB148-059-Q1-E1-C7
gctcccgaggcagcgggcaggcagcggtggttctcccctaagactgagtgatggcgacgctccagaggcgggcgggcaagcggcgacggcagtcccgagtcgaacgagtggcggcgtcgcaccctaggctcggtggtaacggtgattgtgcgaggcacgataggcttcggcagtgacggtggtggccatgggacacgcgggtagctccgacgggcgcgtgaggcgcggtcgtctccagcggtggtggccacatgaggcgtggttggctccggtgtccttcgatgaccaactccttcgatctgatggcctcggcggcggcgtcctccgatgacctcctccaattctttgtttatgcatgcggctgttggttgagcccatactaatttttc

SEQ ID NO: 7883 - DNA, 274 bp, Zea mays
  Clone ID: LIB148-059-Q1-E1-C8
ggacgcaccacatccgtcaagcaccaggtcatccctgccaactgggaggccaggacagcctccaccggcaggtgggtaactttagagctgactctccattccaccgacctatgcgatctcaaccaaagcgcggtggttcccgtgcatggcattagccatacatgcatcggcacttactgtcgagttgctgcgacaagccgattactccaatggtcccgtgacgagcagtcatcgcgacatcctccgtctacatcatcctcagctcgatccagtg

SEQ ID NO: 7884 - DNA, 403 bp, Zea mays
  unsure at all n locations
  Clone ID: LIB148-059-Q1-E1-C9
gggaagtcaccacagcatcaagatacgacgatgaggttagcagggcaaactctggtactggttctggtcgccggtctggcttggatgatgcggatatgtcaggctcacaattgggtagccctgctcacactggaaggaagaggggatctcctaggacttctgaaagccagcatgctatagcagaggccaaaacatatggggaaaattcaagaggcagaaagtgaccaaactctcagagcagcattgaccgtatgagcagaatgctgaaccagatggttcatccattcatcattcatagaaaaaaaaaatgataagttccttgctagcgccagacaggaacattgcatcagtccatctaggtcncttggtctttgtgaatagagctttcctcttttccctttac

SEQ ID NO: 7885 - DNA, 408 bp, Zea mays
  Clone ID: LIB148-059-Q1-E1-D1
caacgcttctcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatccaaacctccctgtgctgctgtgctga

SEQ ID NO: 7886 - DNA, 376 bp, Zea mays
  Clone ID: LIB148-059-Q1-E1-D10
cctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaagctcaccgctaaccaggagtactgggcggagcgcgcggaggcggcgcacgcgtacaaccgcg

SEQ ID NO: 7887 - DNA, 228 bp, Zea mays
  Clone ID: LIB148-059-Q1-E1-D11
gcatcccacccatggtcaggccgacgcgcagcatcatccctgggaacgatcacggtgcagctatacgtggatctcctctcacacaaggtacatcatcagtcccatagcgctgaggcgtcgaacctatcagaagtcgctgtgtccgaagctgaagaagcagtcgctgcaccgctcatcgcaaagcttgaggagaatgtcagtgcagccgtgacagataccgcaatatat

SEQ ID NO: 7888 - DNA, 404 bp, Zea mays
  Clone ID: LIB148-059-Q1-E1-D12
atgcatgcatgtgacgacctctcctcctcgctgtctctctgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgccggcgtgtccgcgctcagagggttcaagctat

SEQ ID NO: 7889 - DNA, 371 bp, Zea mays
  Clone ID: LIB148-059-Q1-E1-D2
cccacgcgtccgcgcgtccgtatgatcgaccagatcaagcgcgagatctccgtcatgcgcctcgtccgctagacgaacgtcgtggatctgcacgatgtgatggtcagcatcatcaagatatacttcgccatggagtacgtccggggcggcgaactcttcgcccgcgtcgccagctgtcggctcaacgaggacgccgcgagaacgtacttccaccagctcgtcggcgccttcgactctctgccacagccgctgcgtctagcagcgcgaccgcaatcccgagaacctcctcgtcgaccatcagggcatgctcaaagtctccgatctccgccgcagcgctctcatgtagtgccagcatcaagatcgcctgctgc

SEQ ID NO: 7890 - DNA, 368 bp, Zea mays
  Clone ID: LIB148-059-Q1-E1-D3
cccacgcgtccgcggaagcaaagcacaccagctcatttgcttcgcccgttcgccgtgcgtgcgtcgtcaaccaaagactcgtttccttctttgtgctcctgttcgttccttccttccctggaacccttcccccgtaagctcgccgctgcgctgcgttcggatggcagttggaggcggcgtgtgtgtggcgtcgccctcgccgtcgtcggtcgaggcgtggtcgtggaggacgagcggggcgcggcgccgcgcggccgttaggtgcagcgtcgttggcgaggccgggccgggcgccgccggcgggcgggtggaggacccctaccggacgctgcgtctgcgccggggggccacccgcggcgaggtcaaga

SEQ ID NO: 7891 - DNA, 372 bp, Zea mays
  unsure at all n locations
  Clone ID: LIB148-059-Q1-E1-D4
caagtacaagaagagcactgagttgctgattangaagctgccgttccagaggcttgtcagggagattgctcaggatttcaagacggatctgcgcttccagagccatgccgtgcttgctctgcangaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggaggaagaactctgcgctcgttttgtgtgttcgcctctctcaccctgtaagttttgtgagaagatgatctagtaaactgtacttggcctgtttgactgtanccgcag

SEQ ID NO: 7892 - DNA, 248 bp, Zea mays
  Clone ID: LIB148-059-Q1-E1-D5
aagcatgtctctgagcaaccttggctcaagaatgctgataaggcttcaaatgtgtcactcggagaggttgttcggtcgaggctgaagcagttgtcggctatgaacatgcttacgaagaatgcatttggagtcgtcgccatgaatttagcgagtggaagagattggtagattcagagagatgttcgatataacgcacaccatcatggagtgtagtttgtcacttgaggagatgaaggagcggtttccgg

SEQ ID NO: 7893 - DNA, 315 bp, Zea mays
  Clone ID: LIB148-059-Q1-E1-D6
agtgagtcttagtattggtggatcaggaagctgccgttcgacacgcttgtcacggacattgctcaagatttcaagacggatctgcgcttctagagccaggccgtgcttgctctgcaggatgcagcacacgcctacctggttgggctcttcgaagataccagtctgtgcgcgatccatgccaggcgcgtgaccatcatgcccagtgacattcagctggcaacaaggatccgtggcaagagggcgtatgtctgtcgacgagatgaagaactctgcgctcgttttgtgtgttcgcctctctcaccctgtaagttttgt

SEQ ID NO: 7894 - DNA, 396 bp, Zea mays
  Clone ID: LIB148-059-Q1-E1-D7
caaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctccaatttctcgaacccgtccaaatttttttcct

SEQ ID NO: 7895 - DNA, 340 bp, Zea mays
  Clone ID: LIB148-059-Q1-E1-D8
aacaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccac

SEQ ID NO: 7896 - DNA, 403 bp, Zea mays
  Clone ID: LIB148-059-Q1-E1-D9
cccacgcgtccgcacgacgccaagtccgcctccgccgtcatccgctacgccggctccagcggcgccccgccggcgcccaacatgaccgagccaccggccggctgggcctggtccatcaaccaggccaggtcgttccgctggaacctgacggccagcgccgcgcgccccaacccgcagggctcctaccactacggccagatcaacatcacccgcaccatcaaggtcatggtctcccgcggccacatcgacggcaagctccgctacggcttcaacggcatctcccacagggacaccgagacccccctcaagctcgccgagtacttcaacgtcaccgacggggtgttcagctacaaccagattggcgacgtgccccccgccgttaacgggccactccatgtcatcc

SEQ ID NO: 7897 - DNA, 352 bp, Zea mays
  Clone ID: LIB148-059-Q1-E1-E1
gccatggccgcccccgacgtcctcgcgtgccgctccccgaggtggcgggcatggtgcgcgcagctatcgcgggggtcacgacggcgacgcgattccaggagctggtagactggatggaggagcggaaggcggcattcagggacgacggcaagtggacagagacggtgaatctggggctcaggagccccgcgctcatcatgttcgggctgcttcagttcgccatcgacagggacctcgggttcgggaagaccagcctcgtgctgccctgggtgcgccatggccggctggggtccgcgtccgtgacggtggtgccctgccccaacggcgacgggtcgtggttcttcggcggcac

SEQ ID NO: 7898 - DNA, 406 bp, Zea mays
  Clone ID: LIB148-059-Q1-E1-C5
ggaggcgcagagggaaaaggaagatgagctgctttccgtgcttcggcggcggaaagggcaacaacgacgacgccgacgcggagagcccgggcgacgcggccccggcgtctaacatgacgccgcccgcgatggtgcaggcgcccgccgcgtacttcccagctcccgccgccgctccaacggccgcggcgccgcccaagcccggtggcgggaaccaggcgcacgaggcttccgccgatgactcggcgctgcggctcgccatcacggggcaggcgttcgcgttccgcgagctcgccgccgccacagaccacttcacgccgtacaacctcgtcggtgaaggcggcttcttccgggtctacaagggccggctagagaaaagcggcagacggtggcatcaagcagctggaca

SEQ ID NO: 7899 - DNA, 393 bp, Zea mays
  Clone ID: LIB148-059-Q1-E1-B10
aagacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatcttcgcccgcgaggtgccgctggacccggcggcggcggcga

SEQ ID NO: 7900 - DNA, 403 bp, Zea mays
  Clone ID: LIB148-059-Q1-E1-B11
aggacgccatcaaagatacccttcgagaaagggttggcccaaaggtttatccagccctctggatctggtgttgacttgggattcttttctcttgatgagctttcgagttcatcaggggaagtattcccacttgttgtttatgcagaagcatatccatctccagaggaaggtggcccgtcagtaaacgccactcgtgcacagattactcttgctgttttggagaagcacaacaacgaccttcaagtcaaagttatgaagcaaatcttgtggattgatggcgtgaggtatgagctacaggaaatttttggtcttgtcaactccactgaagcggatgttgctgatgctgatgccgatgacacggggaatgaatgtgttatctgcttgtcagaaccaagagacactg

SEQ ID NO: 7901 - DNA, 428 bp, Zea mays
  Clone ID: LIB148-059-Q1-E1-B12
ctcgcgggccgacacacgcctcaacacgacggcatcctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccat

SEQ ID NO: 7902 - DNA, 415 bp, Zea mays
  Clone ID: LIB148-059-Q1-E1-B2
cccacgcgtccgcacaacacaaggagaaggggaagggcggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcaattacgggcaattcatctggaagagctgaaggaaatt

SEQ ID NO: 7903 - DNA, 373 bp, Zea mays
  Clone ID: LIB148-059-Q1-E1-B3
ggtcgagtccgcgtccgatcccatgctccgatcgccgtggagcaatgtcaagtcgatgcatcggaaggggctagagatgtatgacttccgcttcgacgcggctgattcggctgtcaagcttcccagccagctgcgctgcgctccgcattgctcttgatggcatccagtagatctgttcgccccccaatatcaaaggccggaggaggaataaacgttagggagtcggccatgggatgcttttcatgctgctgtgtggcagatgacgacaacgttggcaggaggaatgagcatgacgatgcctatgttcctatccctgctcatgtttataattttggagctagccggttcccagccccaggccctggtcatctcg

SEQ ID NO: 7904 - DNA, 416 bp, Zea mays
  unsure at all n locations
  Clone ID: LIB148-059-Q1-E1-B4
cccacgcgtccggacaagatggcgtgcacagacaatgcgatgaaagccttgttcctcctggtcctccttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatgggtattggatcgagaatccacccgtggataacctggtcatca

SEQ ID NO: 7905 - DNA, 383 bp, Zea mays
  Clone ID: LIB148-059-Q1-E1-B5
agcccacgcgtccgtgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacagga

SEQ ID NO: 7906 - DNA, 410 bp, Zea mays
  Clone ID: LIB148-059-Q1-E1-B8
gacgccgccgtcttcgagcgctgctgcctggagatggaggaggccctgaacgcggtgtacaggcagggccgcaacggggacgccatcgggccgctggagatccgggtggtgcgcggcggcacgttcgaggaggtgatggactacgccatctcgcgcggcgcctctatcaaccagtacaaggcgccgaggtgcgtgtcgttcggacccatcatcgagctgctcaactccagggtggtgtccagccacttcagcccggcgtgccccacgtacagcccgcacaagaagtgatgacctaatagcattggccgtcggagctcggaggctggggttcacggtcacgggccagactgagctactacacttctgctagtactatatattgctacttgttgctctctacagtgcgtgtc

SEQ ID NO: 7907 - DNA, 411 bp, Zea mays
  Clone ID: LIB148-059-Q1-E1-C1
ggaagacgatgcgctccgcttcgtcgtccgtgggtggtgcaagtgcaagcgcaaggcagacaaacgcggcgagaaggagagcagagaagcccggtgccacatccgtgtggcctgcggccggcggcgcggttacgaacgcctcgtcgtctaaggatgtggccagcagggcagcaaaatcgccatccaccgccgcgcagaagacgaggcctgctggtgtcgagaaggcagcagcgtcttcttctgtaaagctgaagacgaagcctcagaaaacaacggcaggagctggaaaaactcaagctgcacctcccgcccgtgctcctcctggcacggtaatagcaaagaagagtacgggagccgagaactatgtccccatccagaagaacaacaaccgtgccggcggcgagaccaaca

SEQ ID NO: 7908 - DNA, 405 bp, Zea mays
  Clone ID: LIB148-059-Q1-E1-C10
cgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaac

SEQ ID NO: 7909 - DNA, 401 bp, Zea mays
  Clone ID: LIB148-059-Q1-E1-C11
agctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcatgtggacgcgttcgccaagcgcaccgcgcatgcgcgcaagcacgtcgcgaggtcggctcgcaccatcccgccgcatcagacgcaggcgctcacgt

SEQ ID NO: 7910 - DNA, 396 bp, Zea mays
  Clone ID: LIB148-059-Q1-E1-C12
gagctgctggagcccttttggtttatgatatcactaggagggagaccttcaatcatctcgcaagttggctagaagatgccaggcaacatgcaaatgctaacatgacagtgatgctgattggaaacaaatgtgacctttctcataggcgtgctgtcagctatgaggaaggcgaacagtttgccaaggagcatggtctggtttttatggaggcatctgctaaaactgcacaaaacgtcgaggaggcattcattaagaccgctggtacaatatacaagaaaatccaagatggcatatttgatgtatcaaatgagtccaacgggatcaaagttggctatgctgttcccaactcatctggacgtggtgctggctcgtcctcacaggctggtggctgctgca

SEQ ID NO: 7911 - DNA, 373 bp, Zea mays
  Clone ID: LIB148-059-Q1-E1-C2
tgcacacctgcggccacgacgcgcacaccgcaatgctgctcggtgccgccaggatcctccatgagcgccgcaacgacctgcagggcacagtagtcctccttttccagccgggtgaggaggtcggtattggcgccaagaggatggtggaggcaggcgccgtggagaacgtggaggccatattcgggttccacgtcaccgtgctgctccccaccggcgtggtgggctctagggccggcccgctgctggccgggtgcgggttcttcgaggcggtgatcaccgggggtcggcggccacgccgcctccccccagaacatcatacaccccgtcctggcagcctccagcgtcgtgctcatcctgcaaagcctcgtgtcgc

SEQ ID NO: 7912 - DNA, 415 bp, Zea mays
  Clone ID: LIB148-059-Q1-E1-C3
cccacacgtccggacgcttctcccttctcggagcctgcctcgttggttgccttctgcggacgccgccgattaggatctcctgttcagagctctccccacattgcaccacgcatcatgaggttcgtaatggtcctcacaggatagaggatgcacgcgagatagagaacgtagaggtgatgcacgagtacgaccttcacatgcagtcttgtatccacattcttggccctaggactgttccacagctgctagggagtgtgtacgtctaagaggtcatagacagattcgatggtcaactgcatggatttcaaggagctctgcagcgacttctaatacataatcatcccctacgtggagtccataatgacgtatgtcgcgacggaaacctttgggctcctcaaggataaccgcccattca

SEQ ID NO: 7913 - DNA, 415 bp, Zea mays
  unsure at all n locations
  Clone ID: LIB148-059-Q1-E1-B1
agtgccagacgagaaagacgtggcggttgtaggggaggaggtggaggcggaggcggagacggagacagagactgaaggcgaagcggaggcagaggtcgaggccgaggtggaggtcgaggtggaggcggaggccggtgcatcgtctgcgaagaagaaccgtatccaggtgtccaccaacaagaagccgctctatttctacgtcaatctcgccaagaggtacatgcagaactacgacgaggttgagctctccgctctggggatggccattggtaccgtggtgaccgtcgctgagatcctcaagaacaatggcctcgccactgaaaagaagatcctcacatcaaccatcggcaccaaggatgantgcaanggccggcttgtccgtaaagccaagatcgagatcctgctgtgcaaatca

SEQ ID NO: 7914 - DNA, 420 bp, Zea mays
  Clone ID: LIB148-032-Q1-E1-F2
agatggcgatcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgacctcaaaccgtacaagaggaactggatcgagatccagaacgtcgacaacctgtcca

SEQ ID NO: 7915 - DNA, 409 bp, Zea mays
  unsure at all n locations
  Clone ID: LIB148-032-Q1-E1-F3
aacgctcatctctcagatgtcatctgtgcggggcctcaatggttcttcaagtgaaggatctcctagccccggtaccagcgctccgaacgaagagagcaaccctgcggcagcgagcaagaggccgtatctcgagaggaactactccgtgctggaaccttcagaagggagccagctcgccgacgacgtggaaggggaaagctctctcgagaacgtgaagaaacagctcgagctcaacaagaaggcaatggccgctctttaaaaggagcttgaggaagaacggagcgcttcggcggtcgcggctagccagacgatggccatgatcaataggctgcangangagaaggctgcaatgcagatggaggctctgcagtacctgaggatgatggaacagcaggctggacacgaccac

SEQ ID NO: 7916 - DNA, 424 bp, Zea mays
  Clone ID: LIB148-032-Q1-E1-F4
acaccacctttaccaccgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatgggcaccttcgtgcaccgcaagtacagcgacaaggaggacagcgacatattcaagtgctacgacagctgctccgacgacgtggaggaggccgtcgcccacctcaacggcctcgtccgggagcccaccgacg

SEQ ID NO: 7917 - DNA, 430 bp, Zea mays
  Clone ID: LIB148-032-Q1-E1-F5
ggactcgcgggccgatgcaagcctctatagtgcgtcataatagccgaggaattcgaaggaccgaacgagaagctcctgcgtggtgtcaacgtctaccctaccgtaccagctagccaccacacgcgtagcgcgggaaatgccggcggcggcggccatgacgacgaggcgggtggtgctggaggtgctacggtcggcctcccgcgacgccttccaggtggccttctccttcgcggcgaggccgcccgtgtccaccatgctcaagccggccatcaccaagcccctctaccaccaccaccacgacaacgactaatctggcgcagatctacagcacggccgtcggcatgccttcacactttcacagcccggtgggtgtgccgactatatatttcgtcccaattgatgacttactaccacatttcgtcgctactac

SEQ ID NO: 7918 - DNA, 404 bp, Zea mays
  Clone ID: LIB148-032-Q1-E1-F6
atttttcaaggcacacagtggtcggaaatctggcagctgatcagcgcgagattctcctttctgctcataggttgctccaggcaatggttgatgttatatccagcaatggttggcttagtcttgctcttagtacaatggagctgagtcaaatggtgacacaaggcatgtgggatcgggattctgtgctgcttcaagttccacacttcacaaaagacttggctcggaggtgccaggaaaatgaagggaagcccatcgagagtatctttgatctagctgagatggctgtcgatgagatgcgggatctcttacaactatcgaactctcagctgcaagacatcattgaattcatcaagcggttccccaatgttgatatgacctatgaggtccgtgagggtgatgatata

SEQ ID NO: 7919 - DNA, 415 bp, Zea mays
  Clone ID: LIB148-032-Q1-E1-F8
aggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagatccgacctgcaggaggaggcaacagctaccgtaataaccaaagcggaagcacaagaggcttcagctgaaggtggcgattaacctacctaaccatattatttattcattcatatgcatgcatccttgttgctatgccagcca

SEQ ID NO: 7920 - DNA, 381 bp, Zea mays
  Clone ID: LIB148-032-Q1-E1-F9
cagagctcgagccaccgatatggttgtcctttacttccataaggctgcttcggtagggcaaaatactttctttgacgttttaaaatatgttgctgcccagtccccttctcggaaatcaaggctgcaccctcatcaggaaccacagcagcagcaaccacaagtgcaggtggagctgcagcagcaaccacaagtgcaggtggagctgcagcagccgcaaccacaaaaacaagcagcacctgttatgcgcagaggagcatctattgctgctcggcaagcagcaatggcacagcaatctctggagactatacccgttccatcttcacccaagatcaagcgtcaaacatcagggagacctggttcggtggcatccacaaagcctgc

SEQ ID NO: 7921 - DNA, 417 bp, Zea mays
  Clone ID: LIB148-032-Q1-E1-G1
agactggagcacagagctagttagccagccagccagcagccagcttgctcgccgcgcccgtccttcttcctcgcctccgttccattccgtcccgccctccaccgccgccgccgcattcacggatggagatgaagaagatcgcctgcgccgtcctcgtcgccgcctcggcggccaccgtggcgctcgccgcggaggctccggctccggcccccaccagccgctcctccgccgtcccgccccgcgtcggcgccgccctcgggggcgccgtcgcctcattcttcgcctactacattcagtgagccgggcggcgcgcccggaggcccaggaagagactagggggagagagagtgacatggctgcgcccattccgatgcgtgggcatgttttttgattcgacacaccttttgtcctcttttt

SEQ ID NO: 7922 - DNA, 381 bp, Zea mays
  Clone ID: LIB148-032-Q1-E1-G10
agccgcgcgcggaggcgaggcgttcgcacacctcgcccgcgccaccaccaccgctccgttgcgcccgccagccgtcacgcgtgacgtttcccggggggccgggggagagagaggcagaaggaggaggcacggagaggacgagacaggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttc

SEQ ID NO: 7923 - DNA, 396 bp, Zea mays
  Clone ID: LIB148-032-Q1-E1-G12
cgcgcatcccacaaccaccgaccaacctacgtcctaatcctccgctgctcgggtataaaaatgatgatgcctctgaaggaaagccataccaggttcttgcattcctgtcagatcccactgaaacaggtctgaagagaagcgctcgacgtggtgcaggtctgtcatattctgtggtgtagttcaagcataagccattacagggaggctcgtcttcaggatgcaagccttttcattatgatgaaggcatacgagatgaaggtgtaatctaaggatgacatgaataaacgccgaagctaccgccagatcgatagcttcggctcatgatgaagatgaagtatgatggtgatgctgaccgaaggggaaaaaaagactatttagtccttaataatttgtatt

SEQ ID NO: 7924 - DNA, 339 bp, Zea mays
  Clone ID: LIB148-032-Q1-E1-G2
tgtgctgtgccctcctgtgctgctcatcgtcgcctccagcccaacggtgtcgactgctcatgacgatagctgctggaaggacgacgaccaccaccctatctgctttcccgaatactgcgtggcgacctgccatgatcacgggcacgcggacggccgctgcaactgggcatggtcgtggaagccgtattgccagtgcctgttggcggactgccaatacgcgcgaacagctgcgtcgcatggcgtcctggctgcctcgccggccgatgaaggatgaacggttgcggccgatgatcgatgtgtccgtcggcatgtcgatcactcattggaaccccctctaat

SEQ ID NO: 7925 - DNA, 382 bp, Zea mays
  unsure at all n locations
  Clone ID: LIB148-032-Q1-E1-G3
aaaaacccttccgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacngcaccatcgacgggcagggacccctggtgtggagcaggaaacagtgccagcattcttacaattgcaagatcctcccgaatagcttggtgctggatttttgtgacgaacgtccagattcgcggcatcacgctgctcaacagcaagttcttccagctcaacatcttcgagtgcaag

SEQ ID NO: 7926 - DNA, 378 bp, Zea mays
  Clone ID: LIB148-032-Q1-E1-G4
gcgtccgcacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggc

SEQ ID NO: 7927 - DNA, 384 bp, Zea mays
  Clone ID: LIB148-032-Q1-E1-G6
agctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaagtgcggtgcgtggacagccctagcgggtgcaagcccgacgcggcggcactggtggtgacggtgaccgacctgtg

SEQ ID NO: 7928 - DNA, 390 bp, Zea mays
  Clone ID: LIB148-032-Q1-E1-F12
cggtggtccatcatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatc

SEQ ID NO: 7929 - DNA, 402 bp, Zea mays
  Clone ID: LIB148-032-Q1-E1-D7
gcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagggaccgtgtcgtcgagggtgggcacgtagttggctgtgcggtaattgctcgtctggtcgggagggacaaataacgcaagtgttgcttttgcttgctcacttcgtgtgctcttgtaactttatggggtcaaccgttatataactgaaacgatttgattaattgatactaatgctctctaag

SEQ ID NO: 7930 - DNA, 377 bp, Zea mays
  Clone ID: LIB148-032-Q1-E1-D8
gggcacaagagcatgcggctgcaggacacgaaccagagccacgtgcacgccgaggaatcgctgcccgttgtggccgaaaacggggtgacaatggcggggaacgacggcgactcgcggctgttcgtcgacctggagcccgttccggccatcagcaagcggcacggcggcagcgtcggcggcgaccacgcggcgccgtgcgccagggctaggaccatgtccaccagcttcaaggagccgccttgtgtcgccgaacacctccctctctctggccccgtgcagctcgcggcgtccaccggcttctcctgggccaagaagccccggcccgacgccacgacggcggcggtaactgtgacgatgcggagcggctccatggggcc

SEQ ID NO: 7931 - DNA, 397 bp, Zea mays
  Clone ID: LIB148-032-Q1-E1-D9
cggaggacgcggatgagcggcgcgactatttccgcgccatgcaggccaaggatctgttccggcacgagcagatgatcacgatgatgggcagcgaccggaacggcagcagcaggaggcggcgggcgaaggagtcgtccaagctgccggaggtcatgtccgccacgtccatgttcgagctgccgatgcggagcgcgctgaacatcgcgcacgtgggcatgtacctggtgtcggtgcgcatcggcacgccggcgctgccgtacaacctggttttggacaccgccaccgacctgacgtggatcaactgtcgtctgcggcgccgcaagggcaagcactatgggcgacagtcgatggggcagacgatgtcggtgggcggggaaggcgcgacggcggcgaagaa

SEQ ID NO: 7932 - DNA, 359 bp, Zea mays
  Clone ID: LIB148-032-Q1-E1-E10
agcgcaatcgtcgactgctgctgcgttcagttccgttcggaagatgttcttggagagcttccgggtggagagcccgcgggtgaagtacggcgagggcgagatccagtcggagtaccgctacgacaccaccgaggtcgtcccgccggggaatggcggcggcgcggggtgggtggtgcgcccaaagtccgtcacctacaacttcaagaccagcaccaacgtcccaaagctgggggtgatgctcgtcggatggggcggcaacaacgggacgacgctcacggccggggtgatcgccaacagggaacggatttcgtgggagactaaagagaaagttcacaaggccaactacctcggctccctga

SEQ ID NO: 7933 - DNA, 375 bp, Zea mays
  Clone ID: LIB148-032-Q1-E1-E12
actcgtgggccgatacaagcctctatagtgacgtcctgttaacgcgtccgcgccggcgtgctgcggctggccatgggcgccgtgcgcaccaaggccgccgaggccaaggccgcggcgggcgcgctcgccaacgacccccggacgcagccgctggcgcgcggcccgctgcacgactgcgtcgagtcgttcgacgacatcgcctacagcctcgaccaggccgccaagtccctcgccgccggcaaccgcgacaccaccggcaccatgctcgacaccgtgcgcaccgacatggacacctgccaccagggcttcgaggagcgcgaggagctcacgccggtcatggccaagcacgactccgaactccccaagctctccagc

SEQ ID NO: 7934 - DNA, 325 bp, Zea mays
  unsure at all n locations
  Clone ID: LIB148-032-Q1-E1-E2
ggctcctgtacgggagtanggacaccagtgctcctgtatattgctcgtcgtcgctcgttcttggccgcggatcggtgcagtgcatgcgtagcggaagaggtggcgcgacctggtgtcgtgagattgaagatgagcggggactccagcgcgggatcgagtaacacgatgaagaatctccatccactggtgattaccgttgtcacccgtgctcgccgcgacccaaggccagtgcctcggcgggaccctcgcgctatcggcgtccggtcncccccatgccgcgtgaggacacgtgttacctgaagagcaagttggtacctggaatctc

SEQ ID NO: 7935 - DNA, 414 bp, Zea mays
  unsure at all n locations
  Clone ID: LIB148-032-Q1-E1-E3
agggcgatgataaggagtcactcagctgaattacttcgggatggcgtatcactggagcaaataggtcttgatttttctccagaactcactgaaacaactgctccagattccatccggatgcttgttcaaacagttctctcagataagaaaccagaagaaattcaatcagttgtagaatcactcttgagcaaagtaattaatgaacttgagcaccgtattgcaagccagagtgaattggtgaaaganactatggataccaacggctgtaactcagttttgagaatggagtctccctgtaacaacaatgacagtaaatcattatccagagtggaccctccacaagtggagttgacttcctgcagtgatctggagaaggtgaaagaaactatggataccaatggctgtaactcagtt

SEQ ID NO: 7936 - DNA, 419 bp, Zea mays
  Clone ID: LIB148-032-Q1-E1-E4
agtcgagcacccctggttcaagaaggggtacaggccggccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaagaaacaggacgggctggtgaagctgcaagggtccaaacaagggaggaaggggcagctcgcgatcgacgccgagatcttcg

SEQ ID NO: 7937 - DNA, 429 bp, Zea mays
  Clone ID: LIB148-032-Q1-E1-E5
actcgcgggctgacgcacgcgtctgcccacacgtccgcccacgcgtccgcgacaagaaagaagagtactatctcagctactggattgggaaggatagcttggtggacgatcaagtgtcggcatctcaaataatcaatacaatgtggaattcattgaaaggacggccagttctgggccgtatataccaagggaaggagccaccacaatttgttgctcttttccagcccatggttatcttgaagggtggaatcggatctggatacaagaagctcatagaagaaaaaagtgctaggggtgagacttatactactgaacgcatagctctaattcgagtatctgagacatctatctacaacaacaagactcttcaagtagaatcggtagcaacgtctttaagctcagcggagtctttcgtactgcaatctggaa

SEQ ID NO: 7938 - DNA, 384 bp, Zea mays
  Clone ID: LIB148-032-Q1-E1-E6
agatcaaaccaatctctctctcttgcaatgactctcaagcgcctagggctgctaccctagaaccaagcctgcggcagagggtataacctcgccggagaagacagctatccccatggaccgaaggtccatgacacctggtatcagctctaggttatcctcaccaccaccagccgtccatccctcaccaccaccagccgccgcgccatcagccgccgcaacgccctcccacctgccctctccaactctagatgcattcactcggctcaaagagagttttggccgcttcgcagagcagtgggatcagttcgttgtgatgttccaccgctacaaggagaagacagagaaggaactccaagcagcggtgcggcttcagacgacaacgcg

SEQ ID NO: 7939 - DNA, 406 bp, Zea mays
  Clone ID: LIB148-032-Q1-E1-E8
cacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatca

SEQ ID NO: 7940 - DNA, 396 bp, Zea mays
  Clone ID: LIB148-032-Q1-E1-E9
aaagaccctaagaaatctaagtattcagatacactgcatcggttttggaagaaagagcatgattaggggtgttaaaagtttatggagctgtcagaattacatgatggctttattgttcaggattctcttaccatcaaagcccaagttcaagtcattagaagatagaccgtccatttcgttgccttgatggtcagtaccgaagggaactaattagggtgtatctatcaaatgtggaacaaatttatcggtgttttattgatgaaaaagaaggacgttcagcaggctgattgaggataaactcgggtggtccagtttcagtggattctggctagccatttttcatctttgattttatctgaacagagacttgaactcgctatcaactttcagtagacc

SEQ ID NO: 7941 - DNA, 310 bp, Zea mays
  Clone ID: LIB148-032-Q1-E1-F1
ccggttgcccaacccttgcaaccgcctgggctgctttcgggttgacgggccatcggcagcgcccgccggggctcctgggccgacattgaaggccgccgtgcgcgcgctcttcgacctccccgacgacgccaagcgccgcaacgccgacgtcatccccggcagcggctacgtcgcgccctgcccgccaacccgctctacgaggccttctggctcctcgacgccgccgcgcccgccgacgtcgacgccttctgcgcgccgctcgacgcgccgcccatagtcaaggagaccgttaagacctacgcggagaaga

SEQ ID NO: 7942 - DNA, 352 bp, Zea mays
  Clone ID: LIB148-032-Q1-E1-F10
aggccgaagagctggaagcaatcagggagttgtttcagttgctggacacgaacaaggatgggcatcttacaatcgaagaactcaggaagggaatgcgattgataggccacaatgtccatgacactgacgtcgatatgctcatggaagctgccgacatcgacgggaacgggaccctggactgcaaggagttcgtgacagtctccattcacctgaagaaaatccgtagcgaggatcacctgcccaaggtgttcagctacttcgacaagaacgggagcgggtacatcgagatcgaagagctgaaggaggccctctctccaagaggtgaccagaaggcgatcgaggacataatcct

SEQ ID NO: 7943 - DNA, 398 bp, Zea mays
  Clone ID: LIB148-032-Q1-E1-F11
agggagcggccaccaaccggaatcacgacgatgttggcggttcttcccatctccctctctctccagttgttcacgatggctcaggcagggtggcgacactagatcttcatgcaccggggcaagggtcccgtagagcacatatcgggtcgtgcgcggattcccagcggcgggcggatttcactgccatggcgacggcgaacgagcggaaccacatcggcggcacccttccagcacgctgcatgcccatggcgatgaggttcatcgagaatctctcgactttggtgtagatcgaaagggaagcacggctgtcccatatataccccgagggagtctagatatgctcggccaggagcaacggccaccccaagaatcacgcaatgttcccttggcttcaattc

SEQ ID NO: 7944 - DNA, 399 bp, Zea mays
  Clone ID: LIB148-032-Q1-E1-D6
cggacgcgtgggatttggtggtacacgggggcacggggcagatctcttgggtcatcctctacgcgagcgggccgcttctcccatccagccgcgcgcggcgtcgccggaaccggagaagggaggggaaggagcgcgagatggacaaggccaataagctcagcaccggagcgggggagaaggcgaccaagagcaggagccacgggtccacggcgctgttcgtcgcggtggactacgcgttcctgctcgtcttcgccggcttcctcgcctacctcgtcgggtcgcggatcctcgcctccgccgccggctccgcctagaccggcccgcgttcgtggatctctcttctttcttccacgtttttttggagtcgatggctgccggagcaccgggatcttgccgggt

SEQ ID NO: 7945 - DNA, 393 bp, Zea mays
  Clone ID: LIB148-032-Q1-E1-C11
ggatcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccatccagtctaactaatccattcctgtgctgctcggcgaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtt

SEQ ID NO: 7946 - DNA, 392 bp, Zea mays
  Clone ID: LIB148-032-Q1-E1-C12
cccacgcgtccgctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgaactcagcgcg

SEQ ID NO: 7947 - DNA, 402 bp, Zea mays
  unsure at all n locations
  Clone ID: LIB148-032-Q1-E1-C2
aggtcctctcctctgtccctctacggtgcttctgctcgccggcccaaaatcgcctcatcgaccacgcccccttccaggctcccgtctccatgggtctcctctcaaacaggattgggagggagagcctcaaggcggtggatcatatctactcctggagggcggcgtgggtctacgcgcatcacggaatatatgtgggcgatgataaggtgatccatttcacaagaggaagaggacangaggtcggaacaggaactgtcgtcgatattattcttgtgagttcaccccaaaacgaagcaacacgccttgcccggtgtgcaccgacgaaaccagcgacagcagcacagagacgaacggcgtggtatcctcctgtctcagctgcttcctaactgggggtgctctcta

SEQ ID NO: 7948 - DNA, 409 bp, Zea mays
  Clone ID: LIB148-032-Q1-E1-C3
tcgctcctgcgccgcccgtccgatcaggtcactggccggggagggctcagaaacctttcatccaatacatacatctatctgagcgctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcaggcatccaataacgtcacctccgacgatgagtactgggcggagcgcgccgaggtggctcggtcgcgcaacctcgccgcctacgtcagcgacaccgtggccgccacgaaccgcttcaacgcagacgtgctgagggccacgacgcggcgggcgctggcgaagtacgatgggccgtgcatggcgactcaaccca

SEQ ID NO: 7949 - DNA, 409 bp, Zea mays
  Clone ID: LIB148-032-Q1-E1-C4
gcgcgccatcactccactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaacagctcgt

SEQ ID NO: 7950 - DNA, 96 bp, Zea mays
  Clone ID: LIB148-032-Q1-E1-C5
cacaaacctccgatcatccctaagaccacgcttccgttcatgagtacggtcacacttcaggtcgccgccaatcccgcgatgcatgaaggtcacacc

SEQ ID NO: 7951 - DNA, 395 bp, Zea mays
  Clone ID: LIB148-032-Q1-E1-C6
gcgggctggtttgaccgtcgttttgtacccgttgagatcccaggattcagactggtgccattcgatttgatttggcgcggggtactttcctatggccgcctccatcgcggcctcgcccttctttccagggtcgccggcgccggccgctcctaagaacggccttggagagcgcccagagagcctggacgtccgcggcgttgcggcgaagccgggagcctcgtctaatgccgtgagggcgggcaagacgcgcgcccacgctgccgtccccaaggtgaacggtggcaagtctgcggtggcggatgtggaacacgagaccgtaactgtaccttcgtcagtgccgaggactttctacaaccagcttcccgactggagcatgctccttgctgccatcacga

SEQ ID NO: 7952 - DNA, 403 bp, Zea mays
  Clone ID: LIB148-032-Q1-E1-C7
cacgaatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtagcagaggaactgga

SEQ ID NO: 7953 - DNA, 416 bp, Zea mays
  Clone ID: LIB148-032-Q1-E1-C8
ggagaaccagcagcctccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtgcttacgta

SEQ ID NO: 7954 - DNA, 390 bp, Zea mays
  Clone ID: LIB148-032-Q1-E1-C9
cacgcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacaca

SEQ ID NO: 7955 - DNA, 420 bp, Zea mays
  unsure at all n locations
  Clone ID: LIB148-032-Q1-E1-D1
cgccggccgcccgcggtcaccctcgcgctctcccgtcacgccggatcggacggactccggccccctccttcacaactccaacgttggcaagagaggatggcgttcctaaccaccataacctgcagcatggcccgcctgcccaccagcagcggcatggcagcactgctcctcctcgtcgccttcgtcgtcctcncctccgccgccctgtcctcctcgtcctcgcttctgcactcacctcctgagagtgatgagacaagcggcggcagcgagcagcaagccccgccggaagacgagaacaaggagaaagagcggcagctggccaaggagaatgcgtacgcggcggagaaggtcgtccagcatgagatgctcaagtacgccaaggagaaaggtctggtgtccccgtacaacggcaacgggtgg

SEQ ID NO: 7956 - DNA, 369 bp, Zea mays
  Clone ID: LIB148-032-Q1-E1-D10
gtacgcatcttctggctcacgacgatagccgaggaattcgaaggaccgaacgagaagctcctgcgtggtgtcaacgtctaccctaccgtaccagctagccaccacacgcgtagcgcgggaaatgccggcggcggcggccatgacgacgaggcgggtggtgctggaggtgctacggtcggcctcccgcgacgccttccaggtggccttctccttcgcggcgaggccgcccgtgtccaccatgctcaagccggccatcaccaagcccctctaccaccaccaccacgacaacgactaatctggcgcagatctacagcacggccgtcggcatgccttcacactttcacagcccggtggggtgtgccgactata

SEQ ID NO: 7957 - DNA, 391 bp, Zea mays
  Clone ID: LIB148-032-Q1-E1-D11
gcgaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaagtgga

SEQ ID NO: 7958 - DNA, 401 bp, Zea mays
  Clone ID: LIB148-032-Q1-E1-D2
ttacataaatttattaaaagctcaagagcatctaaggtgtcgatcgggaggtctgtctacatagaaaatgcttttcagttcaactttctaaagtgagacggtgatgttaagactagaacagataaactatatccaattaaagacatgacccaaatatcttatgttgaacaaagagtttactttaccaagaacatgatagagtaaatatgagtttgcaatctaaactgttagtgtttacgtgtatttgttgttatgcaatatttataattgaaatgtatgtgtttattccgataaacatgacgaacgcactgatatcttgtcgtgattaatgtacgaaatatggagatacaagtgctcgattcacttagtacctaaatcgatcgcagaaacatcactcactc

SEQ ID NO: 7959 - DNA, 393 bp, Zea mays
  Clone ID: LIB148-032-Q1-E1-D3
gctggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaacttctacggcgggcgggacgggtccggcaccacggcgggcgcgtgcgggtacaaggacacgcgcacgcaggggtacggcgtgcagacggtggcccgtgagcacggtgctgttcggtgacggcacggcctgcggcgggtgctacgaggtgcggtgcgtggacagccctagcgggtgcaagcccgacgcggcggcactggtggtgacggtgaccga

SEQ ID NO: 7960 - DNA, 419 bp, Zea mays
  unsure at all n locations
  Clone ID: LIB148-032-Q1-E1-D4
agcacccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggacntgcgac

SEQ ID NO: 7961 - DNA, 396 bp, Zea mays
  unsure at all n locations
  Clone ID: LIB148-032-Q1-E1-C10
cccacgcgtccgggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacngtggtggacccagcggcaagggcgactacaccaacatcaccgcggcgctggaggatatcccggtgagcaacaccaagcgcgtgatcctggatctcaagcccggcgctcagttccgcgag

SEQ ID NO: 7962 - DNA, 216 bp, Zea mays
  Clone ID: LIB148-058-Q1-E1-H4
cacgcatccgcgagaggtgaaccagcatcctccaatataagccagcacatccaaatataaccgagagacctcagccctcaggcaagccgaccgccgacgtaccaccgcgccaacccgagagaaagatggatatgatcaacaggatgctcatcgccgcgctcctcgtagtcaccgtctcagccagcgcattgctggcctccatcgaagccgccgccg

SEQ ID NO: 7963 - DNA, 269 bp, Zea mays
  Clone ID: LIB148-058-Q1-E1-H5
acccacgcgtccgcccacgcgtccgggaggactcagccaaccccatcttcatcgacatgaagtactgccccaacaagttgtgtactgccaacggcgcctccaaggtcaccgtcaaggacatcaccttcaagaacatcactggcacctcctccaccccggaggccattagcctgctctgcactgccaaggtcccatgcaccggcgtcaccatggatgacgtcaacgtcgagtatagtggcaccaacaacaagaccaatggctatatgcac

SEQ ID NO: 7964 - DNA, 234 bp, Zea mays
  Clone ID: LIB148-058-Q1-E1-H6
agcccacgcgtccggctcaggcgacctgcaacggtcactccacaggtaccggcgctcctgttaacggcagtcacgtgcgcgaatagcaacgctcaactgacagcctagagtcccatgacgaggtgcggcatcgtcccaatcttcatcgactgtactggctgcggcacatgctacgacgtgaaatgcagcgaagaagctaactgctccggcaagccactcaacgtctgcatcact

SEQ ID NO: 7965 - DNA, 299 bp, Zea mays
  unsure at all n locations
  Clone ID: LIB148-058-Q1-E1-H7
agggacagggtgagggcaccgcctgttgacacccttgcgcatgacctgcacacctctgactgcctgcatgagctccggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcngttggtgaaaaaccgggggnaaaaaaaggggggggaaa

SEQ ID NO: 7966 - DNA, 329 bp, Zea mays
  unsure at all n locations
  Clone ID: LIB148-058-Q1-E1-H8
aaaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctaaatcggacagggccaaantttcccgggntttttgggaaaaaaaaaaacccccccggggggggg

SEQ ID NO: 7967 - DNA, 353 bp, Zea mays
  Clone ID: LIB148-058-Q1-E1-H9
agggacgtaagaagtcgtctaattcttggatcgaattagacgacttcatcgtcactctcgtcattagcacgctaacttgtaatctgcaggatctaatcaaagacttgatttagttatggacggattggtaggcctcttggaagttcgcgtggtccggggtatcaaccttgcctaccgcgacgcaggaggcagcgatccgtatgtcgtcctacggcttggtaagatgaaactgaagactggcgtgaagaagagatccgtgaaccccatatggcaagaggagctgactctgagcgtcatagatcccagccatccactgaagctgtcggtgttcgacaaggacaccttcagcatag

SEQ ID NO: 7968 - DNA, 374 bp, Zea mays
  Clone ID: LIB148-059-Q1-E1-A1
gggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaagcggaggagctcgggctgagcggcggcggcctcggctccgacgacgcggtgcggcggacgctggcgcagcggaagccgaccaaccggtacatcaac

SEQ ID NO: 7969 - DNA, 404 bp, Zea mays
  Clone ID: LIB148-059-Q1-E1-A12
aagcggcggtcgccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagt

SEQ ID NO: 7970 - DNA, 337 bp, Zea mays
  Clone ID: LIB148-059-Q1-E1-A2
cgggccccccgtgccgtgagcaagtccatgcgatcccttggcaaaacaagttccccgggtcacgggcatgccgcatggggccggcgtcatctgcagcggcttgggcacgggcgcctggctcagccgcgtcgtttgtgcgcacagtcactgctgatgattctcagctgccggctcactgcaccgtgggcgcgtccgccgaaagccgtcctaatcatgcacgcaagtggaccactgggcggccgtggacctccgggatctctcacgcgcgcttcggctcggctcaccacaggtgcctcactacggttactttacgtacccgagtccattgcattggttg

SEQ ID NO: 7971 - DNA, 385 bp, Zea mays
  unsure at all n locations
  Clone ID: LIB148-059-Q1-E1-A3
ggtcgaggcccgcgtccgctacaacagaacatccatccgagctaagtaattaggtcgaaaatgacccgtgccagcagcagtagcagcagccggcgtgtgacgctggtactgctcggtctccgcctgctgcttctggttggtgttgcgcangcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgc

SEQ ID NO: 7972 - DNA, 355 bp, Zea mays
  Clone ID: LIB148-059-Q1-E1-A4
cggacgcgtggcagaaaacaaggaggaactcctcatcctcctcgcttctgccctttccaaaaggttcctccttgtcctggatgacttggagagcccgagcatatgggacaatctgctcaaagattcattgggagatggtgttgtcagaggaagaatactgatcacaactcggaacgaggaagtggcaacaagcatgaaggcaactatccaccatgttgacaaaatggaccctgagagtgcctgggcattattgtgcaatcaagttgatgcagaatgcaattcggaagagcttgcaacattaaaggatgttgggattaagattgcagagaaatgtgatggccatcctctagcaatc

SEQ ID NO: 7973 - DNA, 382 bp, Zea mays
  Clone ID: LIB148-059-Q1-E1-A5
aagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatc

SEQ ID NO: 7974 - DNA, 273 bp, Zea mays
  Clone ID: LIB148-059-Q1-E1-A6
gacagacgatggctgtgaatgtgagaaccatgtggtcgtcgatgcgggcacaggttgcgatggttgtggcgttggtgttcttggtgagcggcgcatggtgcagtcgtcgcacagtcggtccatgcaagaagatcacggtcatctatggcaaggactggctggacgctaaggcgacatggtatggcacgcgcacgggtgcatgtcccaactataaccgtgggggccgcagatacaatgacgtgaagaggcccttcttctttaacatgggcgcat

SEQ ID NO: 7975 - DNA, 351 bp, Zea mays
  Clone ID: LIB148-059-Q1-E1-A7
agcacgaggacgcgttgccggtcgttgctgcggagaaggagactgccgccgccgccgcaacctcgaaggaggaggaggaggtggagtcgcccaagaaaggagcggctctgtcgccggtgccggaggctatcgtcatcgccacagccgcaacctcgaaggaggaggaggaggaggtggagtcgcccaagaaagaagcggctctgtcgccggcgccggagcctatcgtcatcgccgccgccttaacctcgaaggacgatgaggaggtggaatcgcccaagaaagaagcggctctgtcgccggcgccggcgccggaggccatcgttgccgtagcagcagtggaagacgtggtgg

SEQ ID NO: 7976 - DNA, 362 bp, Zea mays
  Clone ID: LIB148-059-Q1-E1-A8
acggcgctggaggatatcccggtgagcaacaccaagcgcgtgatcctggatctcaagcccggcgctcaattccgcgagaatctgttcctgaacatcaggaagccgttcatcacgttccggtcgggccccaagaagcccgccgtcgtggtctggaacgacactgcaggcacaagcggcatcgacggcaagccggtgggcacggtggggagcgccacgctggcggtggagtcggactacttcacggcgtacggcgtggtgttccggaacgacgcgccgctggacaagcccggcgccaagggcggacaggcggtggccgtgcggctgttcgggaccatgacgcatatctacaactgcaccatcga

SEQ ID NO: 7977 - DNA, 331 bp, Zea mays
  unsure at all n locations
  Clone ID: LIB148-058-Q1-E1-H3
aactgcgactgcctccaagggttccaagtatgccactccctgggtggcggcactggttctggcatgggcacgctgctcatctccaagatccgggaggagtacccagaccgcatgatgctgaccttctccgtgttcccgtcgcccaaggtgtccgacaccgtcgtggagccctacaacgcgacgctgtccgtgcaccagctggtggagaacgccgacgagtgcatggtccttgacaacgaggcgctctatgatatttgcttccgcaccctcaaagctttcaaacccccaaaaaaaacccccccccccccnttttttttttcccccacaaaaa

SEQ ID NO: 7978 - DNA, 406 bp, Zea mays
  Clone ID: LIB148-059-Q1-E1-A9
gacccacgcgtcagcggacgcgtgggcgaggccgccgtcgcgctcaccaactgaccggaccggccggcgttccccgtcgactgtgttcgatcgctagacggggtggcacgctgcgatgactacctgtatggcgagtccctatacttactcatacataagctgcgccgccgtgtcgtccggacgcgtggggccgtgggcgagtgcggcgtggacgaggaggaggagctcgggctgagcggcggcggcggcatcggcgccggcgacgcgctgcggcggacgcttgcgcagcgcaagccgaccaaccggtacatcagctacgcggcgctgcgcgcggaccacgtgccgtgcaacaagcgcggccggtcctactacaccaactgcgcggcgcagacggccgccaacccct

SEQ ID NO: 7979 - DNA, 259 bp, Zea mays
  Clone ID: LIB148-058-Q1-E1-F6
gcggcatcctgcagatagagcgacagggtctgctgaaacataaggactgcgtcgtgtggatcactggtctacgcggttcacgtgatgtctgcaaaagctgatctcgtcagatttaattacgagcacagatacttccttttatatgtatacacctgtctgacagtctgtcagtccgtcagtcttgacttgatgagggaaaagcacactcgcgtgcgcgctgagccgcgagctgtatcgcataggccacctcacgtacgtc

SEQ ID NO: 7980 - DNA, 261 bp, Zea mays
  Clone ID: LIB148-058-Q1-E1-F7
cgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccc

SEQ ID NO: 7981 - DNA, 266 bp, Zea mays
  unsure at all n locations
  Clone ID: LIB148-058-Q1-E1-F8
ggtgtatactgatgtatgtgaagcaagaaacatcagctgcaaggtactgggcaactgcgataagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggccttagcgtgtggtgccgcgtgtgtgtatatattacacacnatgcattatacat

SEQ ID NO: 7982 - DNA, 405 bp, Zea mays
  Clone ID: LIB148-058-Q1-E1-F9
cccacgcgtccgcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggcca

SEQ ID NO: 7983 - DNA, 312 bp, Zea mays
  Clone ID: LIB148-058-Q1-E1-G1
ccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaaagtacccggtcaatcgacaaccctggcccgttgctgaacatggcaggggtgtggggaacccgggcccccggggttttttt

SEQ ID NO: 7984 - DNA, 407 bp, Zea mays
  Clone ID: LIB148-058-Q1-E1-G10
acaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcaaagtgtggccaagcctaccc

SEQ ID NO: 7985 - DNA, 404 bp, Zea mays
  Clone ID: LIB148-058-Q1-E1-G11
cggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaaggacaagtggtgc

SEQ ID NO: 7986 - DNA, 403 bp, Zea mays
  Clone ID: LIB148-058-Q1-E1-G12
gcaagtcgccttcttcccatccctctccatcaagcaaaagactgacaggaaagctaaaccccaacaatcaccatgggattcttccaaggcaagacctccaagcagaccacgagggtcaagaagcttctcggactcgccctgtcgcgcctcgccattgcacgccgtccccgccttgctcgcaggtccatctgccgtaacgatgtcggccagctcctctccctcggctacctccatcgcgctctcctccgcgcagagcaggtcatagaggaggataacatgctgcaggcgttcgacatcattgagctctgctgcaagcgactcgtcgagcacgcaacacatttagacaaaccgcgggagtgcggcgaagagataagggaggcggctgccgggatcatgtttgcag

SEQ ID NO: 7987 - DNA, 338 bp, Zea mays
  Clone ID: LIB148-058-Q1-E1-G2
cccggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaatgcacctgaggctgccaagagaactgctgcccccgctgaagcacccggggccgcgtccacccccgttgccgacgctgtcccatcatcgtcgtctaggaagtctggtccagctaccgcgcccaagcccaaccccgggggcccccccgtttcccccctttaaaaaacccccacaaaaaccccccccccc

SEQ ID NO: 7988 - DNA, 326 bp, Zea mays
  Clone ID: LIB148-058-Q1-E1-G3
acggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccaaccccgtcgccgccggctggcccatcatcgtcgtctaggaagtctggtccagctaccgcgccaggccaaaccgggcccccccttttcccctttaaaaaccccaaaaaaccccccccc

SEQ ID NO: 7989 - DNA, 334 bp, Zea mays
  Clone ID: LIB148-058-Q1-E1-G5
agcgaaaaggcgcaggcgaagccagcggggagagaaaacgggcgggatccccaccgcctcgcgcgcggcggcggcggcggcggcggcggcggcaatggaggtcacctcctccccctcgccttccgcaccgccgccggcctcctcgaagccggcgctccaactcaaccccgcggacgtcctcctccgtcgcctgccgaccccgaccccaacagcggcgacacccgtcaccgcgacggcgccccccgcgcagcccgccaccgcatccaaccccggcctttcccaacccttgggggccccccccctttttttttgggaccccccctttttccccccc

SEQ ID NO: 7990 - DNA, 63 bp, Zea mays
  Clone ID: LIB148-058-Q1-E1-G6
aaccaaaacgtgcacgagaatccagccgggagagaaaaccggcgggatccccaccacctcgtc

SEQ ID NO: 7991 - DNA, 264 bp, Zea mays
  Clone ID: LIB148-058-Q1-E1-G7
agggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgc

SEQ ID NO: 7992 - DNA, 406 bp, Zea mays
  Clone ID: LIB148-058-Q1-E1-G9
atcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcggagacaagttcgaggctgttgtgcccttcatgggtgaatctgtaactgatggaactcttgctaacttcttaaagaagcctggagacagagtcgaggccgatgaacccatagcgcagattgaaac

SEQ ID NO: 7993 - DNA, 268 bp, Zea mays
  Clone ID: LIB148-058-Q1-E1-H1
aggtgttcaacttcgtgaagctggcggagctgtactacgccgggagccacggcatggacatcaagggacccacggcgcagtccaagcacagcaaggcaaaggccgaagctgttatgtgccaaccagcgagcgcgttcctgcccgtcattgacgaggcgtaacgcgcgctgacggcgaggaccgcgccgatccccggcgcgacggtggagaacaacaagttctgcctctccgtccacttccgctgcgtccaggaggagaaatggcgcgc

SEQ ID NO: 7994 - DNA, 387 bp, Zea mays
  Clone ID: LIB148-058-Q1-E1-H11
agcgatagtctaaagaaagacgccgccatctacaactttgtgcaagagcgtcttcagaagtcagcgccatacaaaatgatcatggagctgagtgcaatggagctggaggctcaagaaatatcgttcgaggagcttctggctcgggagaaggaggacactgccttctggcagcgcaacgggaagatgagatcagtctcatccaagtaggacacaatgcccctgctacttgggctcactgacgatagcagaccttcaacatcggtagtgtctaggcatgaaaccctttggagcagctgctgcatgcctgcatcgaaccgtttggtgtaacgccgcggccttctgtcaagatcctgccctgattctgggcagattgagttgtgtcgtgat

SEQ ID NO: 7995 - DNA, 324 bp, Zea mays
  unsure at all n locations
  Clone ID: LIB148-058-Q1-E1-F5
gtgggtctcaggcgatagattgctcatgaggcaaccgaccttaagactcggcgtcttgatatattggattgcactgcatgctttgcttgctagttttatttgaactctgtaaagatgtagccatctcctggcgagtgactgtacagtactctgtgtctatagcaagttatatctaaacagaagcagtttgcactgataccgtgattcctttcgaaaatgttaccgaatacttgagccgtattggcagctgcagaaatcttcaaatgaatggccaaantttttttttttttccccaaaacccncccccccccccncttttttttt

SEQ ID NO: 7996 - DNA, 401 bp, Zea mays
  Clone ID: LIB148-058-Q1-E1-H12
acggtcggtatacggagagcgcgaagctgcgaggagcgacctgaacatggcgacgcttcttgatcctaccaggacttatccttacagatacagagcagctgtactgatggacgagggcaaagaggatgaggcgatcgcggagctgtcaggagccatagctttcaagccggacctccagctgctccacctccgcgcggcgttcttcgactccatgggcgagcgcgagagcgccctgcgggactgcgaggccgcgctctgcctggacccgacccacggcgacacattggagctgtacagcaaagcctccaccaccaatgccgaaccccagagctaggcagccagccagccggccggccggcaggccgccgctctcctcgtcgtcgattcagctgcggtttttg

SEQ ID NO: 7997 - DNA, 301 bp, Zea mays
  Clone ID: LIB148-058-Q1-E1-H2
ccggtctagccttcccgaggctgtcacgccgtcacgctccctctcccgccagccgccgcctccgccggggggcccaccccgccgggcgtcagcgcgcccgcccccgcggcgcagcagcagcagcagccgcccccgctcgcggtgctggagcgcgtgcgccgcgtcggcagcggcgcgggcgggacggtgtggatggtgcggcaccgcggcacggggcgcccctacgcgctcaaggtgctgtacgggaaccacgacgactcggtgcggcggcagatcgcgcgcgagatcgccatcctccggc

SEQ ID NO: 7998 - DNA, 328 bp, Zea mays
  unsure at all n locations
  Clone ID: LIB148-058-Q1-E1-D7
agggggcacctcgccccgaccggcctgatactgggaggcaccaagtacatggtcatccaaggcgaacctggagctgtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacaggggatgtaatgacaaccccttcccctggaatgcatgttgatgatgtttgcctgggggtttttccccccaaanaaaccccccttttttttccccccgggggggttttttt

SEQ ID NO: 7999 - DNA, 401 bp, Zea mays
  unsure at all n locations
  Clone ID: LIB148-058-Q1-E1-D9
cccacgcgtccgctgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcncgctcacccgcaacgacggcatcaa

SEQ ID NO: 8000 - DNA, 270 bp, Zea mays
  Clone ID: LIB148-058-Q1-E1-E1
agagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacac

SEQ ID NO: 8001 - DNA, 391 bp, Zea mays
  unsure at all n locations
  Clone ID: LIB148-058-Q1-E1-E10
cccacgcgtccggacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacgggacctaagccagtacanaggacatggtaattggatcgagatt

SEQ ID NO: 8002 - DNA, 401 bp, Zea mays
  Clone ID: LIB148-058-Q1-E1-E12
atcatgtctggtcgttcgtggacaataatggcgcctctcctagcgtcgatgctgctcgtcgggctcgccgcgggctccgaggaggaggaggacggcggcggcaaaaagaagccccacgtcaaccacggcaagtttaaggcggagccgtggacggacgggcacgcgacgtactacggccgggcgccacggttaaactgacacaacggacagcggcccgtgcggctacaagggcgagctggggaaagactacggcaccctgacggcggccgtgggcccgtcgctgtacaccaacggcaccgggtgcggcgcgtgctacgagctcaagggccccaagggcaccgtggtggtgacggccaccaacgaggccccgccgccggtgagcgggcagaagggcgagcact

SEQ ID NO: 8003 - DNA, 289 bp, Zea mays
  Clone ID: LIB148-058-Q1-E1-E2
actcgaagccgaaggactcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgaatggaatggccttccccccaaa

SEQ ID NO: 8004 - DNA, 268 bp, Zea mays
  Clone ID: LIB148-058-Q1-E1-E4
ggcgaaccaagccagcgcgaccagcgaggagtgcactgttgcttggggagtctgtaatcatgcttttcacttccactgcatcagcaggtggcttaagactcgtcaagtgtgcccattagataacagtgagtgggagttccagaaatatggccactagttcctgggcaccctcatgtgatgttggggcttacttctagtgactgctaccactcgagtgtatttttttctgccaaacagctccatcttttactgctttggatgcttgcat

SEQ ID NO: 8005 - DNA, 323 bp, Zea mays
  unsure at all n locations
  Clone ID: LIB148-058-Q1-E1-E5
agcgccgccggtgaccgccccacctcctccgtcgccttcttctccgccgggggcgggctcggcctcggcccctccagcctgctgctccacctgctcctcctccactccctcttatagcctccagcctcccctcgcctcccgccaccccctatggccgccgttttcttccaccacgtcgtcggcgacctcaccgtcggcaagcccgaggtcgccgagctgcacgacaccgacacgctcgacgacgccgcgcgcgccatcgccgccnagcccccggaaggggggggggcccgngcccccccggggggtttttggggggccccccc

SEQ ID NO: 8006 - DNA, 261 bp, Zea mays
  Clone ID: LIB148-058-Q1-E1-E6
ccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtca

SEQ ID NO: 8007 - DNA, 262 bp, Zea mays
  Clone ID: LIB148-058-Q1-E1-E7
cggacgcgtccgcccacgcgtccgggtggtcaagatgtactggggtgacccgagggagaaggtgtgcgacgcggtggaggagctccagatcgagtcgctcgtcatgggcagccgcggcctcggccagatccaaaggattctgctgggaagtgtgacgaactacgtgctgtccaatgcgtcatgccccgtgaccgtcgtcaagtcgaagtagtggctctggcctttcatttccagaaagatgaatctgcagctaacctatacg

SEQ ID NO: 8008 - DNA, 259 bp, Zea mays
  Clone ID: LIB148-058-Q1-E1-E8
cccacgcatcggaattcctgcatgacgtggaggtgctcaactgcatgggcaacaccagcatggtgctccgcctcggagcatgcgcggagtacggctgtctcgtatatcattacatggatcactggagcatcaacgaacggctgttatgtcggggcagcacgccacctctcgcgtgagcctagcggttcaggatcgcagctgagatcacaacagcgcagttgttccttgcacacacgaagccagagccgctggtgcaccg

SEQ ID NO: 8009 - DNA, 406 bp, Zea mays
  Clone ID: LIB148-058-Q1-E1-E9
cgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtgactcgccttaattagttcgctttg

SEQ ID NO: 8010 - DNA, 327 bp, Zea mays
  unsure at all n locations
  Clone ID: LIB148-058-Q1-E1-F1
cgtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgccggtacaaggacacgcgcgcgcaggggtacggcgtgcagacgggtggccgtgagcaacgggggttgggnttttttgggggttttttttttttggggggggggggccccc

SEQ ID NO: 8011 - DNA, 402 bp, Zea mays
  unsure at all n locations
  Clone ID: LIB148-058-Q1-E1-F10
cccacgcgtccgcgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcnaagccgggctcaaggtccaggccgtcat

SEQ ID NO: 8012 - DNA, 402 bp, Zea mays
  Clone ID: LIB148-058-Q1-E1-F11
cggacgcgtgggcgaagggcgaaggttcacatgccgcttgcttggtgtgattttagaagaaacagctccagaggagcttcagaaccatgtcacagtgaagccttccgtggtggaggttctccttgagattgcaaaattctgtgatgtgtatttgatggagcgcattcttgatgatgagagtgagggaaaggttttatcggccctgagtgaagctgggctttttggtggtggtggcttgataaaagataaggttctcttctgtagcacggagaatggccgtacatcttttgttcggcaactcgagcctgattggcatatcgacacaagtcctgaagttgttcaccaattagctaggtttatcaaatatcaactgcacatctccccgcagcgacctgaaagaat

SEQ ID NO: 8013 - DNA, 403 bp, Zea mays
  Clone ID: LIB148-058-Q1-E1-F12
gttcatggtgctatttaggcgtgaagtatcatttggagactccttatacctctgggagatgatgtgggctctagaatacgaccctgacattttcttcgcaacatgcgaagaacaaggtgcagtacataaaaataaagtttctaaatccaaactgaaaggactgcgccattttggcaagtgggataaggacaaggataaggaagatgataagaatggggctgaggacggtgaagatggtccggttccgatttcagtcttcatggttgcaagtgtcctcaaggagaagagagaaaagctgttacaagaagccagaggactggatgatcttatcaggatattgaacgatgtaaatgggaacttagatgctaagaaagcttgcgctggagcattgaaacttcacaaa

SEQ ID NO: 8014 - DNA, 328 bp, Zea mays
  unsure at all n locations
  Clone ID: LIB148-058-Q1-E1-F3
gtccggtccggttctcttcgccgcggcggcggatggccctgccgctctacggctgcaggtcctgcgctgtgcatgatgccatcatcttctgccactgctgtgacgccaggctgtgcctgcactgcgacgccgccgtgcacggggctaccgaggcgggggcgctccacccgcgcgcccggctctgcgacgcgtgcggcgccgcgccggccgcgctgcgctgcgacggcaccgtgacgctgtgcgccgtgtgcgtcggccgcggtgctcccnggcgttgggaacccccncccgggggcccaaaaaaccgcccccccccccggggggcccc

SEQ ID NO: 8015 - DNA, 261 bp, Zea mays
  Clone ID: LIB148-058-Q1-E1-D6
cgtcatctcttcgccttcgctacgcaattccgatccacgctgcgggccacttgtgacgactggcggaacccgcgagaaacagaggcgggcgagcggcgatcggagatggcgccggagaagccccggaaggaacaggaggaggagttgatgctggaggatggaggcatcgaggagagcccgcgccgcagcttcgaggactgcggcgactccgaggaggaccgcggggagggcgatgacgaggaggagcgggacagcgaccgc

SEQ ID NO: 8016 - DNA, 266 bp, Zea mays
  Clone ID: LIB148-058-Q1-E1-F4
ctgagcatcccagggacggcgacaaatggggtcgggagatccatcgtgtctgcgaatctgcgtgcttgccgttgcggcggatgggaacggggacgggatagtgcgggatctgctttggaaagtttcctaattcctagtactatgcttttacgcaaaattggtccaatttctgtatggttcctctaaaatgtgctgtccaaacggggccgtgttctatgcaatagaaatcatgctactcttaccatacttcgatggttttggcaaac

SEQ ID NO: 8017 - DNA, 167 bp, Zea mays
  Clone ID: LIB148-032-Q1-E1-A5
ctgttcctcgagcaactcaactatcgtctgctgcaactaccatgacgtcactcgacacttatatgacgaatgattcagtagcggttggaacggttgtatgctcctgaaggactggctcgctgtcgtcgaccaagaaacagaatcatcagccagacgattcaggctgc

SEQ ID NO: 8018 - DNA, 377 bp, Zea mays
  Clone ID: LIB148-032-Q1-E1-A6
cgcagatgctgctggagcacggcgacctcatcctgtcgggcgccacgtccgtgttcggcgccgcgcccgtggaggtctccgtgaaggtggccggcatccactggcactactgcagccggtcccacgccccggagctcaccgcgggctactacaacacgcggcgccacgacgggtacctcaccatcgcgcgcctcctggcgcgccacggctccgtgctcaacttcacctgcgtggagatgcgggaccacgagcagccgcaggaagcgcggtgcatgccggaggcgctggtccggcaggtgggcgccgcggcgcgcgccgccggggtgggcctcgcgggcgagaacgcgctgccgcggtacgacggcacggcgcacgac

SEQ ID NO: 8019 - DNA, 411 bp, Zea mays
  Clone ID: LIB148-032-Q1-E1-A7
cccacgcgtccgcgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcgcgagatacgatgtcgcggcggggcgccgcgacggcatgcgctcgaacatggacgacctcccgggcaacttccccgtgccgggccaccacgtgccgcgcctcaccgagctcttcagccagcgggg

SEQ ID NO: 8020 - DNA, 390 bp, Zea mays
  Clone ID: LIB148-032-Q1-E1-A8
ccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccact

SEQ ID NO: 8021 - DNA, 397 bp, Zea mays
  Clone ID: LIB148-032-Q1-E1-A9
cccacgcgtccgctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcg

SEQ ID NO: 8022 - DNA, 435 bp, Zea mays
  unsure at all n locations
  Clone ID: LIB148-032-Q1-E1-B1
gcggtcaggggtccacggacgcgtcaggctggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcangggtacggcgtgcagacggtggccgtgagcacggtgctgttcggtgacggcacggcctgcggcgggtgctacgaggtgcggtgcgtggacagccctagcgggtgcaagcccgacgcggcggcactggtggtgacggtgaccgacctgtgcccgcccaag

SEQ ID NO: 8023 - DNA, 355 bp, Zea mays
  Clone ID: LIB148-032-Q1-E1-B10
accctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcg

SEQ ID NO: 8024 - DNA, 398 bp, Zea mays
  Clone ID: LIB148-032-Q1-E1-B11
cggacgcgtggcggacgcgtgggctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagacatttttcgagtccaggaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacg

SEQ ID NO: 8025 - DNA, 382 bp, Zea mays
  Clone ID: LIB148-032-Q1-E1-B12
acgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctg

SEQ ID NO: 8026 - DNA, 189 bp, Zea mays
  Clone ID: LIB148-032-Q1-E1-B3
ccggtcaagaatctacggacgcatccagaacctaataacaaaggttataggaacaacaactattggagcagtgataacaataacagcaacaatgcctggagtaacaacagcaattttaacaacaataatgactggagtggtaacaattcctataacagcagtactgagaacggtaatagcagctacaac

SEQ ID NO: 8027 - DNA, 418 bp, Zea mays
  unsure at all n locations
  Clone ID: LIB148-032-Q1-E1-B4
gccaactcgggtgcagcatgctgctgatgacgccgatctgcagggccttccggtggccatcaagcagctggaccgcaatggcttccagggcaacaacgagttcatggtggaggtgctcatgctcagcatgctgcaccaccccaacctcgtcagcctcgtcggttactgcgccgagggcgagcagcgcctgctcgtctacgagtacatggcactagggtccctcgaggaccacctgttattgctgcgtgacgatggccatggcagccctttgccctggcgcacgaggatgaagatcgcgctcggcgcggcgcggggcttagagtacctgcacgaaagcgctgtcatctaccgggacctcaagtcctccaacatcctcctcgnacaagactacgcgcccaagctctctgacttcggcctc

SEQ ID NO: 8028 - DNA, 228 bp, Zea mays
  Clone ID: LIB148-032-Q1-E1-B5
gacaaatattcagggctctgttatctatcatctgctagattttttaggaggatccctcacatggcaggaccttaaagctggcactgaggaagatgtctacgtatccgattagtgacaaggagtatgcttacctcggcacacattctgtgcagatcatacacgacggagttcgtctcatatttccactattgtcgctccctgcaatttgtatacatgccagattactct

SEQ ID NO: 8029 - DNA, 400 bp, Zea mays
  Clone ID: LIB148-032-Q1-E1-B6
ggaaaccagagctcctgactgttcctctctccctcctcacgggcgggctccgtctgttccgtccatccaccgccccggtcgtctcccggccagatccctctcctgcaaggtttctttgcggtatggtcggttctctgtggtttctcttctgaatgtgctggtgcggtgatgttgttttgatttgtgttcgctttggcggatctggtcgcgcacagagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggagagatttgga

SEQ ID NO: 8030 - DNA, 371 bp, Zea mays
  Clone ID: LIB148-032-Q1-E1-B7
aggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgattacgtatttgactggactgcactcaagtaccctcaaatgggctccaacaacaagcttgttcaacagaccaagtgcaagaatggctggag

SEQ ID NO: 8031 - DNA, 408 bp, Zea mays
  Clone ID: LIB148-032-Q1-E1-B8
ctgcttcgcaaacggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctgggacggcgcgactcgctcgtgtccaaccgcgaggacgccgacaacctgccgggcccggacatcgcggtgcccaagctcatcgacgagttcgacaagcagggcttcaacgtcgaggagatggtcgcgatgctgggcggcggccacagcatcggcgtctgcaggtgcttcttcatcga

SEQ ID NO: 8032 - DNA, 447 bp, Zea mays
  Clone ID: LIB148-032-Q1-E1-A3
cggtcagggattcacgggtccatccactcctgacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtgactcgccttaattagttcgctttgcttttgaggttgactcgaccattttgctgtagcgtgaattgcatggacatg

SEQ ID NO: 8033 - DNA, 259 bp, Zea mays
  Clone ID: LIB148-032-Q1-E1-B9
actcgcgggccgatgcaagcctctacagtgactcgtattgactgcgacgcgtccatcctgatcgacccgatgtcgaaccaggcctccgagaaggacgccggccccaacgtctccgtgaagggctacgacgtggtcgaggagatgaagacggagctggggaggaggtgcccgcgcatagagtcgtgcgcggacatcatcgcggtgagcggcgtcgtacgctgtgaggcacacgggccgtcgcgagtaggctttgtccctg

SEQ ID NO: 8034 - DNA, 241 bp, Zea mays
  Clone ID: LIB148-032-Q1-E1-C1
acggacgcgtccaggcagcagccccgtctgcctgcaggactacgcggccggcgagcgcgctcgggagatgccctgcacgcacacgttccactccaattgcatcgttccgtggctcgagatgcacagctcctgccctgtctgccggttccagctgccggccaccgactacaaaggctcatgcagcagcggtgacggtggttttgtcagtgtcgatgcggatggtgaaggcaatgacaacggc

SEQ ID NO: 8035 - DNA, 304 bp, Zea mays
  Clone ID: LIB148-031-Q1-E1-E9
agaaaaaaataaaaaaaaaaaaaatataaataaaaaatggcggccgcactaaaaagatataagcttaaatactcttacataacaactctatagctcttcaataatatcaccggggattgggttcaattggcggtcgaaaaacaccgtctttaatcgggaaaatactcttcgttaacatatttaatcacctttcaacacgaccccctttcaacagctagcgtcataattttaaagcccgcacctatcaaacttcccagcattttctcagtctgactcttcaaagtgatgccccctttcacagcct

SEQ ID NO: 8036 - DNA, 322 bp, Zea mays
  Clone ID: LIB148-031-Q1-E1-F11
ccatgccagcggcgggggagacagaggaggcagaatgagattctagggagttaagggaggcgaccgccatgggggactccagcgacggggtggcggtcgacgtcgagcggatcttctttggcggcaaggggcatcgagtgaggacgaggcacggccctctatcggtttctgtatacggagacgaggacaagcccgcgctcgtaacttatccggatttagccttgaatcacatgtcttgcttccaaggattgttcttctgtccagaggccgcgtcgttgttgcttcacaatttctgtgtgtaccacatcacacctcaagggca

SEQ ID NO: 8037 - DNA, 335 bp, Zea mays
  Clone ID: LIB148-031-Q1-E1-F12
aataacacagttgagcgcgacgatgggatccctcgctaataacatcaaggtcgtgggtgtcgtccttgcagcgctcgtcgccggcgggtcgggcaggcccccgaaggtgccgcccagtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggaccgcaagggctgcggctcatgctacgaggtgagatgcaaggaaa

SEQ ID NO: 8038 - DNA, 124 bp, Zea mays
  Clone ID: LIB148-031-Q1-E1-F6
aggttctagatcgcgatctgccgccctttttttttttcctttctttttttttttttttaattttcttttttttttttttttttttttttctatattcattgggttggtgccatttccacccttt

SEQ ID NO: 8039 - DNA, 353 bp, Zea mays
  Clone ID: LIB148-031-Q1-E1-F8
aggttggatctggctcatgtttcctggcttcttgcttggctctactatcttcatgctatggaacaaacactataggcatgggcgctcggtaggagcgtttgagatgagaactcctcctcgaagaagaaccgtggaacagctcttagctctgcaacaggccatctcgcagctggaagcgcacgtgcaagcaggaaacatttttctcctgaagctccggtccctcatgcttgcagcgtttcctcagagcaccaacagagttgcagctgcactggttgctgtggctgcgatattcacgttcgtgcccttgaggaccatcgttctactaatccttctagaagaatacacaagacaga

SEQ ID NO: 8040 - DNA, 368 bp, Zea mays
  Clone ID: LIB148-031-Q1-E1-F9
aatggctagggagagatagttccgagcgccaccaccgcgaagaggagagaggagggtagccaccatggttgaatcacgtgtacgacgccatagagacctcaatgattggtctaggtgcttcgccatcatgtatagagcgtgagcgcggagttgttgggggcggatcaaccgaaacaccatggattcttcgccggagtctgatcctcaccgccgagccgctatttgctatggagagccctccccccaccgatccattatgtgacgagcaagtgactgaggaacccggagctctgcaggtggaagactttaaggaggagctcgcagaagaacatgaagaaccatctgggaaaacagtgctaccacaaggg

SEQ ID NO: 8041 - DNA, 377 bp, Zea mays
  Clone ID: LIB148-031-Q1-E1-G11
agggagacctggtgtggagcaagaaccagtgccagcattcttacaattgcaagatcctcccgaatagcttggtgctggattttgtgacgaacgtccagatccgcggcggcacgcggctcaacagcaagttcaaaaacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtccgcgacgactgcatctccatcggccccgggagcaagatgatccgcatccatggcgtcaagtgcggcccatgccacggcatcagcctcggcagcctggggcccctc

SEQ ID NO: 8042 - DNA, 328 bp, Zea mays
  Clone ID: LIB148-031-Q1-E1-G6
aggtgggcgaacagaccccagccagtcgatcgttcaagaaaaataccagcttaccaacaacagcagcagcaagcccacccgttcgacgacatggcccgcctcggggccggcgccgtgttggcgctcctagtggcggtcgccgcggtggccgcgttcctcgcggtgccggcctcggcgaagtccggggagctgagcgcgatggggttgctggcggcgaagggcggcagcggcgcgggcccgcagaactgctcgggcgcggtgggcgagtgcgacgtggacgatgcggaggagctcgggctgagcggcggcggcctcggctccgactacg

SEQ ID NO: 8043 - DNA, 360 bp, Zea mays
  Clone ID: LIB148-031-Q1-E1-G9
cgcacgcgtctatatctatacacatatatagacctaataagaacaaagacgtacgataacctgcttattttgcgacccatcccgttcccacgcaaaggcgccgagcgtgatctccgtcggtgccgggatggcctcgcaccgggaactgctgctgctgctcctcgccgccgcgctcgtcgctgcgctggcctctgtcgcatccgccgacgacgccaacgccatgcccaccatcctgacccccgtggcgcataccccgctggggtccttcgacggcgacaagccggcctctgacgatgacgccgtcgacgacgacgaggacgccgcccctgtcggcgcgcccaacggggccaccatgactga

SEQ ID NO: 8044 - DNA, 394 bp, Zea mays
  Clone ID: LIB148-031-Q1-E1-H11
ctcacgggtcgacacacgcctctacctcgactccgtctcactcaccccgccttcacgcctccctcaccaaataaggtcccgcccttttccgacattcacaggggggacaggaaatcagcggccatggcctcgattcgggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctca

SEQ ID NO: 8045 - DNA, 366 bp, Zea mays
  Clone ID: LIB148-031-Q1-E1-H12
cctatactgaatcgtatgacgtaggactgcgtctcactatcgaccaccgcgccgctccggttaaattacacctcgaccggccagcgcaattctgtggctcgatcgatcgtgggggtcggtgaagcaagtgagcaagctatatatatatagaggagattcttcgagcgagctagtagctagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcagaggcgcccaagctgattgatgtgcaaggc

SEQ ID NO: 8046 - DNA, 336 bp, Zea mays
  Clone ID: LIB148-031-Q1-E1-H7
agcgacaagatggcatgctcaaacaatgcgatgagagccttgttcctcctggtcctcttctgcatcgtgcatggtgagaaggaagagtcaaagggcatcgatgcgaaggcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaac

SEQ ID NO: 8047 - DNA, 392 bp, Zea mays
  Clone ID: LIB148-031-Q1-E1-H8
aacgtcagctggcaagtgtttacaagggagaagcagagaagatccttatggtgaataaagcggaggcagaagcagaggcgaaatatctttctggtgtcggtatcgctaggcagcggcaggcgataaccgacggccttagagagaacatcctgaacttctcacactcggtgtcgggcaccagcgcgaaggaggtcatggacctgatcatggtcacgcagtacttcgacaccatcaaggagctcggggacggctccaagaacaccacgatcttcataccccacggaccaggccacgtgaaggacatcagcgagcagatccgcgacggcatgatgcaggcctcaagcagcaacgtgtaaatcaccgactctctgcacgattggagacggctcggc

SEQ ID NO: 8048 - DNA, 347 bp, Zea mays
  Clone ID: LIB148-031-Q1-E1-H9
aggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggag

SEQ ID NO: 8049 - DNA, 395 bp, Zea mays
  Clone ID: LIB148-032-Q1-E1-A10
gggacgtaagaagtcgtctaattcttggatcgaattagacgacttcttcggcactctcttcattagcacgctaacttgtaatctgcaggatctaagcaaagacttgatttagttatggacggattggtatgcctcttgaaagttcgcgtggtccggggtatcaaacttgcctaccgcgacacatgaggcagcgatccgtatgtcgtcctacggattggcaagaagaaactgaagacaacgcgtgaaaaagagatccgtgaaccccatatggcaagaggagctaagtctgaccgtcacatatcccagccaaccactgaagctggaggtgttcgacaaggacaccttcaacacacacgaccccatgggagacgcggaagtggacgtggcgccactga

SEQ ID NO: 8050 - DNA, 397 bp, Zea mays
  unsure at all n locations
  Clone ID: LIB148-032-Q1-E1-A11
cggacgcgtgggttccgccaccaccccccctctctctctctcttcttcttcttcaatcctccctccccgcgccggagttggaggagggagaggggacaagctttccggcgccgacgccgacgcggacccggcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcagtgacccagatcgtcttcccaacgagttgggcagtatgagcataaaggacgacaaggacgttgaagatantgttgtcaatgggcaatggggcggagcctggtcatatca

SEQ ID NO: 8051 - DNA, 344 bp, Zea mays
  unsure at all n locations
  Clone ID: LIB148-031-Q1-E1-E8
agagggtcagcaagggcgcccccgagcagatcatcgagctgtgccggatgagcaaggatgccgagaagaagatccatgccctcatcgacggctacgccgaccgcggcggccgctccctgggcgtgtcgtaccagctggtccccgagaagagcaaggagagcgccggcgagccgtggcagttcatcggtctcctcccgctgttcgacccgccgcggcacgacagcgcggagaccatccgccgcgcgctccacctgggcgtgaacgtgaagatgatcaccggcgaccagctggccatcggcaatgagacggcgcggcgcctgngcatgggcagcaacatgtacccg

SEQ ID NO: 8052 - DNA, 339 bp, Zea mays
  Clone ID: LIB148-031-Q1-E1-C7
aggtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaagtgcggtgcgtggacaagccc

SEQ ID NO: 8053 - DNA, 330 bp, Zea mays
  Clone ID: LIB148-031-Q1-E1-C8
agcgcttccgctccacaggatcctctgcgccacccacaaccgtgcgaccgtccgtgctgccggcgaccccgatccgccgacccgtcccgtcccaccacacccgagcggggctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgctcgcatggcctcgtggc

SEQ ID NO: 8054 - DNA, 375 bp, Zea mays
  Clone ID: LIB148-031-Q1-E1-C9
acgtcataccgccgggcaactacctgacgggcgggctggagctgaagggcccctgcaagtcctccatcatcatccgtctcgacggcaacctgctcggcaccggcgaccggcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgaccgtc

SEQ ID NO: 8055 - DNA, 376 bp, Zea mays
  Clone ID: LIB148-031-Q1-E1-D10
gcgtccactcctaaactaatatttggagctacggagtataccactgcaatcgatatctggtctgttggctgtgtagtggctgagcttctgattggtcagcctttgtttcctggggaaagtggtgttgatcaactggtggaaatcataaagattttgggtactccaacaagagaggaaatcaggtgcatgaatccaaattattctgaattcaagttccctcagataaaagcccatccatggcacaagctttttggtaagcgcatgccacctgaagctgttgatctcgtgtcaaggctacttcagtactcaccaaacctgcgctgcactgctgttgatgcttgtgcccatccattcttttatgagcctgcggaaccca

SEQ ID NO: 8056 - DNA, 342 bp, Zea mays
  Clone ID: LIB148-031-Q1-E1-D11
acccacacgtccggtccttcatcttctcaccagcctcctccgacacgtaaattgcaccgatcgagacacagggaacaaaggcaacagccatggcgggaacccgtgcccggtacctcctcgtcgcggctgtcgcagcgctcttagccacgcctgcggccgtggacgcggccacgctggcggagatctgcaggggaaccgcgttccccgacatctgcaccagcacggtggggagcgaggcgcagagcgccggggtgttggacgccatggcggtgttgcggatgcaggtggacgcgttcaacaagcgcaccgaggcggcgagggcgcacgtcaaggaagccgccg

SEQ ID NO: 8057 - DNA, 339 bp, Zea mays
  Clone ID: LIB148-031-Q1-E1-D3
aagcggaagcggcggcggcgcgggggcccggccgaacgtcgtcacggtggcgatcctgatgtcggcgtgcgcgaagctgaggaggccggcgcccgggcgggaggtccacgggtacgcggcccggaacgtggccgcgctcgacctccacgcgctcaacgcgctggtgcacatgtacggcaggtgcgggcggctcagggacgcgaggacggcgttcgccggcatcggggccggcgcgaggaacgccgtgtcgtggacggccatgatcgacgcgtgccgcgagaacgggcgccccgcggaggcgctgggggtgttcgaggagatgcgtcggctcgctggcgc

SEQ ID NO: 8058 - DNA, 349 bp, Zea mays
  Clone ID: LIB148-031-Q1-E1-D4
gggtcgagcacgcgtccgcccaagcgtccgtgatcctcaaggcgtggaagaacgcgtgcgatgcgactgtggtacagaagatcgtcatcccgccgggcaactacctgacgggcgggctggagctgaagggcccctgcaagtcctccatcatcatccgtctcgactgcaacctgctcggcaccggcgacctcagcgcgtaccataggaactggatcgagatcgagaacgtcgagaacctgtccatcaacggccacggcaccatctaccggcagggagccctggtgtggagcaagaaccagtgccagcattcttacaattgcaagatcctcgcgaatagcttggtgctgga

SEQ ID NO: 8059 - DNA, 291 bp, Zea mays
  Clone ID: LIB148-031-Q1-E1-D5
taatggttaaggcttcagagtagaacatccacgtaatgggttagatcaaaatcaggggcaaatttctggcttggttaaaaaaatccactagactgtaggagagggataaagggttacgtcatgatagaaaacctcaggatgagcaattgaacagtgagaggtgaaggccagatagtgatggggggaaagggttcggggattttatcagccgggaccatgtttcggtctattcttaatataatacagggagggaggtatttagataaaaggatgagtttctgtttgataaaa

SEQ ID NO: 8060 - DNA, 369 bp, Zea mays
  Clone ID: LIB148-031-Q1-E1-D6
agcgtggatgccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacact

SEQ ID NO: 8061 - DNA, 326 bp, Zea mays
  Clone ID: LIB148-031-Q1-E1-D7
agcccacgcgtccggtttccggcgttgcgccaccgttcccgcgtgttgcgttgattcctcgggtcgaaccaacgcgcggcgcggggtcccggtcgcggccatggcgcggctgccgcccaagatccccaccgtagcgccggcgtggccggagttcgggggcgggcaccaacagcagcgcagcccctccgtgggcacgttcctcgccgccgcgcccatgcagccgtcgtgggtggacgagttcctcgacttctccgccgccaagcgcggcgcgcaccgccgctccgtcagcgactccgtggccttcctcgagcccgaacccggccccg

SEQ ID NO: 8062 - DNA, 387 bp, Zea mays
  Clone ID: LIB148-031-Q1-E1-D8
aggagctcctcgggaatccggtgccaggcctcgccttctcgcggcggtgctccctccctcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccgggcacagcagcagctgcaacaacaacaacaac

SEQ ID NO: 8063 - DNA, 370 bp, Zea mays
  Clone ID: LIB148-031-Q1-E1-D9
aggcctttttaccgtgcttgtccgttcgattccgaggtttgacaatgagctgcttgatgacacaatcagaaatttctttgttaactatcacggatcaagttatctgtcgcatcaaatgatctttcgcaagggacattttcagaagtttgtggatagagcagagagggcttacaggagatttgtaagggtaagactctccgtatctgagcggaatgggagatctagcatgtccaggtgtggtgtctgtggtgtaagagcttcctcatttcagctttaccgcaacaagttcatcgaggccaagaagtcagacctcactaatccggaagtagtggaagctcaaaagaactgtcccggtgccttagtgttcttc

SEQ ID NO: 8064 - DNA, 315 bp, Zea mays
  Clone ID: LIB148-031-Q1-E1-E10
aacatgcagtcatctcctccatcaccaccaccaagctcaacaacagccagctcgcgaaaataatgaagagccgcagcatggcatcatcggccgcgctcttggtgcgagccggcgcgctagtggcggccacagccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtaaggcagga

SEQ ID NO: 8065 - DNA, 390 bp, Zea mays
  unsure at all n locations
  Clone ID: LIB148-031-Q1-E1-E11
acccacacgtccgcatgaacaagttcaagaagaaggcgctgggcgtggtggcgcggaacctgccggtggaggagctggacaagtacgtgcagatgttccacctcatggagaaggaccacaacggcaacctcacgctggaggagctcatggacggcctccacatcaacggccagcccgtgccggagtcggagatcaggatgctgctcgaggccgccgacacggacggcaacggcaccctggactgcgacgagttcgtgacggtgtccctgcacctcaagaagatgagcaacgacgagtacctggcgtcggcgttcaggtacttcgacaaggacggcagcggcttcatcgagcccgangagctgcnggatgaactgggccccaacgaacaag

SEQ ID NO: 8066 - DNA, 359 bp, Zea mays
  Clone ID: LIB148-031-Q1-E1-E12
attgacatgttggcctggtggcgtgttgtcgttgattgagctcgaggatgatgaaatgggggctcagcagcggcacgcccgcggattcctactacgaggtacggtcagattgggcggacggtgtgcccaagatcaagttcaagatcaaggctggcaaaacattaagtgctcggaaatggcaagctgcatttagtcccgatggctgtcttgatattgcctcagtcctaagccggatacacagaggaagtgtccatccgacagtcagaggagaggtctgggaattcttacttggttgtttcgatcccagaagtacctttgatgaaagggaagagatacgcaaatacggaggatacaatatg

SEQ ID NO: 8067 - DNA, 331 bp, Zea mays
  Clone ID: LIB148-031-Q1-E1-E5
agggttcgtggatggctgcgccacgacctctcctgctgtcgctgctggtcgccgtgctagcggtggccgccgatgtcgccaacgccggccacgccaagccccggacgcgtggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaagtgcggtg

SEQ ID NO: 8068 - DNA, 386 bp, Zea mays
  Clone ID: LIB148-031-Q1-E1-E6
agcagtgccccaatggacacacgctgtgttccacatgcaaggccagagtacacaaccgttgccctacctgcaggcaagagctgggcgacatcaggtgcctggcgctggagaaagtcgccgagtctctggagctcccctgcaggtactactcgctggggtgccccgagatcatgccttactacagcaagataaagcactaggcgcagtgcggcctgagaccgtacaactgcccctacgccggctccgagtgcggcgcggccggcgacatcccttccctcgtctcccacctgagggacgaccacaacgtggacatgcacagcggctgcaccttcaatcacagatacgtgaaatccaaccccccgggaggtggaaaaagccaacttgaa

SEQ ID NO: 8069 - DNA, 333 bp, Zea mays
  Clone ID: LIB148-031-Q1-E1-C6
cctaaacacaagaacccagatgcataataaaaggtgaaagctagcagaagaggtacctaactctaccctactatagagaaaaagtcagcacattgcaagcagtaatggtggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgagggaggcgtacaggcccgacccgtacaacgtcaccaacagcttcaacgccgccgtccacagagctgtcagca

SEQ ID NO: 8070 - DNA, 316 bp, Zea mays
  Clone ID: LIB148-031-Q1-E1-E7
aggccggagcaaaaagcttgtgcgtctggctgtctccggccggccgggcttgtcgtacgtcctccaatccgttgacggtcaggccctctagcttttgctcggtgttctggagacagagcgagagagagagagagagagagaggtagacggagatggagtgcctgctggggctgctcaaggtgcgggtggtgcgaggagtgcacctggcaatctgcgacccgctcacccacagcagcgacccctacgtcgtcctccgccacggaaagcagaaagtgaaatcaagtataaaataccgcacgatcaacccagaatggaa

SEQ ID NO: 8071 - DNA, 210 bp, Zea mays
  Clone ID: LIB148-058-Q1-E1-B9
acaagcctctacactgagtcgtattaagcaatagaacacccttccgtgtgcatcgctcctccgtccacacctccctggtcagtcgtatacgaggatcatgccggctaacgtggacgccgcggcccagtaccggtaggaggttgcccttagcagcgttcccggcgtccagagagtgccggtgtgcagtggactgttcggtcatcgaggccc

SEQ ID NO: 8072 - DNA, 335 bp, Zea mays
  unsure at all n locations
  Clone ID: LIB148-058-Q1-E1-C1
agcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcgggccgnttccggnccccccggggaaaggggcccccccccccccgggggaaaaaaaccccccccc

SEQ ID NO: 8073 - DNA, 183 bp, Zea mays
  Clone ID: LIB148-058-Q1-E1-C10
cgcctctaatgtgacttgtactgcccttgcgctgttgtggaaggcgtctccgcttacgatctttgtcatgctgatcttggcgccttggctgggacctcctgccctcgtggtgttcaggtggatcatcatcacgcagctgcgctgtctgcggcgtcggctgtgttcggttgctttcttcagtgg

SEQ ID NO: 8074 - DNA, 409 bp, Zea mays
  Clone ID: LIB148-058-Q1-E1-C11
atcttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcagggggagca

SEQ ID NO: 8075 - DNA, 406 bp, Zea mays
  Clone ID: LIB148-058-Q1-E1-C12
agaaacaggcacacaagaacaaatacctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcag

SEQ ID NO: 8076 - DNA, 269 bp, Zea mays
  Clone ID: LIB148-058-Q1-E1-C2
actcgcctcctccattgaccaacaattaagcctccccgaccgccacatctattaagtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaggagccagcatccaccattgagcc

SEQ ID NO: 8077 - DNA, 285 bp, Zea mays
  Clone ID: LIB148-058-Q1-E1-C3
ccgacccgcccgtccacccgagtatcattccaaggcgacaaaagtggcagtgccccctaaggatgacgatgatgagagcggtgaagaatatgaagaggaagagcgtgataacaccttatgtggatcatgtggaacaaatgacggcaaggacgaattctggatctgttgtgatagttgtgagcggtggtaccatgggaagtgtgtcaagatcactcctgcacgtgctgagcacatcaagcactacaaatgcccagattgcaacaacaagagggcaagagcctagcg

SEQ ID NO: 8078 - DNA, 231 bp, Zea mays
  Clone ID: LIB148-058-Q1-E1-C4
acccacccctcaacacggcgcacccttcaggcgagacagcagtccgactcgcccccaacgaccacgatgagcacagcggtgagcccgatcaacaggaagagcgaggcaataccttatgtggatcacgtgggacacatgcccgacaggacaagttccggctcagacgagatacttctgagctgtggtagcatgggaacatgcgtcaagatcacatccggcacgtgcgacagc

SEQ ID NO: 8079 - DNA, 264 bp, Zea mays
  Clone ID: LIB148-058-Q1-E1-C5
catatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctc

SEQ ID NO: 8080 - DNA, 267 bp, Zea mays
  Clone ID: LIB148-058-Q1-E1-C6
agctcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgctttgac

SEQ ID NO: 8081 - DNA, 267 bp, Zea mays
  Clone ID: LIB148-058-Q1-E1-C7
agcagggaatcggtggtctcgaggcttcgtgagctcctgtcagacgcggcggtcgggagcaatccgattctccgggtgatggccggcaccgtcttcatgcacgaacgcgattacgccgaggctctcaagcacaccaactccggtggcagcatggagctgcttgcgctgaatgttcagatataccttcaaatgaacaggacggaccacgcagagaagcagctcagggtgatgcagcagctggacgaagaccacacgctgacgcagctc

SEQ ID NO: 8082 - DNA, 259 bp, Zea mays
  Clone ID: LIB148-058-Q1-E1-C8
aggtggaaactggaccgcccttgcgctgatgtggaagacaactccgattacgatatttttcttgttgacattgatgcctttgctggacccccctggcctcttgttgttcaattggaacttcagaaacagctgcgctgttatcatctctgcattgttcggtttccttcttcagtggtctggtgctttggcactcggcgcgacgtcagctttgtctcatgttgtgctgggccaattcaaaacgatcgtcatcatgctctcc

SEQ ID NO: 8083 - DNA, 403 bp, Zea mays
  Clone ID: LIB148-058-Q1-E1-C9
cggacgcgtgggcggacgcgtgggcgtcgacgccggcctctctcctcacccgctcggacagtcggagcccggcggccggagggcgacgtcgtccctaatagatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccatggcgccgtcctactccgtgagcaacatgtccgtctcgcagttcgacttcagcacctccgacctgacgctgtacgtcaagctcaccgcctccgtgcgcgccgagaaccccaac

SEQ ID NO: 8084 - DNA, 272 bp, Zea mays
  Clone ID: LIB148-058-Q1-E1-D1
cccacgcgtccgggccgcccttttttttttttttttttatcaatcatcaatcacattgttaaatatatcacatacattttttattattacattgcatgtacgtgacattgttgtagaatagaagagaagtatttccccttccaaacaaacagaaaagaagggaaaacgaagttcgtaatcgtagtatcgaacacacaatcatgtttccctttcctcgatcctctcttcttcccaaaccgagaggtgaaccagcagcctccaataaaaggcca

SEQ ID NO: 8085 - DNA, 405 bp, Zea mays
  Clone ID: LIB148-058-Q1-E1-D10
cggacgcgtgggggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccggga

SEQ ID NO: 8086 - DNA, 406 bp, Zea mays
  Clone ID: LIB148-058-Q1-E1-D11
cgagaatgccacgagcagctcatctgtggagaagagctacgagctgcctgatggtcaggtgatcaccattggggcagagaggttcagatgccctgaggtcctcttccagccttccttcattggtatggaagctcctgacatccatgagaccacctacaactccatcatgaagtgcgatgtctacatcacgaaggacttgtatggtaacattgtgctcagtggtggcacgaccatgttccctggtattgcggaccgtatgagcaaggatatcactgcccttgcgccgagcagcatgaatatcaaggtggtggcaccgcctgagaggacatacagtgtctggataggacgatcgatccttgcctcgctgagcaccttccaacagatgtggatctcaaacgctgagtat

SEQ ID NO: 8087 - DNA, 260 bp, Zea mays
  Clone ID: LIB148-058-Q1-E1-B8
gcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcgg

SEQ ID NO: 8088 - DNA, 307 bp, Zea mays
  Clone ID: LIB148-058-Q1-E1-D12
ctcgcgggtcgacacaagcgtctaaagggagtcgtattaaagagcaagtgtgatcatccgttgatacatcttgctaagaaacctgcgtgcccttcgttcacgtcgcgataccgacgacgctctcttcggctccggcaaaccacatcatgtcgcgacggagatgaagaatgtcacctgcgccgtcttcagcagggccgcctacgccaccgtggtccacgccgccgatgctacggctcccaccactacgagcaccacctcggccgcattacaggccgtcggctctgtgcagggagatacagtgctctcc

SEQ ID NO: 8089 - DNA, 267 bp, Zea mays
  Clone ID: LIB148-058-Q1-E1-D2
agcgtcgccgagccatgacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccg

SEQ ID NO: 8090 - DNA, 273 bp, Zea mays
  Clone ID: LIB148-058-Q1-E1-D3
acaccgacaccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacaggggctgatggt

SEQ ID NO: 8091 - DNA, 268 bp, Zea mays
  Clone ID: LIB148-058-Q1-E1-A11
cccacgcgtccgcccacgcgtccggcaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctcatgcattccgatatggtgccggagttaaaaaaatgtaaatcaatgtgcaaactcaaatgacatcttaacc

SEQ ID NO: 8092 - DNA, 374 bp, Zea mays
  Clone ID: LIB148-058-Q1-E1-A12
aaagtgacgtacctactagcacgtgtggtaatgcgttgatacagcatgctaataaccctgagtgcacgtcgtgctcgtctcgatggcgacgacgctcctctcggttccggaataccatatcaggtcgcaatgggcatgtgcacagtcgcctgcacggtcatcacagcagccgccacggccacagtggtcctcgttcgcgaaggcacgtgcgcatagggtgacgagctcctcctcgggtacgtcaacgggcgtcggcacattactgggtacctccgtgctcaccttcttcgcctactacctgcagtaaaattaaaggagggtcagatggagatgctgctggctgccagtgcctgtattcggttggattccgttta

SEQ ID NO: 8093 - DNA, 269 bp, Zea mays
  Clone ID: LIB148-058-Q1-E1-A2
agagtgcgtgcgtgcagccacaggcacgcgtcggcaccatgtcgtctttcaccggcaagcacgacaagtgcgcggagtgcgacgagaccgtccacttcatcgacctcctcacggccgacggcgtcacctagcataagacatgcttcaagtgcagccactgcagagggatcctcgcgatgtgcagctactcgtccatggacggtgtgctgtactgcatgacccacttcgagcagctcttcatggagaccgggagcttctccaagaacttc

SEQ ID NO: 8094 - DNA, 271 bp, Zea mays
  Clone ID: LIB148-058-Q1-E1-A3
gggggacgcttcccttgccacatccggcaagtcggtcaagtccctgtgcgcgcccaccctatacaaggagtcgtgcgagaagacactgtcccaggccaccaatgggacctagaaccccaacgaggtgttccacaacgtggccaaggtggcgctggagtcggtccacacggcggtcgagcagtccaagtcaatcggcgatgccaatgccagcgactccatgaccgagagcgcgcgcgatgactgcaagatgctcctggaggacgccgccgac

SEQ ID NO: 8095 - DNA, 298 bp, Zea mays
  Clone ID: LIB148-058-Q1-E1-A4
acccaatccgaccaaaccggcagagccggggggcggcgatggcgctgcgacgggcgctcctcagatcggcagagatctctttcgaacgcaagtagccgggagattcggaatcccgcgcgcgagttgggcctagccagctggcgtcgtagccgcactctgggaggcatgtgggttcgagccgcggagggtaggggtaggggcgggtttcagttgttggcctgttgctgtatttcgcgtggtgatggaatttaatctcttccggggcgacgggcatggttttaagggaaaatttttgggg

SEQ ID NO: 8096 - DNA, 256 bp, Zea mays
  Clone ID: LIB148-058-Q1-E1-A5
agcaatatctcctccctctccctcacggatgcaatcgccatcgcagcgaaatagacatgtctgatcgggcacagatgtcgtggcacgcatacgtcggcgaccacctgatgtgcgagatcgacggccagtacctcgcggcggaggacatcgtcggccacgacggtgccacctgcgcgcataacagagcagttccccgagttcaagaccgatgacatggccaacatcatgaatgacttcgacgagcctatgcacctcg

SEQ ID NO: 8097 - DNA, 266 bp, Zea mays
  Clone ID: LIB148-058-Q1-E1-A6
ggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctggctgat

SEQ ID NO: 8098 - DNA, 269 bp, Zea mays
  Clone ID: LIB148-058-Q1-E1-A7
gaaacggaaggagcatagggaggagggcaacgagggcgacgggttctacggcggcataaggaagctccgcggcaacgatgacatctccaagtggaggcagctgtggccaacagacgtcctggagtaagcaggaaccgcatcccttctcacaccgacattgatccatcgctcaaatgacacgcctttctttcatcatcatattgaccaaattcgtcgtctctgtcgcgctgttgtaaacgggttagtagaagaacaaatcccgttagctg

SEQ ID NO: 8099 - DNA, 261 bp, Zea mays
  Clone ID: LIB148-058-Q1-E1-A8
gccggatccccgtgagagtccccacccacaccccgagggcggcgtcgggtcgtcggggacagctgatttcacacgacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggc

SEQ ID NO: 8100 - DNA, 407 bp, Zea mays
  Clone ID: LIB148-058-Q1-E1-A9
acggacgcgtgggcggacgcgtgggcggacgcgtgggcggacgcgtggggtccgtggagagcggcaagttctggttcccggctcaggtctacaaccgcgagcatgggcatgttgggttcatgatgtcatgctatgatgcagcgctcagttacgatttccatacggacacattccgtgcaaggtacccaccacacggtcgacgaaccgtggtgttggaggatggcgtgcaatgggacagggtgagggcaccgcctgttgacacccttgcgcatgacctgcacacctctgactgcctgcatgagctccggcccggcgaccacatcgagattcagtggagaaggaacaaagaattcccatacggctggtggtatggagttgttgggcacttggagtcatgtgatggaagc

SEQ ID NO: 8101 - DNA, 299 bp, Zea mays
  Clone ID: LIB148-058-Q1-E1-B1
gaaagaaatcgcctaattctttcgatcgaattaggcgccttctgcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaacctcctggaaacccccggggttttcccc

SEQ ID NO: 8102 - DNA, 398 bp, Zea mays
  Clone ID: LIB148-058-Q1-E1-B10
gaaagaagtcgcctaattctttcgatcgaattatgcgccttcttcgtcacacgctccgtctttatttgtaatctgaagcttacaggaacatttgagtggatcatggacggattggtaagcctcttgaaagtccgggtggtgaggggcatcaaccttgcctaccgcgacgcaagaggcagcgatgcgtatgtcatcataggacttggcaagaagaagcttacgacgagcgtgaagaagagatctgtgaaccccatctggcacgaggagctaactctgaccgtcacagatcgcagcctagctctgaagctggatgtgttcgacaaggacacgttcagcagggacgacccgatgggggacgcggagatcgacgtggcgccgctggtggatgcggcgaacgc

SEQ ID NO: 8103 - DNA, 407 bp, Zea mays
  Clone ID: LIB148-058-Q1-E1-B11
agcgcttcggcggtcgcggctagccagacgatggccatgatcaataggctgcaggaggagaaggctgcaatgcagatggaggctctgcagtacctgaggatgatggaacagcaggctgaccacgaccacctggcgattcaggacctgcacgatttgcttacggagagggagaaagagttgcttgacttggacgctgagctcgcgcactgcaggaggctcctgcagaacgatccgttcaacggcgacggacgtaataatggcgctgacacagtgaacacaacgattgacggcagaaatccggcgatcgaatgcttggatggcgcggaccttgtggggagcgccatgtcgcttttcgaagacgagaaggcgttcattttggagtccttgagcagactggaggaaaacct

SEQ ID NO: 8104 - DNA, 395 bp, Zea mays
  Clone ID: LIB148-058-Q1-E1-B12
gccgccgctgccgcggagattgatagtactagtataaagcaggcggagacagccggcccctctggcctcgctgctcccccttcctccccgtccccacccacatgccctgcctccgccccgccccgccctgcccaagctgagttcccccacccccaacaaacaattactagagtagctgcattggcggggaaattaaagcgctagaagctcagcagcaatggcggagcaggctggcgtcagaaggtactggtgccacatgtgcgccgcggccgttagccccgcggatggcgacgtggagatgaagtgcccgttctgccacagcggcttcctcgaggagatggagaccgcccgcggcgccgcgaccgacgactgtgacggcgacggcgctgtggctc

SEQ ID NO: 8105 - DNA, 306 bp, Zea mays
  Clone ID: LIB148-058-Q1-E1-B2
gccgccgatcccgtgggcgcagcggttccggatcgcggcggagatcgcgacggcgctgctgttcctgcaccagacaaagccggagccgctggtgcaccgggacctgaagccggccaacatcctgctggaccgcaactacgtgagcaagatcagcgacgtcgggctggcgcgtctggtgccgccgtcggtggcggacagcgtgacgcagtaccggctgacggcgacggcgggcaccttctgctacatcgacccggagtaccagcagacgggggaaaggcctggggggggggcccggggtttttcccc

SEQ ID NO: 8106 - DNA, 335 bp, Zea mays
  Clone ID: LIB148-058-Q1-E1-B3
acccacgcgtccgcccacgcgtccgaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccggggtttcggtttggaaaaccccccaaaaaaaacccggggggtttttcccccaaaaaacccccc

SEQ ID NO: 8107 - DNA, 273 bp, Zea mays
  Clone ID: LIB148-058-Q1-E1-B4
ggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcgggcg

SEQ ID NO: 8108 - DNA, 266 bp, Zea mays
  Clone ID: LIB148-058-Q1-E1-B5
aggtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaa

SEQ ID NO: 8109 - DNA, 286 bp, Zea mays
  Clone ID: LIB148-058-Q1-E1-B6
agctcttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctgggagagacccaggttcccgggggg

SEQ ID NO: 8110 - DNA, 271 bp, Zea mays
  unsure at all n locations
  Clone ID: LIB148-058-Q1-E1-B7
ctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgnntgaccaac

SEQ ID NO: 8111 - DNA, 383 bp, Zea mays
  Clone ID: LIB148-057-Q1-E1-G5
gtgacgttgtggtaacgccaggtctgccgggtttcggatcagcgtgggcttgctgagcgtgggcctagtgggactgcgccactgcgatctcgccaccagcggctccgcccagcagaaagacattgacctgctcaggagcgtcgaaggctctagcgacgggatcaggccccagtcccaatgccggttctccagactgaatgaagctggctgatacggaatccgatgcaccggcgcctgcgccggcgccggggccgtcgtccggttgaactgagaagcgtgcgttcagccaagcaaagtggtcaaaaccgagaactaattaatgggtccatcgtgtgtcaggctactattgttcttgccataagtatatatagatgcgcaaagtg

SEQ ID NO: 8112 - DNA, 305 bp, Zea mays
  Clone ID: LIB148-057-Q1-E1-G7
aacctcaactcacacgtctgatacggtctgggacagctccctcacgcctttgcccgcctgagcgctgttgtacgtggcacgtacatgctgtcacaagccatagtgcaaagtcgagtttggtggtattggtaaatcgtatggggtcacttctgagcgggagaccgccagatgcatgaagatcatctgcgatccttcgtatttgccatgcaaggtgaagaaagttggaagggtggcccacgccatatgcatcactaagcatccgatcccggacaccattgactcgcactccgtgcagatcatcctcc

SEQ ID NO: 8113 - DNA, 408 bp, Zea mays
  Clone ID: LIB148-057-Q1-E1-G8
gtcaccttccaccttgaaaaggggtgcggccccaactacctggcactgctggtcaagtacgtcgacggcgacggtgacattgtggcagtggacgtcaaggagaagggctccgacacatacgagcccctgaagcactcctggggcgccatctggaggaaggacagcgacaaaccgcttaagggacccctcaccgtccgcctcactaccgatggaggcaccaagtccgtctacgacgatgtcatccctgccaactggaaggccaacaccgcctacaccgccaaataattaactttagtgctgacaatactttaagccgacctatgctagctatactagattgggttggatcccaagcaatgcattacacatgcatgcattggaccgtgatatctatttgctaccactacc

SEQ ID NO: 8114 - DNA, 419 bp, Zea mays
  Clone ID: LIB148-057-Q1-E1-G9
ctcacgggtcgatacacgcctctacacacacgttctgccaacgcgtccggcgacgactgcatctccatcggccccgggacctccaaggtgaacatcaccgacgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggacgtcaccttcaagaacatcaccggcacctcctc

SEQ ID NO: 8115 - DNA, 422 bp, Zea mays
  Clone ID: LIB148-057-Q1-E1-H1
acaaccctctggagtgagtcgtattatttttggtggaacctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacatcctcacgtgtcacctcttcacgaggaacttatccccacttcaattcatacccctggattaccctattcttgtgatgtcccgatggttgaagaggccatagacgccatctgcaagagccacggaacaccaccag

SEQ ID NO: 8116 - DNA, 398 bp, Zea mays
  unsure at all n locations
  Clone ID: LIB148-057-Q1-E1-H10
tgacttccaaggatatacaggaaatggcacccttacatctgtattggcacggcttggtgaattggaggagaaggtacaggcaattgaagcaaagccatcccaagtgccatttgaaaagcaggaattgttgcatactttcgttaaccgcgtgggtgtgttggaagctgaactaatttctatgaagaaggtcttgtatgagacattggttcggcaggatgagctgcttgcatatattgaccaacgacgggcagccaaattttgtcggcagaagttctgcttctgagtgctgaagtacctgccacctatgttcttctattcggagttggcatgctgctattgtggacacagaatacttgcaaatatcttcatattttgttgcggtgtanagaattgcaata

SEQ ID NO: 8117 - DNA, 297 bp, Zea mays
  Clone ID: LIB148-057-Q1-E1-H11
cgacgagaggctatctggctgctccatggcggggcggcggtgggaggcccgtgcccgacagtgacggtggcctcctccgtccgtcagccctccctagcaccgaggacacgtcccctcacgctcaacctggatcgttgtaccgcaaccactttgtgtttgagcgcctctaggtggccatgcgcggcggatttgagcatcgcgggctcgcggctagaatataaccacctgttctgcttgctcatcgatgtgtctaattcaaaagggaaagtcctacaatggttgggcatttctttcctg

SEQ ID NO: 8118 - DNA, 414 bp, Zea mays
  unsure at all n locations
  Clone ID: LIB148-057-Q1-E1-H12
cgacgacgggcagatgtacttcggcgctcccggagccccctgcgtggccaagctcgtcaaggtcgtcgcagcgcggccgtactctgtgtccatcatggagatcagcgagcccattttgccggccgcgttgccctcccccgtcgcggcgcccggccgccgcggcaagggtggtaagcgcaagatcaagccatcagcggcaacccatgaggattccaacatgatcccgcgcaagcccgtcgaagcagtggtggtgggtaagggtaaggtggccaaggataccgtgtccgagtcanctgctccaangcccgcccccgtctccgccccttagttgcgtgttgggcgccgctgcccgccgggccccgggcaacatgcgtcgtgtctgcgcgcgcacgcacgcattgaacgggagataga

SEQ ID NO: 8119 - DNA, 408 bp, Zea mays
  Clone ID: LIB148-057-Q1-E1-H2
ccaaatcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatccatcactcactcttcgtcacctctctctttctcactctcgccagtcttttt

SEQ ID NO: 8120 - DNA, 407 bp, Zea mays
  Clone ID: LIB148-057-Q1-E1-H4
aaatcaatcaatgccccaatggacacacgctgtgttccacatgcaaggccagagtacacaaccgttgccctacctgcaggcaagagctgggcgacattaggtgcctggcgctggagaaagtcgccgagtcgctggagctcccctgcaggtactactcgctggggtgccccgagatcatgccttactacagcaagataaagcacgaggcgcagtgcggcctgagaccgtacaactgcccctacgccggctccgagtgcggcgcggccggcgacatcccttccctcgtctcccacctgagggacgaccacaaggtggacatgcacagcggctgcaccttcaaccacagatacgtgaaatccaacccgcgggaggtggagaacgccacctggatgctgacggtgttccac

SEQ ID NO: 8121 - DNA, 401 bp, Zea mays
  unsure at all n locations
  Clone ID: LIB148-057-Q1-E1-H6
aaggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccatcaggtacggcgagggctcccacaccgtggtctcctaccgcggcacgccgctgtgctccgggaagctcccggccttccttcagggctacangaacgtcaccgtcatggacatctccatggagggccgc

SEQ ID NO: 8122 - DNA, 419 bp, Zea mays
  Clone ID: LIB148-057-Q1-E1-H8
gaccacgcgtcagcccacgcgtccggctactcagagggacactgtctcggcccggccaattgcccggccggaccttcgcccatgatcacagggagaacatcctttgcttcccatgggcatgaagaataaccaagactcccagttggtcatgggccggtacaggctgggccaactcctcggcagcggcaacttcgctaaggtgtacaaggcccataaggtggccaccggcgaggctgtggccgtcaaggtgctggacaaggatgctgtgcaccgctccggcatggcggagaaggtgaagaccgaggtcgacgtgatgcggcgcgtgcgccacccgaacgtcgtccgcctccacgagatgatggccacgcggtccaagatctacttcgtcatggaatacgccagcggcggggagctcttcc

SEQ ID NO: 8123 - DNA, 404 bp, Zea mays
  Clone ID: LIB148-057-Q1-E1-H9
taggatgagttgggaaaagcggacttgccactgccttcttcaatgataataactcatcactggcaagatctcttgctgacctaatgcaagaatctaaccaagaggtacctgcatggctattgcgctatgcagctcgtccttcttatggtggtggtggtggtgggaggaaccggcgatcagggggagggagccgctttggtggccgtgacttccgcaatgattcttcgtcatttggcaaggggggatcccgtggtggtggtgactactatggtggaggcagcagtggtggttatggtggtggcggacacggtggagctggggctccgagtgcctgggattgatgttacagttgctcccaagtagaggggtctgccaagtttaggtcactttttactctagttcta

SEQ ID NO: 8124 - DNA, 276 bp, Zea mays
  unsure at all n locations
  Clone ID: LIB148-058-Q1-E1-A1
cccggtgccggggcgccgccctcctcagcgctgcgaaagcgacctcaacatcnaggagcaccgctcctgcatcgaagtggccggcggcaacgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgcaagggctctgcctccgggggccaggccacggagatatacgagctcctcgtggacgacaccgg

SEQ ID NO: 8125 - DNA, 406 bp, Zea mays
  Clone ID: LIB148-057-Q1-E1-G4
cgactacacgcactggctcatgtacgccatcggcggcagcaaggcccccaccatcatcagccagggcaaccgctacatcgcgccgcccaaccttgccgcgaagcaggtcaccaagcagcatgacacgccggagtcggtgtggaagaactgggtgtggcactccgagaacgacctcttcatggaaggcgcctacttcaccgtcaccggcggccagatcaacaggcagttcaacaagaaggacctcatcaagcccaggaacgggtcctacgtcaccaggctcacgcgctacgccggctccctcgcctgcacgcccggcaagccctgctagatcaagccaccagcgaggacggccgacgaccagaagcagaccatgcattcgccggctcgccatgtaagaaacagggga

SEQ ID NO: 8126 - DNA, 324 bp, Zea mays
  unsure at all n locations
  Clone ID: LIB148-031-Q1-E1-A2
gtttactaccctaaacacaagaacccagatgcataataaaaggtgaaagctagcagaagaggtacctaactctaccctactatagagaaaaagtcagcacattgcaagcaataataatggagacgacgacgaagctccggtggagccggcccggctccttcctcctcgtcgccgcggcgttcctggcgtccgccgccgcgtcgggcgtcaacgtcggccagttcgacgaccacttgcagaagcggaaggagctcgccgaggcgtcggcgaaggaagcgtacangcccgacccgtacaacgtcaccaacagcttcaacgccgccg

SEQ ID NO: 8127 - DNA, 177 bp, Zea mays
  unsure at all n locations
  Clone ID: LIB148-031-Q1-E1-A3
aaacaaagcacctctctctagctagctactagacgacagctagagctagctcctcaacgacgacgcagtagtacatatggagaaggcggcgggcgtgagcgcggcgaggctggccgtggcggcngcngcggtgctgctgtgcctgctgctgctgctggcggcggggccgcacggggt

SEQ ID NO: 8128 - DNA, 336 bp, Zea mays
  Clone ID: LIB148-031-Q1-E1-A4
gggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaag

SEQ ID NO: 8129 - DNA, 319 bp, Zea mays
  Clone ID: LIB148-031-Q1-E1-A6
agcggacgcgtgggatcgattggacatgatagacaacatcgacggccgtcgggtaaccaagaacaaggcgcgcatccaagttggcgactcctcttcgtcggacgaaagcgacagggagaaggaggaagatgaagaagaagcacatgaggaagtggccaaggcgcccccgttgggttggaatcatcacaatcaccacgaagcggccggcggcattggcaacaacagcaacaggaggcggcttctgtcgaagcagctgtccatgaaggagaccaccagggagatcaaatgggagaagcgccggcggcagatactgcggcgc

SEQ ID NO: 8130 - DNA, 266 bp, Zea mays
  Clone ID: LIB148-031-Q1-E1-A7
agctgccacttcacaaacaacaacgaactcatgctcctccgcgccagcgactcctggccgcaagaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaa

SEQ ID NO: 8131 - DNA, 329 bp, Zea mays
  Clone ID: LIB148-031-Q1-E1-A8
agggaaagctctcttcctcctcctcctcctctcgaattccgtctcttgtccctgtcgtcctcgcccggtttccccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccaccttgacaactatactagtgactacaccctacatgtgttggtaggttatt

SEQ ID NO: 8132 - DNA, 363 bp, Zea mays
  Clone ID: LIB148-031-Q1-E1-A9
acgtcatcccgccgggcaactacctgacgggcgggctggagctgaagggcccctgcaagtcctccatcatcatccgtctcgacggcaacctgctcggcaccggcgaccgcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgaca

SEQ ID NO: 8133 - DNA, 65 bp, Zea mays
  Clone ID: LIB148-031-Q1-E1-B10
gcgggctggaaccctttgcctcctgctttacctctatcctcttccgtctctactgcactctgctc

SEQ ID NO: 8134 - DNA, 380 bp, Zea mays
  Clone ID: LIB148-031-Q1-E1-B11
taaccagaatctgttcacggaccgcttcaagatcccctcgtacctgggccgcccctggaaggagttctcgcgcctcgtcatcatggagagcaccatcgccgacttcgtcgagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacatacttgggttcaagttctaaaggccgcatggcatggcatacatcacatcatatatagtga

SEQ ID NO: 8135 - DNA, 311 bp, Zea mays
  Clone ID: LIB148-031-Q1-E1-B3
caaccaaaaggcagttcttccgcgactgcgaggtgctgggcaccgtggacttcatcttcggcaactcggcggcgctgttccagaactgcctcatgacggtgcgcaagcgcggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatc

SEQ ID NO: 8136 - DNA, 263 bp, Zea mays
  Clone ID: LIB148-031-Q1-E1-B4
agaaaaaaaaaaaaaaatttaaaaaaaaaaaaaaaaaaaaaaaacaaaaaaataaaaaaaaaaaaaaaggatggccgttctaaaggaataaaacattaaataagcgtggatggcagggcagatcgattctaacttaaaaaaaaatttgaattcattggccttcgttttaaaccgtaattacagtcaaatgcctgtcgttattcaacttaatccctttgaaaaacatcccgttttcaatataaggcgcattgctgaaaatgccc

SEQ ID NO: 8137 - DNA, 311 bp, Zea mays
  Clone ID: LIB148-031-Q1-E1-B5
ctgccacctgccattgccattgtgtgagggacaccacgtcaaaggataccaatggccacaagatggctctgcgcggctacctgcccgtgccgccccctttggtacgcgccgcggacaccgcaagcgataaatccgctacgctcgactttttctcatcagcaccggcagcatctgtaaccgcacgggccaagggcgaccggcgcaggcacgcgtacatctccgccaatctcacgtcgcgccggggcagcaggcatacggttgccactgaattagagtcatcatccgcgatctccgttcctatctcatcgggg

SEQ ID NO: 8138 - DNA, 334 bp, Zea mays
  Clone ID: LIB148-031-Q1-E1-B6
cccacgcgtccgggtgaccaagcgggagtacacgcagtacagcgagtacaagaactgggtgtggaagtcgcaggacgacctgttcctcaacggcgccttctgcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccg

SEQ ID NO: 8139 - DNA, 347 bp, Zea mays
  unsure at all n locations
  Clone ID: LIB148-031-Q1-E1-B7
agcccacgcgtccgctcgtctcaccctccctccctcacacaaataataaggaaaggtcccgcccttttcctccgacatccacaggggggaggggaaaacacgtgcatgcacccggcggcaataatggcctcagttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcangcacttcggcaccggcaagct

SEQ ID NO: 8140 - DNA, 339 bp, Zea mays
  Clone ID: LIB148-031-Q1-E1-B8
agcttggacgctcgacaccaaggccccgctcaagtaccccctctgcatccgctttgctaccaagtctggcggctaccgtatcgccgatgatgtcatccccgccgatttcaaggctggcaccacctacaagaccactctcagcatctaatcagcctctgataagtgatgacgaataatatttcgaaagagctcatctagtccacgtgccaacgagccaatatttaaattttttctatggttattttgtggcacaacaccatctcttcctgtgccttgttgtgttggttgattttattacatgaattgaaatacactgcttatttaagattcttttgggtg

SEQ ID NO: 8141 - DNA, 327 bp, Zea mays
  Clone ID: LIB148-031-Q1-E1-B9
gaccacgcgtcaactacgagtccggtccgtccagcgtccagtcgcccagcgtttcagcgccatctgcgggtcccacatcatcgttcgacacacgagcaccgagcattcaatccgtcatcgggggcgatgacggcgacagtgattatacatgcagcggctctcgcagtcctccagctggcgtcatcgtcgtctaaaacggcacgcatggccagcgtcgcccaggacgaactctcagcattcgtagcagtggccgttacttcttcacatcacctgcataaagattgatccgaagctgcagatgaacggaatgggactgataaggagtgc

SEQ ID NO: 8142 - DNA, 393 bp, Zea mays
  Clone ID: LIB148-031-Q1-E1-C10
gggtcgacgcccgcgtccagccgcattcctggtgtcggtggtgttcctgggcctgtccacggtggtgaccatgatcttcgcccgcgaggtgccgctggacccggcggcggcggcgaagcaggacgaggccggggagtcgtcgggcccgttcgccgttttcaagggcatgaagaacatgccccccggcatgccgcaggtgctcatcgtcacgggcctcacctggctctcctggttccccttcatcctcttcgacaccgactggatgggccgcgagatgtaccacggcaggcccgacggcagccccgaggaggtggccaggttccaggagggcgtccggcagggcgccttcggcctgctcctcaactccgtcgtcctcggagccagctccttcct

SEQ ID NO: 8143 - DNA, 367 bp, Zea mays
  Clone ID: LIB148-031-Q1-E1-A12
ggtcgacgcccgcctctagcatgaatcatcgtacatccgagctaagtaattaggtcgaaaatgacccgtgccagcagcagtagcagcagccggcgtgtgacgctggtactgctcggtctccgcctgcggcgtctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccgggaacaagaaca

SEQ ID NO: 8144 - DNA, 370 bp, Zea mays
  Clone ID: LIB148-031-Q1-E1-C11
agcggaagtcatgcaaatgaagcagatggcgaacccgacgaccgccgcgggcatgctgcgcgtcttcttccacgactgcttcgtcaccgggtgcgacgcgtcggtgcggatcgcgtccacccagttccagaagtcggagcacgacgcggagatcaaccactcgctccccggggacgccttcgacgccgtggtgcgcgccaagctggccctggagctggagtgccccggggtggtgtcctgcgccgacatcctcgcgctggcgtcgggggtgctggtcaccatgaccggcgggccccggtacccgattccgctggggcgcaaggactcgctgtcgtcgtcgcccacagcgcccgacgtccagctgccgcac

SEQ ID NO: 8145 - DNA, 339 bp, Zea mays
  Clone ID: LIB148-031-Q1-E1-C5
aggcggtggccacgatgacgactaataagcccctcctcctcctcgccctggcgtccgcgctccttggtgcggcgccggccgccgcgaacgcgcccggcggggggttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggggctc

SEQ ID NO: 8146 - DNA, 433 bp, Zea mays
  unsure at all n locations
  Clone ID: LIB148-030-Q1-E1-G7
ccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcaagtgcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggcgacggcgtctccgtgatggggtccagcgatatctggatcgnacacctgtccatgagcagctgcgcggacgggctggtgga

SEQ ID NO: 8147 - DNA, 403 bp, Zea mays
  unsure at all n locations
  Clone ID: LIB148-030-Q1-E1-H1
acnccggctcccgatggatttcctctctgctgcgttacgggctaactctggacatgaagatgccgcgggccgacccttctccaagccgggtgccaacaagtccgcctccttctctccaactcccatgaagccgccgcggtgggaatctcacccataactccctccaaaccactgctttccgcaaccaacctctggcccgaacgcagccgctggcaactggcatctccatccagcggcagatacatttcaaggagggaccgcgctctcctggctcatcaggggacatattgaatccggatcatccctgcctctgacgagagtggattttgaatctgcagttggctctatcacctatccaaatctacgagctgacattttgcattctnttgcgatgcaaacgaaa

SEQ ID NO: 8148 - DNA, 422 bp, Zea mays
  Clone ID: LIB148-030-Q1-E1-H10
gacgcgtgggcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctaccacatgca

SEQ ID NO: 8149 - DNA, 419 bp, Zea mays
  Clone ID: LIB148-030-Q1-E1-H11
attcattgtagatggagaaagaagatttatacccgaccttccatgcgaaactgacaatatgggtcagattgtgaacctagtagatgtccatgacttcgttcctgacagcgtggaaagtgtatctgagctgatggcccctccctccccggactccagctacggtttccatgttcccggcgagaaggagttctccaaggagcctcctcagctgccgtcccagctctatctcggcgtgctgaattcccggagcaccgaagaaggctgcgcgaggccgaggcacgtcgtcctcgaccatctctacatcgagaagggctggggcgcacagccgctggtggccctcggctacacccacaggttccgctccaagttcgtcacctgcgtcctgtacaaaggcatcgagcggtagcctagctaaccat

SEQ ID NO: 8150 - DNA, 399 bp, Zea mays
  Clone ID: LIB148-030-Q1-E1-H12
atacactccactagagtcagtcagattagctgtgtgctgctgcttcccctgcgtcatggtggaggtcgcggtgctcgccacggtgcgcgcgcccgcggcgctgtgccgcaaggccgcacgcgtgcgcaagggccgcaggcgctctgcctccgcgggccaggccacggagatatacgagctcctcgtggacgacaccggcgtcgtcgaggtggatgccggcgccgccaatgcagtggcgctgcccgtgaagcccgccttgcagctggaggaaaagggggagctggacaaggacgtgtgggcgacgttctacggcaccggcttttggacgagcccgtcgcagctggacgacaacgacgacaggtgatcgggacaggcccgcgagcgagctatccaaaagct

SEQ ID NO: 8151 - DNA, 332 bp, Zea mays
  Clone ID: LIB148-030-Q1-E1-H2
acccaagcgtcaatcctattatgatgtcatctctgatgtgtatagtggtaattctgacgtattatgatctcgctgactgaaacttctacaggccagttgatagcaggttggattccttcacgggacctcgtaatcattcgtgctagtgagtaactcatgtaatatgctctcaaaccaagtgtatcctgcaggaattttcgagacacacatatctgcgaatgtgatctcaatccagtggcatataaatttctatcatggaacgagtactcgttgcatcattatgagcacatattgaatccggattatccctgcctctgacgagaatggatttt

SEQ ID NO: 8152 - DNA, 374 bp, Zea mays
  unsure at all n locations
  Clone ID: LIB148-030-Q1-E1-H3
cagacgagtgggcgaagattgcgtccaataaaacggtcctcaacctccccggcaatcctcccaacacgcccctccggaaggccgcccctcggggaacgccaatgactgcaaggcggggtgttacgaggtcacgggccactccaaatgagcatggangactgcatgaagaggtgcnaagagatcgctgctaagcaggggcctanggacccttacaanggatacanacttgacatcccatgaactagttaatgctcctatatcatctgcctatccatgcatgcattgcattgcgtatgcacactgtgcgtgcctgcccacaaagttcgacaacacaccgatctcgatggatttgtaatcggtgtcactcgatcgag

SEQ ID NO: 8153 - DNA, 364 bp, Zea mays
  Clone ID: LIB148-030-Q1-E1-H4
agctacctatagctatatcgcaggttcaattgcaagggcaattgcaccgaccaaaagggcatcacggcgccggccatgaaggtctgccagaaggattgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaagcgctgaccgagtctatacgtacgtcgtcaccggctggccacgcatgcgataaccacctgatat

SEQ ID NO: 8154 - DNA, 375 bp, Zea mays
  unsure at all n locations
  Clone ID: LIB148-030-Q1-E1-H5
cccacgcgtccgcggacgcgtgggcgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtagagcaaggcctgtgaatgcatccaaacaacgacaccaacgccaacattaattaattagtagtctccatgccctgngattgtgcgtggccgctccgttgaacaccatccatccntcggtccgcaatttttccccc

SEQ ID NO: 8155 - DNA, 405 bp, Zea mays
  Clone ID: LIB148-030-Q1-E1-H6
agcgcccgtacagccaccactctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccaaggcgctggagctccccggcgtctgcaaggtc

SEQ ID NO: 8156 - DNA, 388 bp, Zea mays
  Clone ID: LIB148-030-Q1-E1-H7
ggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaggacat

SEQ ID NO: 8157 - DNA, 334 bp, Zea mays
  unsure at all n locations
  Clone ID: LIB148-030-Q1-E1-H8
acgcgtccagctagctatagctatttcgtctcgcctctcccaacggcccggtctcccggagaagcaagcgtctccgatccgatgcatcgtgcgagcatatccactgcgatggacgcgagagcggccatgagctggtactgcggctcccttctggccgtggccatcgcgctgttcctgtccgtgtcnctcggcgtgcacgccgccggagccggcaccggcgttgacatcaatgtgtcgtgtgcagcgacgccggacccggacgtgtgcctgcgcgcgctccaagctgacagcgactccaagaccccgcgggacctgacggacgcggcactccgcg

SEQ ID NO: 8158 - DNA, 181 bp, Zea mays
  Clone ID: LIB148-030-Q1-E1-H9
aagggacgtcacacctttttcctctgacatctacaaggggggaagggaaaacacgtacattcacccggctgcattaatggcctcggttccggctccggcgactaccatcgccgccgtcatcctatgcctatgcgtcgtcctctcctgtgccgcggctgacgactcgaacctcgccgactac

SEQ ID NO: 8159 - DNA, 339 bp, Zea mays
  Clone ID: LIB148-031-Q1-E1-A1
agcccacgcgtccgcccatgcgtccggaccctccgtcgactgacccatctctctagttataatttttctctcgtccttgcattgcatattagttgctatccattggtaacgcacaacagtaaaacgacaaacatccaacagctatattatgttcgacggtgtaacaccctgaattttagggtataaaatttcttctctaaatgcaaaccaaattcaagtgttacctcttgtctctctctctatcttttccttttgattaaaagtaagtgaattaggcgagggtttaattatttaatttgtcaaaacttatgtgagtcatgaaatgttgtatcatgctga

SEQ ID NO: 8160 - DNA, 340 bp, Zea mays
  Clone ID: LIB148-031-Q1-E1-A11
acccatggaatgccgggccgtggaaacccgcccacgcgaccatctagagcgggcgggacgggtccggcaccacggcgggcgcgtgcgggtacaaggacacgcgcgcgcgggggtatggcgtgcagacagtggacgtgagcacggtgctgttcggcgacggcgcggcctgcggcgggtgctacgaggtgcgctgcgtggacagccccagcgggtgcaagcccagcgcggaggcgctggtgtgcgacggcgaccgacctgtgcccgcccaacgaccagcagtccgcggacagcggcgggtggtgcaacccgccgcgggagcacttcgacctcagcatgcccg

SEQ ID NO: 8161 - DNA, 429 bp, Zea mays
  Clone ID: LIB148-030-Q1-E1-G6
acggacgcgtgggattccccagaacactagccttccccgcgaggcccctcccccgcggtctccgcctgacccctccgcacgccgccgcggaggcatcggcggcagccacggcgttgggcgggcttctggcgtcgccgctctcgactctggaggccgccctgcggggcctcaacctcgcgccccttcgcgcccccgtggcggcggcgatgtcggcggccgtgcggtggctgggagtgtaccgggaggtgctgctcgtcggcgtgctgctctcctggttccccaacatcccctgggaccgccagcccttctcggccctgcgcgacctctgcgaccccttcctcgccctgtgccgtgaagtcatgccccccgtgttcgggcgcaagctcgacctcagcccgcttgttgcatcaaggctattgacatcatcat

SEQ ID NO: 8162 - DNA, 416 bp, Zea mays
  Clone ID: LIB148-030-Q1-E1-F12
actcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcagcgggccatcacgttcaaggacaccggcaccgccaagatcatgctgcagctcgccg

SEQ ID NO: 8163 - DNA, 353 bp, Zea mays
  unsure at all n locations
  Clone ID: LIB148-030-Q1-E1-F2
atcaacgccctgcaccagctgcacatcttcatcttcttcctcgccgtcttccacgtctcctacagcgcaatcaccatggcgctcggcagggccaagatacgtgcatggaaagagtgggagaaagaagctgcaggacaagactacgagttctcacatgacccgacgcggttcaagttcacccacgagacttccttcgtgaggcagcatatgaatgtgctgaacaagttcccagcatcattctacatcagcaacttcttccggcagttcttcaggtccgtgaggcangcagactactgcgcgctgcgccacagctttgtcaacgtccatctggcccctggcagcaagtttgattt

SEQ ID NO: 8164 - DNA, 365 bp, Zea mays
  Clone ID: LIB148-030-Q1-E1-F3
ggaaaaggagcgaagagagagagagacgcaagcccgccggcgacgatcgacgagggatgaacgccagagacccggcggctgcgacgatggctccgcgcagctcatcggcggcgacgtgcctgtgcctcgctctcgccgcggccacgctggcgctggcccacggggcgcaaggaggaggaccatcggcatcggcggcggacctggacaaggtcactgccgagaccttcctcgacatcgagatcgacggcaagcctgcaggccggatcgtgctgggactgtttggggacaccgttcctaacacagcagagaacttccgagcactttgcacaggggagaaaggaatggccaagtccggcaagcctcta

SEQ ID NO: 8165 - DNA, 346 bp, Zea mays
  Clone ID: LIB148-030-Q1-E1-F5
cggacacttgggcggacgcgtgggtcacgatgcaaaggacaccgcggcgaaaatgactgatgcgatggccgccggtgaataactccggctggggtagggcggtggtgccacgtatgggttgtctcgccccgacgttatccattcccgactgcgcacgaacctggacggcggcggcacgagtttttgcgcagagaggtcgccgtcggtgagatttttctgtcgcggtgatctgatccccaattgagttactgtagcatggcgaagttcagttcagacgcctgacagagccttttgaagcttagttttctctcaattttgaatggctacttaacccaatatctgcatc

SEQ ID NO: 8166 - DNA, 374 bp, Zea mays
  Clone ID: LIB148-030-Q1-E1-F6
cggacgcgtgggcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatg

SEQ ID NO: 8167 - DNA, 373 bp, Zea mays
  Clone ID: LIB148-030-Q1-E1-F7
gccgccttgtgtcgccgaacacctccctctctctggccccgtgcagctcgcggcgtccaccggcttctcctgggccaagaagccccggcccgacgccacgacggcggcggtaactgtgacgatgcggagcggctccatggggccagggaccaacaggaacaacaacagcggaggaggagacggagcaagaaccacctccggctccggcgccaccgccaccgccacagcagcggcggcaccatacgaggcggagaagcatgaggtgatcaagcagtgggcacaggtcgctgacgccttcagcgcctctgaagcttacaacagcaggttgaggcagacgcttgacgccaagcagctcaagactggaatgatgcac

SEQ ID NO: 8168 - DNA, 379 bp, Zea mays
  Clone ID: LIB148-030-Q1-E1-F8
cagatggccatggagggtcgtcgtcgtcgtcgtctcgttctgtggctcgtgatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtagccctccgccgtatctgtcgcttgcacccaacggctccagccctctgctcgcgcagactgctctcaccactggtgtcagctacg

SEQ ID NO: 8169 - DNA, 363 bp, Zea mays
  Clone ID: LIB148-030-Q1-E1-F9
gcattacgaggccaagagtaagctgctgctgttcttcgacccgtcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgat

SEQ ID NO: 8170 - DNA, 318 bp, Zea mays
  unsure at all n locations
  Clone ID: LIB148-030-Q1-E1-G1
cttgaagacctgcgttgtcaaccaaccaaccaagtttggggcgccaacaagttcaaccgttcctgttcctgataaaaccaaaaaaagattgcaatgtttcaaggaactgtcccaatcctgtttcccctcctcctcccaacaaaaggtggaaccaatcatgccaaaaatggaattgccatgcccatgcatgccttgataatggagaaagcgaaacagcaagagacggagaagaaggangagaaaagcacggagaaggaagagagtcaatgcttatcgccgagtctcaagttcganggcttctgcttcaacagcgacaga

SEQ ID NO: 8171 - DNA, 412 bp, Zea mays
  Clone ID: LIB148-030-Q1-E1-G11
cccacgcgtccgccgagctcatgcggccctgccacttcacgtacctgcgcatgggcgccgagttcttctcccccgaccacttcccgcagttcaaggagttcgtgcgaagcgtcgtgtgccggcagtgggacgagggacaacggcccccccgacaaggaccgtggcatgactgtgtcaggcaataccagatccagggaggccaaggcggtttgaagcttcaactcatcgccgcccccgccatgtctcagtcagctgtctcgttttatttttgaagtgccaaaatacttgcaaatttccgctgctactagatttagctgagaagaacgagatgatccaggtattagtggatcaggagttgcaaatgtgggatcccacatgcattttttcttttgccgatgtttcgtcgtcttca

SEQ ID NO: 8172 - DNA, 409 bp, Zea mays
  Clone ID: LIB148-030-Q1-E1-G12
agaacgtctcacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaagttgtttggtgccatcgacgacctcctggccggcgccgac

SEQ ID NO: 8173 - DNA, 352 bp, Zea mays
  Clone ID: LIB148-030-Q1-E1-G2
atcagctccatgctgcggttgtggagcttgtgtgtgagaatggggcagagattaagtactccacggtgcagaattggtactccggtgatgaggaggggagaggaggcatttataactttgtgacaaagaggggaaggtgcaaagggcggggttcgaagatctcatggacacaggttgagacaggatctgctattacatggaagtacccaagcgttgagcttgtcggggatgacagtgttggagagttctactcggttgcgcttacaaacgattgccagcatgcagacacagggacgatcatgatccacaaggggaaaaattcacgcagccggattatatccaacggcatctc

SEQ ID NO: 8174 - DNA, 290 bp, Zea mays
  unsure at all n locations
  Clone ID: LIB148-030-Q1-E1-G3
gtcaccaccgtcgctgacaacatattagaaacagtccagaatcaggaggggtttgaatatgggtccaggagaatccagcaaagcataaaacaaaactgggaaccttaaggcaggatagcttgaccacaccgaagctggtccaagcaacaaattccttgagcctgcaaagtcatgaacttggtgagaaccactgggagtcaaattggttagacaagtggatggctgtacgtccatgggagaacatgttacttgactgtaatgccanagagagtctgccaacgcatgaagat

SEQ ID NO: 8175 - DNA, 373 bp, Zea mays
  Clone ID: LIB148-030-Q1-E1-G5
ctcttcccccgccgggcaacaactcagccgccgcaaccgccacatcagccatgggcgcctgcgcatccaagcccaagacgcttgaagggcaggccccagctgaggccgccgtctccacacccaatgttgcgcccgaggccactccaatctccgttgaggttgcggctgatgaacaggtagctgagaaggtggtggtggaggagccggctgcggcggccgacgttgagcatcagaaggctaatgaggtgctcgctccagacgcggccgtcgccgagcccgaccacaatgacgacgaagccgtggagaagatcgtcttcgatgaggataatccagcggcagcagcccatgcagatgaaaatgtcaccaccgccgc

SEQ ID NO: 8176 - DNA, 411 bp, Zea mays
  Clone ID: LIB148-057-Q1-E1-E8
ctcaacccacgcgcccgcaacaccccccgccccctctctctctctcttcttcttcttcttcaatcctccctccccgcgctggagttggaggagggagaggggacaagctttccggcgccgacgccgacgcggaccccgcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcaatgacccagatcgtcttcccaacgagttgggcagtatgagcataagggacgacaaggacgttgaagatattgtagtcaatggcaatggggcggagcctggtcatatcatagtgacc

SEQ ID NO: 8177 - DNA, 409 bp, Zea mays
  Clone ID: LIB148-057-Q1-E1-F1
cccacgcgtccgcgcgcatccagctcctgccttgcttcctctcctcccggttcccgaataaaatttcctggacccggagcgcgcagcgcgctcccccgcctcccaaggaaacttatctaagcattccggcggtcgatccatcttcccgtccagggagagcaaggaataatcaatcaaccggccagtgaaacgttaggaggaggaggagagccggagtccgtccagcgcggcgcgggttgatcccttgcgtctccgcccctgcccctgcgcatggcccaacagtgccaaccaagcacatcggtcacgggtcagtcagccacgggagaaggcgcgacgatcgatatggccaaaagtggaccgacagtaatggcggcagcaggcggccggaagcagcagtcaaattgtctgc

SEQ ID NO: 8178 - DNA, 407 bp, Zea mays
  Clone ID: LIB148-057-Q1-E1-F10
acaaacatccgagcacgagcacgcgttcttcgcctctcaccccacgggagggacgggaggcgagggcgcggcgagccggcgggcgcaatcggatttggggaggcaaaaggaaaattccggagagcagttcctttccgcctccccatttcctccggatagatttgggtttgtcctgcgtcgattagtccggcgcccgaacccgcaccaatccattcgccgagggatcgagcaagcgaggcgtggaatcgcaggcggtattccctgcctgcctcttcttctcctccgcctgttcttgccgcggtctccccctccggccgatctggactcgacagatcattatttttttgttggcatacattcccaaccttgatataaagacctccttcattcagaagcctgtgttttgg

SEQ ID NO: 8179 - DNA, 381 bp, Zea mays
  Clone ID: LIB148-057-Q1-E1-F12
gaatcgtattataaggtcccgcccttttccgacattcacaggggggacaggaaatcagcggccatggcctcgattccggcgacgaccttcgccgtcatcttagccgtcctcttctgtgccgcggctggcaccgccgtcgacaacgacctccccgactacgtcatccagggccgcgtctattgcgacacctgccgcgccaggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagc

SEQ ID NO: 8180 - DNA, 417 bp, Zea mays
  Clone ID: LIB148-057-Q1-E1-F3
tactctgtctctctacagtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtttcgagtacgcagtcaac

SEQ ID NO: 8181 - DNA, 135 bp, Zea mays
  Clone ID: LIB148-057-Q1-E1-F4
gtattatggcacgctgcggcacgccgtgatccaggaccggccgctgtggatcgtgttcgcgcgcgacatggtgatcgagctgccgcaggaactgatcgtgaaccacatcaagacggatcgatggtgggggcgcgc

SEQ ID NO: 8182 - DNA, 405 bp, Zea mays
  unsure at all n locations
  Clone ID: LIB148-057-Q1-E1-G11
acccacgcgtccgctccatatacaccagtcttggagttcacaagaaccaacaaaaatacagagctaaagctaaagggcgagaaacttgataacaactccgtgtcactggttttgcgaattgctgatttctctggtcatgcaagaaatatccatttcctcttctacttggactctgatacagctatgtctgtagctgctgaaatggttgaacaattggagttagcggactgcgacgttactttcattgctgattttattgaccttttgatagtgaatcttattccgggttggagacctgtaaatgatgcagcagcgaactcgtataggcgatctgaaagtgaacttgcagtcaattcncatcagaacatctcaaagttggtacctgattatgcattaattgatggt

SEQ ID NO: 8183 - DNA, 412 bp, Zea mays
  unsure at all n locations
  Clone ID: LIB148-057-Q1-E1-G12
ctggcccgtgcgacggcgacggcggtgctgggtttcgtcctggcggtggcgtcagctgaggcggcatcgggggacgtggagatggtgttcctcaaggccgcggtggccaaaggcgcagtgtgcttggacggcagcccaccggtgtaccatttctctcccggctccggttctggcgccaataactgggtcgtccacatggagggaggagggtggtgcaggaatcctgatgagtgtgctgtccgcaagggcaacttcaggggctcctccaaatttatgaagccactctcgttttcagggatattangcggcaaccaaaaatccaatcctgatttctacaactggaatagagtaaagatcagatactgtgatggttcatcatttactggtgacgttgaggctgtggacactgcga

SEQ ID NO: 8184 - DNA, 414 bp, Zea mays
  Clone ID: LIB148-057-Q1-E1-G3
gcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcaaagtgtggccaagcctacccacatgca

SEQ ID NO: 8185 - DNA, 318 bp, Zea mays
  Clone ID: LIB148-057-Q1-E1-C8
aacgaccatgccgcaccatttcacctggaacgggatgcagcacaggaagaactcgtggatggacgggatgccaggcacgcagtgtccgatcctgcctaacaccaacttcacgtacaagtggcagcccaaggaccagatcggcagcttcttctacttcccgtccatcggcatgcagcgggcggcgggcggctacggggccatcagcgtggtcagccgcctcctcatcccggtcccgttcgaccagcccccgccggagaacgaccacgtggtgctcatcggaaactggtacaccaaggagcacgaggtgccagtgcgcca

SEQ ID NO: 8186 - DNA, 397 bp, Zea mays
  Clone ID: LIB148-057-Q1-E1-D12
actgagtcgtattactgaggaggaggatgctgcggcagcatgaagagcgccgccgaggaaccggaacggcactgtcatcatcacgttacgaggtcttcgtcggagcgcgtaatgaggtgcctgaccgacgaggacctggacgagctgcggggctccttcgagctcgggttcgggttcgacgaggagtccggcggcgcccacctccgcgacacgctccccgccctcgacttctacttcgccgtgaaccgtcagctgtccgaccccgccaagctgcggacgctgtcgtcggcggcgagcctcacgtccacgccgtcggccgtgtcctcgtcgtccacgctccccgacgtcccgaacgacccacgcagccccaacgtcggcgcaaccgccgcgtctggcg

SEQ ID NO: 8187 - DNA, 410 bp, Zea mays
  Clone ID: LIB148-057-Q1-E1-D2
cagagatacgcgtcatcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaact

SEQ ID NO: 8188 - DNA, 415 bp, Zea mays
  Clone ID: LIB148-057-Q1-E1-D3
ggccgccctttttttttttttttgaacgaaaacaacagtacttgattgatctaataaagcagcgtgacgcgcttggtacaacatccaggagagcacgtctatatccgacggtgacctccggttatttaggagcacgtctctgatcccatcagatcgatcgcgcaagttcaactgaacatgcacacaagcaccagacagaaaggaaacaatgacgtaacggaaggcgacggctgtgcctcgacaaacaacctcgaccagatcgaaggagaacagtgcgtgtaccctaccgtgcaacagccacacacacgacacgttacgttacgtacgtacttgttccttatataacatttgcatgcatgcatgcagatgcatctactacggctacttacacgggcactgtgcggttgttgtagtt

SEQ ID NO: 8189 - DNA, 413 bp, Zea mays
  Clone ID: LIB148-057-Q1-E1-D4
atgaagatgaagaggggtcaacctagaagaggccatacatcaagaagacatgctttcaatgatagaaaatgttttgagtgtggggaacccggtcacatcgccatgaattgccctaacaagaataagaatggcacagatggagatgataagaagaagaataaattctacaacaggaagaaagatggcagagcctacctagttgaatgggatttggataatagctcggatgatgatgatgatgacacctcatccaaacttaatgccggaatggccatcaatgaagccccttcacttttctcatcccctcattgtctcatggcaaagggagatgctaagaatgttacgtgaggccgatgactacatggacaaagaaaaagaaaagttcatgaccttgaaggaattgtataaaaacc

SEQ ID NO: 8190 - DNA, 329 bp, Zea mays
  Clone ID: LIB148-057-Q1-E1-E12
gtcaggcacgggcgttgccaatagtatcaagtgtggtcatccgttgatcgatcttgcaaataaccctgcgtgcccttcgttcgcgtctcgatgccgacgacgctcccttcggctccggcaaaccacatcaattcgcgatggagatgaagaacgtcgcatgcgccgtcctcgccgccgccgcctccgcgaccgtggtcctcgccgccgacggcccggctcccgcccccagcagcgcgctcctcggccggcgttcccggccgtcggcgccgtgcggggcgcctccgtgcgctgcttcttcggttagtagctgcggtaagtggtaggggagg

SEQ ID NO: 8191 - DNA, 256 bp, Zea mays
  Clone ID: LIB148-057-Q1-E1-E2
gggccgtggcaagcctctgcagtaggtccgatcaccagccgggtggtcacgctctggtaccgcccgccggagctgctcctgggcgccacggcgtacgagccctccgtcgacctctggagcgccggctgcgtcttcgcggagatgcacgcgcgccggcccgtcctgcagggccgcaccgaggtcgagcagatccacaggatcttcatgctctgtggctcgccgcccgaagacctctggcgccgcttggggctctccc

SEQ ID NO: 8192 - DNA, 435 bp, Zea mays
  unsure at all n locations
  Clone ID: LIB148-057-Q1-E1-E3
ggtcgatacacgcctctacacatcactcctgctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcanggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacat

SEQ ID NO: 8193 - DNA, 318 bp, Zea mays
  unsure at all n locations
  Clone ID: LIB148-057-Q1-E1-E4
aggaacgctaaaaactgggaatgggcctacagccaagtacgacgagctanggggctcgtttctgtccaaaaactactactgtgatttcgtaacaagccaggctgaattttatgccgtttcagattcgtggagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaa

SEQ ID NO: 8194 - DNA, 308 bp, Zea mays
  Clone ID: LIB148-057-Q1-E1-E5
gtgaatacgtcatttagcacccctcccctgcgtcaccccaccatatccggccagcccaacgaaaatgtcgcgcgccacagctgcggtcctcttctacatcctcgccgtcgctgccctcagcgcggccggtgcaccggcagagtcaccgagggcaggcagtcctgccaaggcaccggccgagtcaccgaaggtaggcagtcctgcagctcctgccagggcacccagagtctgctgccacgagaactgcccccgcgaaagcagctcaggccgactcgagcaccgtcggatgcggctgtaggcatggtcgt

SEQ ID NO: 8195 - DNA, 392 bp, Zea mays
  Clone ID: LIB148-057-Q1-E1-A7
acccacgcgtccgcccacgcgtccgaccggcgtcaccatggatgacgtcaacgtcgagtatagcggcaccaacaacaagaccatggctatatgcacgaacgccaagggcagcaccaatggttgcctcaaggagcttgcatgcttctagaccctccgtcgactgacccatctctctagttataatttttctctcgtccttgcattgcatattagttgctatccattggtaacgcacaacagtcctacgacaaacatccaacatctatattatgttcgacagtgtaacaccctgaactttagggtataaaatttcttctttaaatgcaaaccaaattcaggtgttacctcttgtctctctctcgatcatttccttttgattaaaagtaagtgaa

SEQ ID NO: 8196 - DNA, 383 bp, Zea mays
  Clone ID: LIB148-057-Q1-E1-A8
acaacactctatagtgacgtcgtattaagccctcagaatggcatcaacacgtgtgatctccaccttgagtatagcggcagcaactaggcaggaccacggcgatatgcacaaactcgacgggcagcacaaatggttgactcaccgaacttgcatgcttcaaaacactgtctcgactgacgcatctcactacttatcagttatctcacgtccctgcattgcatatcatgtgctatccattggttacccacaacagtataacgtacaacatccagcagctatattatgttctacagtgtaacaccctgaattttacggtacaaaatttcatctttaaatgcaaaccacattcaggtgttacctcttgtctctctctctatcttttc

SEQ ID NO: 8197 - DNA, 407 bp, Zea mays
  Clone ID: LIB148-057-Q1-E1-B10
acaccgatctcacgctctctctctcttcctccgtcgcgtcgggtcggcgtcgccatcgccggccatgggttgcggtggctccaaggaggccgtggccaccggcaacaccagcgccggcagcaaggtcctccggaggaagccctcctccgtctccaccggcgcaagccacacatccaccacgtcgccgtcgtcctccggcgtcgtcgtcaaggacgtcgtgaaggatgcggcggcggccggcgaagtgatgacgcccgccgacgccgaaaagcctatctctgtcgaccccaaggcagacgccatcgtggtgatggacgccaagaaagaggagggcatcaacaacgtgagcgtggaggaggatctgcgtcctgaatccaccatggtcgacgacgcgcttgctgtggaag

SEQ ID NO: 8198 - DNA, 407 bp, Zea mays
  Clone ID: LIB148-057-Q1-E1-B11
actttcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacat

SEQ ID NO: 8199 - DNA, 404 bp, Zea mays
  Clone ID: LIB148-057-Q1-E1-B3
aagtcgtattacggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcctggggctgccgctgccgccatcctacgcccccgcgcgctaa

SEQ ID NO: 8200 - DNA, 399 bp, Zea mays
  Clone ID: LIB148-057-Q1-E1-B9
ccacgagtccgcccacgcgtccggtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgactaatgtcaccgagtacatcgcgggcgccaacgtgaggctggagtgcaagcacttcggcaccggcaagctcgagcgctccatcgacggggtgaccgacgggaacggcacgtacacgatcgagctcaaggacagcca

SEQ ID NO: 8201 - DNA, 149 bp, Zea mays
  Clone ID: LIB148-057-Q1-E1-C1
gcgtccgaaaggaactatatactcaccccggtcatatgattggtaactgaaaatatgactcttgtgctgcctaacctggtggctattagattatgttggtactccaaagacatgatttagaggttaagaatttgaatccaagtttggac

SEQ ID NO: 8202 - DNA, 404 bp, Zea mays
  Clone ID: LIB148-057-Q1-E1-C11
agcgcccggggcccccggatcacggaatcctacccttaccaaccctagcctccattggtcgccgtctcgggccatggcagggccggcgccggatcgggccgccctgactgtgggtccgggcatggacatgccgatcatgcacgacagcgaccggtacgagctcgtgcgcgacatcggctccggcaacttcggcgttgcccgcctcatgcgcgaccgccgcaccaccgaactcgtcgccgtcaagtacatcgagcgtggcgagaagatagatgagaatgtccagcgcgaaataattaaccatagatcattgaaacaccctaacattattaggtttaaagaggttattttaacaccgacccatcttgctattgtcatggaatatgcctctggcggtgagctttttg

SEQ ID NO: 8203 - DNA, 408 bp, Zea mays
  Clone ID: LIB148-057-Q1-E1-A6
acgatcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaagtggatggcaatctgctggcgaccacggacctaagccagtacaaggaccatggtaattggatcgagattctacgcgtggataacctggtca

SEQ ID NO: 8204 - DNA, 430 bp, Zea mays
  Clone ID: LIB148-057-Q1-E1-C2
gggtcgatacaagcgtctacactcacttctgcgtgtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgct

SEQ ID NO: 8205 - DNA, 244 bp, Zea mays
  unsure at all n locations
  Clone ID: LIB148-057-Q1-E1-C3
gcgtctagctacattcctaatatctgttttccactgctttgacggcgagaacgtggagagtgctcctcctcctatgaagaaggactacaagctggctaatcttctctgctgggaagangaagcggatgccatggaggagaaggcgggagtgcttgatgagtaagacgggcttctggggtcgatttgcttctgagttgtttattttatatcgtcgcaatttcgtggttgtcgtttggttattctg

SEQ ID NO: 8206 - DNA, 330 bp, Zea mays
  Clone ID: LIB148-057-Q1-E1-C4
gggtcgagacacgcgtctagattgatgtcctattatctgtgttccactgctttgagggcgagaacatggagattgcatcacatcctatgaagaacgactccatgctggctaatcttctcttctgttacgtggaatctgcagcgatgaaagagactgtgggagtgattgatcactgtgacaggcttcatcggtccacttgcttctggattgcgaatcatatatcgtctcaaattcgtgcttgtcgatcgattattcggtgattcacacaagccactgtagtgttatcaaaatttggcgtccgtgtccatgtaaccttcagcttttgcaaca

SEQ ID NO: 8207 - DNA, 239 bp, Zea mays
  Clone ID: LIB148-057-Q1-E1-C5
tgcatgcactgcagtgcgtaagcagactgtgcgtgcctgcccacgcaattcgacagcacaccgatctcgatggagctgtgatcgtgtccactcgatcgagagatcgattgatgcttgagattaaatttgtagtccacattatatataagagatacagcttaaactaaatttattccatcaagcacgaccgccgcaccaccgaagtcgtcgccgtcaagtacagcgagcgtggaaaaagg

SEQ ID NO: 8208 - DNA, 259 bp, Zea mays
  Clone ID: LIB148-030-Q1-E1-D7
catcactcatctcatgacattcatacgagacacacaaagggcatctccgtgtattcgacttccgaagcaagctttcataagatgcgcgcgaggaaccatccaagtgatcggtttgatatatgaaagaccagatgatgcaaaactatgtgtaaaggatctcatattgctgtcatcaactattcaaatgactgatagtcgacgtaaacttactaaaatatctggctgcacacaggagtgacgaatccaaggtctcaacaca

SEQ ID NO: 8209 - DNA, 406 bp, Zea mays
  Clone ID: LIB148-030-Q1-E1-D8
cgcgggtcgacacaagcgtccaacgacatgcataggacactctctatggccgtctctgtgttttcatcttcggctgctatctttgacaagatgaacaaggacaagcactcagaaaattcacaaggagaaagcacggacaatattttgcatagcgttggtgaagggaccggacaaccaaagaatcaaaaccttcatgtgtctcacagccgacgtagtatcatgagaatttctaatttttccatgaaaagaggcccttcaatggccatgatagctccttcagtagctatcagagctccttcaatatctctgagaggtccttcaatgtcttcaagagcatcttctgtgtctgtaaaggaagaccaaatttccccaaataaatcagacgaggaaacggaatcagtgttgg

SEQ ID NO: 8210 - DNA, 422 bp, Zea mays
  unsure at all n locations
  Clone ID: LIB148-030-Q1-E1-D9
cggacgcgtgggtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacanggcgacggcgacgcggtcgcggtccctggcgcacagggc

SEQ ID NO: 8211 - DNA, 368 bp, Zea mays
  Clone ID: LIB148-030-Q1-E1-E1
agggtcgaggcgacgcgtccgtgacatccggcctgtgcttcaggtcaaaagtagtgcacacgcaatgatgggatttgctaatgatgctttcgtaggatgcgcgcgcggaaacaagcaggtgaagggtttcatgtttgaaaaaccggttgatctgaaagtaggtgtgaaccatgtcgtattgctgtcgtcaactatgggaatgaaggatagtggtggtgaacttgctgaagtaaagggcggcattcaggagtgcctaatccaaggtctcaacactgggacgttggatttacaagtcaatggctggggccataaagctgcactagaaggtgagtacaaggagatctactcacaaaaaggtttgggcaaag

SEQ ID NO: 8212 - DNA, 421 bp, Zea mays
  Clone ID: LIB148-030-Q1-E1-E10
cggacgcgtgggcggacgcgtgggttctgaaaggcgccaagattcatccataggatttggggcacccattcgtacgaacatgagaagttctggagctagctgtccaatggttacctcatctttattagaatctgttgaaagtggtgatcttgtaagatatggtctaattccggagttcattggtcgtttgcccattctagtaagtttggcagctctgaatgaaggccagctcgttcaggttctgacagaaccaaagaattcactttccaaacaatacaggaaaatgtttaacctgaacaaagttaggctgcacttcactgatggtgcacttagattgttagctaagaaggcgatagctaaaagcactggtgctcgtggtttaagagccatcttggaaactgttcttttggaggccatgtat

SEQ ID NO: 8213 - DNA, 413 bp, Zea mays
  Clone ID: LIB148-030-Q1-E1-E12
gccacggcatgtggggtgctgtgaagaaacttcagtctgggttcagagcgtaccagcaaatgagagacacagaaaataccctgtcacacagcgccattatggctcgaatgaccaccagggtatccatcacggcttcgaatggtggcttagaccatgacctctccatcgccgataaaatcagtggcgagaatgacagctcccatgcagttcagcatggttttgactggaagtgggtggtttttggtggtgcggtggctgcggtttgtgtgctcaacaccggactggtaggcaaggtcctgttgcttggagcagcgagacggcaggcaaagaagtgatgtgaggagcaaccttccagcctctgcagaaaggcattcgtcaggctgtagctacaaccgtacaggcaaaaagtattg

SEQ ID NO: 8214 - DNA, 313 bp, Zea mays
  Clone ID: LIB148-030-Q1-E1-E2
acaatggcgcatccaataataacaagtgtgattatccgttgattcatcttgccaaaaaacctgcgtgccctccttcccctccccatccgaacacgctcccttcggctccggcaagacaaatcaagtcgcgatggagatgaagaaggtcgcctgcgccgtcctcgccgccgccgcctccgccaccgtggtcctcgccgccgaggccccggcgcccgcccccatcagcgcctcctcggccgcgttcccggccgtcggcaccgtgctgggcgcctccgtgctctccttcttcgcctactacctgcagtaaaattaa

SEQ ID NO: 8215 - DNA, 358 bp, Zea mays
  unsure at all n locations
  Clone ID: LIB148-030-Q1-E1-E3
ggtggagtacgtgcggtccctggacgcggaggaggacgtgactatgctgaggctccacgggtgggaggtgtcgcgcgagtgcgcgcgcacgctgcgcgtcgccaccattctgctgaagaagggtgtggagaggggcctcaccgccttccacatcgggagcatcatgtgcagagagaccctgaccaaggagtccgccatcgaagagatcgtccgtgaggcggcggaacggggaggaggatgcgagactgtcttcttgcangctgtctcggagatcatggaccgccgtctcgacgacatcaaagaacatgttagcctctagatatgcacatggctgacaaaataacgatgtaatcaactc

SEQ ID NO: 8216 - DNA, 363 bp, Zea mays
  Clone ID: LIB148-030-Q1-E1-E4
ggaggccgcgatggtggcgcggtcctgccagccgaggaggaggcagcccctgtcctcggtgagccggtagccgtcgccggcgccgtagaggcccagcaagacctggctctgggcaacggcggccgggctgagcggcacaggctcaaatccacggccttccatgatgcgcctccaccgatccagccgctcgtgccgcgccacccgctcggcgccctcgcacgccaccacgttgcggatctccggcgccaggaggcactgctccaccttcatccgctgcgccgagtccgccgggaacgtcgcgtccagcgagtcgaagatcgccgagtagtagtgcagggcctccaaaaaccttcatggaataca

SEQ ID NO: 8217 - DNA, 399 bp, Zea mays
  Clone ID: LIB148-030-Q1-E1-E5
agatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctgatgtgccggtgggaattggtcgtctgagaaattttgatagcgccgcctgatgtgttatcatcatt

SEQ ID NO: 8218 - DNA, 383 bp, Zea mays
  Clone ID: LIB148-030-Q1-E1-E6
gccagccagccagccgcggcagcgcggccatggcgcccagcctccctgccctcccctcccggcgccccggcgcagcagcgcgacagccgacagccggtcggccagccagcagcgcggggctgagcctgccaggccgcctgagttgacccctgtcctccccctccctgcgttttgttctgaggaagaaagcctgttttgcgaaaatgcctcgacaaaatagactgcaatacgttcctgagcttcgaggaatcgacagtcaagctttgacgaccaagtgatcaagctcttcgagttctacgagattgaataccctgagcatctgtttggtgaagggtgatgctggagacttcgctgatgacgatgatgagttttaagtccaacga

SEQ ID NO: 8219 - DNA, 392 bp, Zea mays
  Clone ID: LIB148-030-Q1-E1-E7
gtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcg

SEQ ID NO: 8220 - DNA, 303 bp, Zea mays
  Clone ID: LIB148-030-Q1-E1-E9
gatacgcttgggcaagcgcagaaacctcagtgcgcatgacgcggcgatgattgcgggcgcggacaccgtctgagtccgatagcggacgtcgatcggctcggcgtcgtcggagccgagcgcgtaaatggtaactgcgtagcgcaataccgcgataaggcaaatggcggcacggagctgcgtcgtgtggagcacgtcgtggatcgaagaccgctagcaacgagagatgttgcaccctgccagcagggttgcgttgaatttgccgcaaccggacatgaggcagcgaatttatgtagaagtggaatg

SEQ ID NO: 8221 - DNA, 139 bp, Zea mays
  Clone ID: LIB148-030-Q1-E1-F1
tcaggagacgccgacgccaacccatcgatctctcaccgcaaactacagctcgccagcgcccggagatgtgcccaacgaatcccgatagctctggccaagccgccgccgggtcctgttagaacacctagtggcagtaggg

SEQ ID NO: 8222 - DNA, 425 bp, Zea mays
  Clone ID: LIB148-030-Q1-E1-F10
gacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaaaggaaaccttgacgg

SEQ ID NO: 8223 - DNA, 373 bp, Zea mays
  Clone ID: LIB148-030-Q1-E1-D6
gccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccaaccccacctcatgatcctcggccatggccactgatg

SEQ ID NO: 8224 - DNA, 373 bp, Zea mays
  unsure at all n locations
  Clone ID: LIB148-030-Q1-E1-C2
cccacgcgtccgggcgctcaccgccgtcctaccttcatatacctagcagtgtctctgcatagaaagataaaaggtangangangcgcagtgcgtggtgggattatttgtgangagatattggagttattatatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgaagccacgtacaagcatgacccggtcgaagtcgccaaccaact

SEQ ID NO: 8225 - DNA, 373 bp, Zea mays
  unsure at all n locations
  Clone ID: LIB148-030-Q1-E1-C3
caggcgtcttcgtactcgcctatctccgcgactcanagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctg

SEQ ID NO: 8226 - DNA, 360 bp, Zea mays
  Clone ID: LIB148-030-Q1-E1-C4
ctcacgcgtccggaccaacgtcccagtaaacatgcccgccaacgccaaccagccggccaacgtcgttccaccgcaagtagtggtgtcgaagcttccgccggaggtgctggccaagctcccgcccgacgtgctggccagcatcccgccggagacgctggccaacatcgcggcgtcgcaggggcagctgcagacgagcgagatcctggccaccatccctgcggcgcaggcgcagggccagctgccggcggacctgccgccggatgtgctggccaagctcacggccgtgcagagccaactgccgggcaacattacgcccgagatgatgaccagtctcgccgccgtgcagcagcctgcagctgc

SEQ ID NO: 8227 - DNA, 404 bp, Zea mays
  Clone ID: LIB148-030-Q1-E1-C5
ggcaaccatcgcccctgctcctcttccttggaggccgggcggggctccctccatgggcgagcctccaaccttccctgtgtactctctcgaacccaagtgcaaggtgcccccgcgtgctctatggccgcacgcgcctggccttgccatctgtggagctcggcagccggagccgcgtatccgccccggctgtggtcgaccggcttcgcttcattaatctggcgcgagattacgagtcacctgaagatcatcctggtacctggaatctcaagtcccaggtcaagaccaggtaccgcaggatgaggcgcgtgaaggatgctgtgatgagttcgtgagtggtctaggccgtcgtctcccagtcaacttttgggttgctggacgttgtctccttataatgtaaatactta

SEQ ID NO: 8228 - DNA, 409 bp, Zea mays
  Clone ID: LIB148-030-Q1-E1-C6
ctcgctcgtttctcattcagcgcccgtacagccaccactctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccaaggcgctggagctccccg

SEQ ID NO: 8229 - DNA, 364 bp, Zea mays
  unsure at all n locations
  Clone ID: LIB148-030-Q1-E1-C7
ggttagggtggtgcgaggagtgcacctggccatctgcgaccccctcacccacagcagcgacccctacgtcgtcctccgccacggacagcagaaagtcaagtcaagtataaaataccgcacgatcaatccggaatggaacgaggaactcaccctgtccatcacaaacatgatgaacccggtcaagattgaactcttcgaccatgacacgttcaccaaggacgacagcatgggcaacgccgagttctccatcctcaacttcgtggagatcgccaagcaggacctgagcgacgtcnccgacggcacggtgatgaagacgatccacacggagaagggcagctgcctcgccaccgacaggcacatcacg

SEQ ID NO: 8230 - DNA, 379 bp, Zea mays
  Clone ID: LIB148-030-Q1-E1-C8
actctctgcaggggaagggggagaaacagaccaccagatcgatcgagacctcgccgtcgtccggcagggttaatataatttggttcttctccggccgggtgtgcatggcaaaacgacccacggtgcccaagttcggcacctgggacagcggcaatgccgggtacacggcctacttcgacaaggtgcgcgataacaagggcgcaacggcgccgccgctgcgccggccgcgcagccccaacgaccccgaccccgaccgcgagcccgagccataggaggggccaatgaggagagtccccccgccgtcgtcgtcgatgccggcgaccgcatgaggccaccgcgagccgccgccgccggggcggcgccacgggcagagccaccg

SEQ ID NO: 8231 - DNA, 152 bp, Zea mays
  Clone ID: LIB148-030-Q1-E1-C9
agttttgtgccggtctatcggccgccgctttcctcccctattcatcaagactgcaataactgtcgctacctatgcttctcacctgtgattttttggacacaatatgttaaggtccattcaattctaatgagacgcctgatgaggctactagc

SEQ ID NO: 8232 - DNA, 404 bp, Zea mays
  unsure at all n locations
  Clone ID: LIB148-030-Q1-E1-D10
cgagcagctgctgccggcggcgctagaggccaagaagcgcgctgggctacggacgtcgtcgtcgttctgacttctgagtttctgaccgaagctgaccgtaccacgtactagtcaaccaccaccaccatcaccgtttgcatgcatgcgtgcgtgcgtgcgcgcttgcgtggacgcagtatttgtacacgtgtgcatgccagcttgacgggtaactgacgtgtatgtagctactagctcggatctggatgtcttttgtgtctacgtagggtacgacgaggagacgatactgtaaggtggcatgcatgctctagggagctgttctggaacacccttccaaagacgctgacgtgtcgagcaatgccatccgatactatggacagcaagtcagcaacgagccanaagat

SEQ ID NO: 8233 - DNA, 418 bp, Zea mays
  unsure at all n locations
  Clone ID: LIB148-030-Q1-E1-D11
gcggtccgctcctctcccggccacctctaccccggacgcatgcatgtggacatgtcccaccgcgtccggctcgcggcggcggcgctcgtcgcggtcgcggcgctggccctggcgctcgcccccggcgccgcggccaagtggcagcggaccaggaacggcaccgtggtcagctacgaccgccgctcgctcatgttcgacggccaccgggaaatcttcttatccgggtccatccactacccgcggagcccgccggacatgtggccggagctcatcgccaaggccaagganggcgggctcaacaccatcgagacctacgtgttctggaacatccacgagcccgagaagggtgagttcaacttcgaggggcagaacgacgtggtgaggttcttccagctgatccaagagcacgacatgtacg

SEQ ID NO: 8234 - DNA, 366 bp, Zea mays
  Clone ID: LIB148-030-Q1-E1-D12
cggacgcgtggggcagctactaccagcagatgcaggacggcacgttgacgatgggcatctacggcaaggagaaggcgacggtgacggtgtcggacgggcggatggccaagctccctggcctcatcctgggctgctccgtcctggaggccggcggcagcgtggacgcccacgacggcgtgctctcgctggggaacggcgagatgtccttcgccgtccacgccgccaagcgcttcggccagcgcttctccttctgcctcctcagcgccaatagctcccgcgacgcctcgagctacctcaccttcggtcccaacccggcggtgatggggccgggcaccatggagacggacatcgtgtacaacgtggacg

SEQ ID NO: 8235 - DNA, 292 bp, Zea mays
  Clone ID: LIB148-030-Q1-E1-D2
ccccacccatcgcaacccgcaatgggtcgcgggggaagatccggaacacatcctcgccgcctcgccgccgctgcgcgacgctgccgttgtcgccgccagcctgcaggagttcgtcgcgcgcaattcgcacgcatcatcagacggcgtccggcggcagcgcaacgtctgcgtcacgtcgggcgggaccacggtgccgctggagcagcgatgcgtgcgctacatcgacaacgtcagctccggccaccgcggcgccgcgtccaccgagtatttcttaaaggctggctatgcggtc

SEQ ID NO: 8236 - DNA, 366 bp, Zea mays
  Clone ID: LIB148-030-Q1-E1-D3
cccacgcgtccggcgcgatcgagaagccaggaccaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaaccg

SEQ ID NO: 8237 - DNA, 357 bp, Zea mays
  Clone ID: LIB148-030-Q1-E1-D4
gtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcactttacatagctaacaagttgaattcatcatcaacatatccattgctggagctgttcttcaagaaccaggaaaagttctacaattctgccacatcatctctctcgggcccttccgtagctctaggaatgtcgaagatggctgcgcagactgttggtaactcagtatccgagtttctgtcgggcttcagcgatgggaagacagac

SEQ ID NO: 8238 - DNA, 347 bp, Zea mays
  Clone ID: LIB148-030-Q1-E1-D5
gcgagtcgctcaacgaccctaacaccaccatgggcgacctggtcccgctggtgcgcgacgtgtccgatggcctgtgcgtcaacgggaacgtgctgaaggcacaaaacgtctccggaaagatcatcatctgcgaagccggcggcgatgtcagcaccgcgaaggccaagatgctaaagggcatcggcgtggtcggaatgatcgtggtgaccccggagttgttcggtccggtaatcatcccgaggccgcacgccatcccgacggtgcaagtctctaacgcggcggggcagaagatcaaggcctacatccacaaggcgcggggcccgacggcgacgttcgtcttcaaaggg

SEQ ID NO: 8239 - DNA, 341 bp, Zea mays
  unsure at all n locations
  Clone ID: LIB148-030-Q1-E1-C11
gggtccgagcccgcgtccgacattagtgtnccgangccgggtncgcccgcgcgtcgcgggcgttccgggtggtggccagcgaccaccgcaaggccacctcatggcacgttctccccgctgactggaagttcggcgtcacgtaccaggcatccaagaacttctaagtagccactttccctcctcttcttcatcctgcatatgcccacaagcaaccatgcaaatgataacatgcatcatgcatgcatattcattctttcgctcatgcactccaatatggtgccggagttaaaaaaatgtaaatcaatgtgcaaactcaaatgacatcttaaccagttgtgatc

SEQ ID NO: 8240 - DNA, 368 bp, Zea mays
  Clone ID: LIB148-030-Q1-E1-A7
agggtccatccaagcgtccacacacacgtctggcatgctccccgacgccggggggccccacaacgatccggccccggccccgcgcggtcacagcaagccgggacatggcgcgcggcggcatcgcccgcctactcgccacgctcctcctcttcctcctgctcgccacgcccctcgcagacggagcttccgaggcagaggcggcgggcctcgcgcagggcgcgtccgaggcggcggcgccggacgcgggcgcggacgcgcagcagcagcagctcctgccgcggcccctcgtcatcgagctcccgtcgtcgctggccgaggacgaggacgagcccggcgccgacgccgtgccgccggacgtgcgctgcgcc

SEQ ID NO: 8241 - DNA, 331 bp, Zea mays
  Clone ID: LIB148-030-Q1-E1-A8
ctcgctggtccataaatatatatctatctatcgccatcgagcaattataatctcacagaataatcaacatcatggggcaagcctcatggctcgtcctcctcgccgtcgtggatctgctgtccgccgggctcctcacgcaggcgctgggtaacggtaagggaggcacgggacaccgttgccccgtcaacccgcaggtcgccgggatctgctcgcgcaccccgttcccggaggtgtgcacgtccaccgccgggcagcacgcgtccatgtacccggtcatcgacaacctgggcgtgctgaacatggacgtggacgcgttcgccaagcgcaacgc

SEQ ID NO: 8242 - DNA, 410 bp, Zea mays
  Clone ID: LIB148-030-Q1-E1-A9
cccacgcgtccgcccacgcgtccggcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaacggctgcaaccccaactacctggccgtgctggtgaagtatgtggcggac

SEQ ID NO: 8243 - DNA, 391 bp, Zea mays
  unsure at all n locations
  Clone ID: LIB148-030-Q1-E1-B1
ggtcgaggcgacccgtccggttcaggaacccctacgactgaagccggaaacccactctcttgcctcctcctcctccttaaggaagggtggcaaaacttcagcgaccgacgaagaagacgttccggtgcagcagcggttcatctggtcaaggaagagaaagatgccgcgcctttttcacgactccatcatctctcttctggattactctcagtgctgcagcgtaaactcgcgcgcagttccctgtaaaagctggagcttttctgagcgtgtangtgcgttggtggaacttgggcccccagtcccccacccaagatctcacctatctgcactgggctggccggctgggcccgccgccaaccaacgtgcttccgccattgcgtcgccgcataac

SEQ ID NO: 8244 - DNA, 410 bp, Zea mays
  Clone ID: LIB148-030-Q1-E1-B10
atcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgagga

SEQ ID NO: 8245 - DNA, 395 bp, Zea mays
  Clone ID: LIB148-030-Q1-E1-B11
tagggctcgtcgcggcaggtgccatgtccggtgggctggccgcatggcttcgtgtggggagcctgcatggccctccctgtgcatgagccgcatggccctgtgtaggcaggcagacgcaccgcgcatggccgaggcgcgctgctctgcgcatggccttgttgtgcatggcccgcaccgtcggtgcgctggggacagggcttgtccgcgccgagccttgccgtcgcggcgccgtccggtgtggtatagttgtggccaccgacgacataaaaatttcacgcatacagtgaaagcggagaggaagagtaggttccataccattatccttctccaactaggagcgatctgttttcttcctaccagcaatttctctccgttttctcgcgagtcgtgctgat

SEQ ID NO: 8246 - DNA, 414 bp, Zea mays
  Clone ID: LIB148-030-Q1-E1-B12
ccggtttccccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctgtttgggcaactgcgtggccttgcgctggtggtctttgctgccactgcaggtgcttcttcgtgctatttcctgtcg

SEQ ID NO: 8247 - DNA, 424 bp, Zea mays
  Clone ID: LIB148-030-Q1-E1-B2
gccggcgacaggataaatccacgacctttattagagagaagagatcctattcctacggttctcctcgcatcctgttgcttctgcgtgcggccagacgcgggcacgatatgcaggccgccgccgccgccccatggatgacgaagaccctgccggtgtttgggaaccacctcggcaaccccacgcgcctcacaagcgcctcctcgtccttccacagtacgcccgcctccttcgccaagtggaggaacaaatgggactgccacaagagcgaaaaaggagcacgaaaggcatccaggaattatgagaggtatgtagttcggcaaaaacgagcagaaggaaagaaggccctaaagggatatcttctctatggaaagccatgcctcatttacaggatggaacacaggtagctttgctaactcacatgcaa

SEQ ID NO: 8248 - DNA, 362 bp, Zea mays
  Clone ID: LIB148-030-Q1-E1-B4
cggacgcgtgggcccaaccccacccagcgcgacgaagccggggggcgatcgctccagcgccgccgcgccagcgacctcaccccccgggagccgccggcggtacccccctccctatcacgcctcatcgaatcctcagatctaagttttttttggttttgtgagttatccaaagttggaccgcaaagatgagtactgctaatcactatcagcacatcaagtcaaccaagcctgttgtagatctactaatattggagtgtttctttgcttaaaatgtggagatgttcatagggcacttggacctgacatttcaaaggttttatctgtaactttggatgattggtctgacagtgatatcgactcca

SEQ ID NO: 8249 - DNA, 376 bp, Zea mays
  Clone ID: LIB148-030-Q1-E1-B5
ggcggccgccctttttttttttttttgtggccgcacagcgaacgggcctcgcaggcctcgtgctttcagctcatgtattacagtattccctatggcccgtgtcaagcacgcacgcactatataaaatacacttatatacatacatgacgtgtactacgacaacgacgaagaagaatgaacagctagcagacgtaccggcggccgattcacaagtgtacagaaaacgatcgactccactccaactatacatatcctactatggcttttgctacaacccgatggatcagaaggcatgcatgcatgtacaggcaggcatggccatggcgatgcctgcaggctgcaaacgaatttgatcagatggctgacaccttgggga

SEQ ID NO: 8250 - DNA, 354 bp, Zea mays
  Clone ID: LIB148-030-Q1-E1-B6
cggacgcgtgggttccgccgctcctgcagcctctcgtggacgacgcgggtggccatcgcgctcgacgtcgccaggggcctcgccttcctccacgggtccgaccgccccatcatctaccgggacttcaagagctccaacatcttgctcgacgcgaaattcaacgccaagctgtcggacttcgggctcgccaaggaagggccgatgggcggtgagacgcacgtgtccaccagggtcatgggcacctacggctacgccgcgccggagtacgtagccaccgggcacctgacggtgatgagcgacgtgtacggcttcggcgtggtgctgctggagatgctggtgggacggcgcgcgctg

SEQ ID NO: 8251 - DNA, 399 bp, Zea mays
  Clone ID: LIB148-030-Q1-E1-B7
cgccccagcccagcgatcgccggagcccgggcctccccaccgctcgcgccggcggtcgccgatcatggccaccacccccgccgaggatccggagcctgggctacctcctcccaaggctctctgcgagcagccgcggcggcggcgcccgtgcgtcctccttagcttctcggcagcgcgcgaccgcttcctccggggccggttcctctcggcgggcctgcgccccttctccgtccgcctcccctcgccggccggcaccagcaccgtcgtccacctctgggcgccgccgcggtccgcgcggcggcccgtgctcctcctccacggcttcggcgcgtcggcgacgtggcagtgggccccgtacctccgcagcctcctcgcggccggcctcgaccccatcgtccc

SEQ ID NO: 8252 - DNA, 394 bp, Zea mays
  Clone ID: LIB148-030-Q1-E1-B8
gacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagaataaacttaacatgcgttaatcatgaaactggagtggttgacccgaagaagttcagcgttctgggtaactggcagcgtgattactcaatggaatacatcctaacccatctcaagaaagagatgaca

SEQ ID NO: 8253 - DNA, 419 bp, Zea mays
  Clone ID: LIB148-030-Q1-E1-B9
gattcatctcacgccctgcgcgcacccctgcctacacacacctgccgccgccttcccagcgcgcggacacgctccgcgccgtcgatcctccatggtcaaggcatcgggcgaaaccagcaaatatctcggggcgcggtggaacgtcccatgatgactgctcgcgcgggggggtccaatgctggcggaagtgttgccgtaaagcttcggcgcctcggaacttctcgccatcggtgatggtccaccgtggaccgcatccctccgcatctatgctcgactccacgcagcgtgaggacacgtgtcatctgaagagcaagttgggacctggaatctcaagccctaagtcaagaacaggtaccgcatgttgaggcgcttggaggatgctgccatgtgttcgtgagtggtctaggccgtcgtctccc

SEQ ID NO: 8254 - DNA, 62 bp, Zea mays
  Clone ID: LIB148-030-Q1-E1-C1
aggacgcgtgggtcgcccacgcgtccgaaaaaaaaaaaaatgcaagagaagcataccgacgg

SEQ ID NO: 8255 - DNA, 393 bp, Zea mays
  Clone ID: LIB148-030-Q1-E1-C10
aaactattcaagtcacagactattcaaaggatggctagtacaaaagatatttctcttccctcttccacagatgcaagtactttgagtgaacaaactccaaatcaggaaaaggatgctgtcacccttatgctcagtgttcgtcaggcaaatcttcttctttcctcgttatggactcaggcactgtcacctgaaaatgttccacggaattatgaagcaatttctcatacttacagcttgatgctattgttttctagagccaagggctcaggtgccgacgttttggttggtagctttcagcttgctttttcattaagaagtgtttcgttacaagcaggttttcttccaccttcacgcaggcgctctctttttactttggcaacttcaatgcttgtg

SEQ ID NO: 8256 - DNA, 430 bp, Zea mays
  Clone ID: LIB148-030-Q1-E1-A6
cgcaggcgggtggtcggcgtctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatgtccatggccacgggctgtgcccggtgcggttccgacacacgcgcgggatcagcgcggtggcaacaactgcaaggaccgcccgctgc

SEQ ID NO: 8257 - DNA, 99 bp, Zea mays
  Clone ID: LIB148-056-Q1-E1-H11
acaatacaagactctaaattgagtcagagaatggatggccctctgctttgtggaccaaaaagtggttcaggaatagcaatcagttgggctacatttttt

SEQ ID NO: 8258 - DNA, 396 bp, Zea mays
  Clone ID: LIB148-056-Q1-E1-H12
gcctccgcacgcctccacctcctcctgcggtcccaactcccatcctttggttcaggaggcaggcaggcaggaaggcaggttcgaggagggattggctccgctcctgctccattgcgcgtgatccggctcgttcttttgattgatctaggcgtttcttggatgtcctggaaggtcaaacggttgttggaagcctcgctgggtgcttcaacgaacgcgaaggtgttgctgtcatttagagcgtcttgattggatttgacctgttggcctggtggcgtgccgtcgttgattgagctcgaggatgatcaagtgggggctcagcagcggcacgcccgcggattcctactacgaggtccggtcagattgcacggacggtgtgcccaagagcaagttcaagat

SEQ ID NO: 8259 - DNA, 312 bp, Zea mays
  Clone ID: LIB148-056-Q1-E1-H2
gtgatgtcaatattatgccggtgcggtctccttggtcccagactctgcggaaaatgactttgatacttctcatgctactggctttctaagcagctccgccggcgagcgcggtggtccgcggtgacgagtgttatcaggtctgctacccagtccacatgattggcgtaggagtgatgtttcgaggtgaaagcagatctctgctagccacgggcccatggacacttacagggatcacgcttttgggttcctaacagccactattgtttcctatatcatttgcctagccatgcatgtcttgcattgcgtttttta

SEQ ID NO: 8260 - DNA, 430 bp, Zea mays
  Clone ID: LIB148-056-Q1-E1-H4
atggctccggtgattatttcgacaaggaaaaggaggagaaccccgaggaggacgctgcgcccgtcgacgtctccgcggacggcgtgtatgtgcctctcaaggaagagaaatccggcgaagacgccacgccggtcgacgtctccaacaacaccggcaaatacgtatcttcttcttccaaggcaaacggcaagcccacgggaggtcagcccgcagagagctccaccaccgccaccgcggatgcgtacgcgtctccaaagcagaaagtcgtcagcagccagcccatggccagcgccgctcctgacgagcttccgctggcggccaagagctccaccacctccgacgcgtacgcatctccaaggcagcagcaggtcgccagcagccagcccatgtctggtggcgctcccgacgagcttccacggtggccaagacc

SEQ ID NO: 8261 - DNA, 420 bp, Zea mays
  Clone ID: LIB148-056-Q1-E1-H5
accacgcgtccgatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgcgattgcctgtattcggttggattcggtttatatatatatttaagtactttagtttgggtctgaacatgtcgattga

SEQ ID NO: 8262 - DNA, 441 bp, Zea mays
  unsure at all n locations
  Clone ID: LIB148-056-Q1-E1-H6
cgcgtccgatttgaggccggtgcggtctccttgcttcgtgttggtgcggaaaaataatccgcggcgtgcacggctattggcttcgtgttctgctcgattgcgccccccacccctcctcggtagcgcgcaagatgaatgaagattggtcctggtctggttggcgtatcagtagatttcattttcattgcgagtgtgccgttttctttgaattcttgggcgggttcgagtgaggttttggggtttcgccttgctttcangggcggtgttgttccgatgacgtctgccaagtagtaattaattttacaggattanttttggtgctgtttctttgaatgataaaccgaaatccttgtttttttttgaaaggattaacatcatattgctttttaagtgctgtttggttcatcaacggtaacatatatagcaacagtaatgattcat

SEQ ID NO: 8263 - DNA, 428 bp, Zea mays
  Clone ID: LIB148-056-Q1-E1-H7
accacgcgtccgattcactaacccaagacaaaacatggatgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagattaagtgcgataagcctgtggagtgctccggcaagcccgtggtggtgcacatcacggacatgaactatgagccta

SEQ ID NO: 8264 - DNA, 412 bp, Zea mays
  Clone ID: LIB148-056-Q1-E1-H8
atggctcttgctattgtggcaccaggtaatgaaaacaagatgccaacttctcaagacttatttgcccttgacaagactggatgggaattggcactggttactgcaccaagtaaccacacaaatcaacaagtggacaatcaattggctgggggatttgacaagctattgctagacagtctttacgaagacgaggcaaggaggcagcaaatagccagtgtgacctacactggaagtactgcagcaaacccatttgaccacagtgatccatcttgcaaagtcagcccatgggcagcgccgctcctgacgagcttccgctggcggccaagagctccaccacctccgacgcgtacgcatctccaaggcagcagcaagtcgccagcagccagcccatgtctggtggcgctcccgacga

SEQ ID NO: 8265 - DNA, 414 bp, Zea mays
  Clone ID: LIB148-056-Q1-E1-H9
gtcaacatcttcatgtacggcgacgggcctaagcaaagccgcgtgaccggccgcaagagcttcgccgacggcatcaccaccatgaagaccgccaccttctccgtcgaggcgtccgggttcatctgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgacggcgcacgggcgcaccgaccccaac

SEQ ID NO: 8266 - DNA, 249 bp, Zea mays
  Clone ID: LIB148-057-Q1-E1-A1
gcgtcaacgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcacggcatcggctggggctggggcggcgccatctgggcgttcaacgtcgttgcgtagaccccgctggacgtcctcaaatccgccatccgcgaggcgctctccggc

SEQ ID NO: 8267 - DNA, 407 bp, Zea mays
  Clone ID: LIB148-057-Q1-E1-A10
agcatgagcaccggaacatgcacatatctcttctaagagtatatacaagagccttagttctgttactgttagagttggacatggggaggcagcaccgcaggagattgagtgcgtgttgccttaagggtagactgcgcaggtgaggtgacaaagagcatgcactgcactgcactgcaccacatatgtgcatcgaaggttgaagacgaccagcacctccggtcagaagagaggaaggagaggcggctggagaaagagagccaggtcagcagggtgttcaaaccgccggcggtaccaacgaatcttcctctttttcttcttttgcttgaatttatgccttgtgacgtgcatctggaggcacgactgatcacaaaagaatacgagtttttttaaagtaacgcagcgcgaaa

SEQ ID NO: 8268 - DNA, 395 bp, Zea mays
  unsure at all n locations
  Clone ID: LIB148-057-Q1-E1-A11
ttcaacggacgcataggctaatcaacaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcanaccaggcccctgacatggctgcgcgcc

SEQ ID NO: 8269 - DNA, 420 bp, Zea mays
  Clone ID: LIB148-057-Q1-E1-A2
acgcgtcaacatgaactcattggatgttgcaaaaggcaaataaagaagaaaacaaatatcacaaatgcagtggtatagaaccacaatacatggttcatgataggcaaacatacttacttttagttcaggttattgagatttgtgctggacgaattggtgaggctgtgtcaatgataaacaacaaggataatgattggtttattcaactcacatgtgcctacttgtacagtcttaaccatagggatttactgtcccaggatactatgaagaattaagccagaattaaattggatttaaaaaggacatccaattgaatatgcaagagcttgctcaatctctccttttgagatgtgatgagaaaactagcaataagaagaccaagaaaaccttatgggatgtcctaagaagtttatactatgc

SEQ ID NO: 8270 - DNA, 420 bp, Zea mays
  Clone ID: LIB148-057-Q1-E1-A3
cacacgtccaggactggcttcaaaaaaatgcaaccaaaaacttccgaccggacagccttcttgggaaaggagggtttgggcatgtctacaaaggttggattgatgagcacacgcttgctccttcaagacctgggagtggtatggttgttgctgtgaagaagcttaaaccggaaggttttcaaggacacaaggaatggctgacagaggttgattaccttggccaacttcaccacaagaatcttgttaagctcattggttattgctcagatggtgacaaccggcttctggtgtatgaatttatgcccaagggaagtttggagaaccatctgtttagaagaagtgctgatcctttgtcatgggcaataaggctcaaagttgccattggagctgctaggggcttgtcatttttacatgatgctg

SEQ ID NO: 8271 - DNA, 430 bp, Zea mays
  Clone ID: LIB148-057-Q1-E1-A4
gggtcgagacaagcctctataatgggtcctcaacatgaagaccgccaccttctccgtcgaggcgtccgggttcatctgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatccacttcatcctccgcaactcggcggcagtgttccagaactgcctcatcatcacgcggcggcccatggacaaccatcagaactcggtgacggcgcacgggcgcaccgaccccaacatgaagtccgggctcgtcatccagaactgccgcctggtgcccgaccagaagctgttcccggac

SEQ ID NO: 8272 - DNA, 387 bp, Zea mays
  Clone ID: LIB148-057-Q1-E1-A5
tgtcaaggactggccggacgctaaagcgacatggtatggcaagccgacgggtgccggtcccgacgataacggtggctgctgctggtacaacgacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttatcacgcactgcgttcggcgccatggccaagaagggcgatgaggagaagctgcgcaaggctggcatcatcgacatgcagttccgaatggttaagtgcaagtacgactc

SEQ ID NO: 8273 - DNA, 408 bp, Zea mays
  Clone ID: LIB148-056-Q1-E1-H10
tctaaattgagtcatattacgcctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgccg

SEQ ID NO: 8274 - DNA, 431 bp, Zea mays
  Clone ID: LIB148-056-Q1-E1-F6
agccgaggaacgggcctcagtgctcgccgccagcagcaaggtctctgatgaggcggcggcggcggctaccgcggtgccgcctgcaggtgccaagacctccagcagcaacgatgcccgcgacggcgccatgggcagcgtgcaggacgagccgcggcagcagcgccacgatgactatcaccaccccgagatcgtccccgagaagatcatacacgaggacgcgttgccggtcgttgctgcggagaaggagactgccgccgccgccgcaacctcgaaggaggaggaggaggtggagtcgcccaagaaaggagcggctctgtcgccggtgccggaggctatcgtcatcgccacagccgcaacctcgaaggaggaggaggaggaggtggagtcgcccaagaaagaagcggctctgtcgccggcgccggagcctatcg

SEQ ID NO: 8275 - DNA, 422 bp, Zea mays
  Clone ID: LIB148-056-Q1-E1-F7
agcaagagccgacttcatctccctccacatgccgctgataccgacgacgtccaagatcttcaacgacgagtccttcgcaaagatgaagactggtgtccggatcatcaacgtggccaggggtggagtgatcgacgaagacgctctggtcagggcgcttgactccggcaaagttgcccaggcggctcttgatgtcttcaccgtggagcccccgcccaaggacagcaagctggtgttgcatgagaatgtcactgtaacaccccaccttggagcaagcactgtcgaggctcaggaaggcgtcgctatcgagattgcggaagccgtggttggtgcgctgagaggggagctcgcagcaaccgctgtgaatgcgcccatggtcccagctgagatccggtcagagctggctccatatgtttctctggccg

SEQ ID NO: 8276 - DNA, 146 bp, Zea mays
  Clone ID: LIB148-056-Q1-E1-F8
acgaaaaggaaagctctctcattgccaaattgcccccgactcaagcgcccggcgccgccggcgttggtggaatcgattgaaccggtcatcccggagaatctaaggacgttggtttcacctcacgtttttgtgcatggaatatgagg

SEQ ID NO: 8277 - DNA, 435 bp, Zea mays
  Clone ID: LIB148-056-Q1-E1-F9
ctcgcgagtcgacacacgcctccaaaggatctcagcatagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagcc

SEQ ID NO: 8278 - DNA, 432 bp, Zea mays
  Clone ID: LIB148-056-Q1-E1-G1
cacacgcgtcagtatgttccctggcattgctgacaggatgagcaaggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagcctcccgccccgtttctttctccttttgttgctgtttcttcattagcatgaacaaagttttctgccggtctgtcggcagccgctttctcctattcatcaagactgtaatgtctattgttgctacctaatgcttctcacttgtcattttggacaca

SEQ ID NO: 8279 - DNA, 413 bp, Zea mays
  Clone ID: LIB148-056-Q1-E1-G10
acaacatcgacttcatcttcggcagcggccagtccatcttccagtgccccgagatcttcgtgaggcctgaccggcggacggagatccgcggctccatcaccgcgcaggtgcggcaggaggaggacagcagcggcttcgtcttcctcaagggcaaggtgtacggcgtcggggaggtgtacctgggccgcgtcaccgcgccggactcgcgcgtcatcttcgccgacacctacctctccaagaccatccacccggccggctggacaaccatacgctacagcggcagcaccgacaaggtgacgctcgccgagttcaactgcactgggccgggcgctgacgtgacgaaccgcgtgccatggtcgcagaggttctctcgcgacgacgcggccaagtacctcaccatcgacttcatcaag

SEQ ID NO: 8280 - DNA, 424 bp, Zea mays
  Clone ID: LIB148-056-Q1-E1-G12
tcgacacacgcctctacacacgcgttctgatacttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggagggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgat

SEQ ID NO: 8281 - DNA, 414 bp, Zea mays
  Clone ID: LIB148-056-Q1-E1-G3
aaggtttcgactcaatcaaggtagcttccagcgtgctcaaacaagggttccaaggttttgcaagacaagcgtgtgtgtgagagagagacctgcattgtttggtcgccactactaccatgcgcgatggccgcgtcgctgtcctcggcgctgagctccatggaggtgatgctggacgcgctcatgcagcgagggataggcaagccggaagaagccagcagcaagcccaaagaagaggagccgccaccggcgctgcccagccgcccgacggggcgaggcagactcccggcgctgcataggcccggcggcacagcagcggctccgtggatccaccggccatccccggtaccgcagccaacgcaggaagacgatcaggagacatgtctggtcggtcaggagctggaaagacgggcgggc

SEQ ID NO: 8282 - DNA, 439 bp, Zea mays
  unsure at all n locations
  Clone ID: LIB148-056-Q1-E1-G4
acccacgcctccgaccacgcgtacgctcctaccccacccgccacccgtcgacgccggcctctctcctcacccgctcggagagtcggagcccggcggccggagggcgacgtcgtccctaataaatactaataatttatcactatacataaccaatatataagccatgggcaagcgcagcgtcnctcggtaccctgaggacnangacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccatc

SEQ ID NO: 8283 - DNA, 423 bp, Zea mays
  Clone ID: LIB148-056-Q1-E1-G5
agcgtggttgctcctgctcgctattcttagccccagagctcgcgtgggacatgctcacggaggtgtccaggccgccttacatcccgccgccggccgacgaggacctcgcggacgtcgaagggttcgacgtgaggggccacttcaaggaccttcaccagccgccgcctcccaagtccgcgtcggagtcgtcctcgtccgagttctcgacggagttctgactgtgagctcgggctagcttcttttgcgctttggtcctcggtagattactatattgtaaccagagggtcgagggtgtctgtactgtacatacatggagacggggatggtgctgtaaattcgacgtagagttggtgtggttgtgcaaacattttgggaagcgcgagggctcgccggcgcactgtgctcgaggcattttcttcgtgt

SEQ ID NO: 8284 - DNA, 441 bp, Zea mays
  Clone ID: LIB148-056-Q1-E1-G6
cgcgcgtacgctcctatccgcacaccttgagaatcgactcgtgactcactcatcgaggttggggccagtcggaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatc

SEQ ID NO: 8285 - DNA, 426 bp, Zea mays
  Clone ID: LIB148-056-Q1-E1-G7
cacgccgcttgcgcacaccttgcagatctgcggttgtcacacatcgcatcgaggttgcgggccgcgcagcagtgttcagcctgttcagattcttgaggaaagcgagacgaaggatggcacgtgtttcagggaggctgtcctatgtcgtgtttctcctcctcagtctcagcagacagtgggaaccgatcgatgccatcaatgggagtagccatgcccatgcatgccttgataatgggtaaagcgacacagcaggaggacggtgaagaatgaggagaggtgcacggataaggaagagagtcaatgcttatcgccgagtctccagttcaagggcttctgctgtaatagcgatagatgcgccgaggtgtgcatgaagtgagagctttcgcggtggcgagtgcaggcgggacgtgggcatgcacaggtgct

SEQ ID NO: 8286 - DNA, 431 bp, Zea mays
  unsure at all n locations
  Clone ID: LIB148-056-Q1-E1-G8
accacgcgtccgcgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttantatatttgtattccacattatatataagaaatac

SEQ ID NO: 8287 - DNA, 415 bp, Zea mays
  unsure at all n locations
  Clone ID: LIB148-056-Q1-E1-G9
aaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaaaggcatcacggcgccggccatgaaggtctgccangaggagtgcgacaaggcgtacgtggtgaaggcggccgaggtcaccaaggcctgcagcgtcacctgcgccaag

SEQ ID NO: 8288 - DNA, 354 bp, Zea mays
  Clone ID: LIB148-056-Q1-E1-F5
accaggcgtccggaagcagaccagcagatcgatcgagacctcgccgtcgtccggcagggttaatttggttcttctccggccgggtgtgcatggcaaaacgacccacggtgcccaagttcggcacctgggacagcggcgatgccgggtacacggcctacttcgacaaggtgcgcgagaacaagggcgccacggcgccgccgctgcgccggccgcgcagccccaacgaccccgacgccgagcgcgagcccgagccagaggaggggccaatgaggagagtccccccgccgtcgtcgtcgaggccggcgagcgcgggaggccaccggcgagccgccgccgccggggcagcgccacggg

SEQ ID NO: 8289 - DNA, 416 bp, Zea mays
  Clone ID: LIB148-056-Q1-E1-D6
accacgcgtccgcccacgcgtccgcccacgcgtccggtgaccttcgtggacactccaggagttttatcaggggagaagcagcggacgcagcgcagctacgatttcaccggagtcacgtcgtggtttgcggccaagtgcgacctgatccttctcctgtttgatccgcataagcttgacatcagcgatgagttcaagcgtgtgatcgggtctctccgcgggcatgatgacaagatacgcatagttctcaacaaggccgaccaagttgatgcacagcagctgatgagagtgtacggagcactgctgtggtcgctcgggaaagtcctgaacacaccagaagtcatgcgtgtctacataggttcattcaacgacaagccgatcagggagacagcggctgggccgctgggcatggagctgtt

SEQ ID NO: 8290 - DNA, 136 bp, Zea mays
  Clone ID: LIB148-056-Q1-E1-D7
accacgcgtccgcaggaacgaagcaaaggaaaagtgaaggaaagtttcccatatgttttatttcctgcgttttccctacaaaatcagccatatgggaaacgcaggaaataaaacattggcttggacctcttttttc

SEQ ID NO: 8291 - DNA, 431 bp, Zea mays
  Clone ID: LIB148-056-Q1-E1-D8
agttgccctacctgcaggcaagagctgggcgacatcaggtgcctggcgctggagaaagtcgccgagtcgctggagctcccctgcaggtactactcgctggggtgccccgagatcatgccttactacagcaagataaagcacgaggcgcagtgcggcctgagaccgtacaactgcccctacgccggctccgagtgcagcgcggccggcgacatcccttccctcgtctcccacctgagggacgatcacaaggtggacatgcacagcggctgcaccttcaaccacagatacgtgaaatccaacccgcgggacgtggagaacgccacctggatgctgacggtgttccactgcttcggccactacttctgcctgcacttcgaggcgttccagctcgggatggcgcccgtgtacatggacttcctccgcttcatggg

SEQ ID NO: 8292 - DNA, 413 bp, Zea mays
  Clone ID: LIB148-056-Q1-E1-D9
agaacgtgctgatcgacacagtgacggtcaaggcccccggcgacagccccaacacggacggcatccacatcggcgactctagcaacgtgaccatcagcagcaccaccatcggcgtcggcgacgactgcatctccatcggccccgggagcaagatgatccgcatccatggcgtcaagtgcggcccatgccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccaggagtactgccccaacaac

SEQ ID NO: 8293 - DNA, 291 bp, Zea mays
  Clone ID: LIB148-056-Q1-E1-E10
cgacacaggcctccaagcgagccaagccagcgcgaccagcgaggagtgcactgttgcttggggagtctgtaatcatgcttttcacgtccactgcgtcagcaggtggcttaagactcgtcaagtgtgcccaggggagaacagtgggtgggagttccagagatagggccacgagttcctgggcacgctcatgtgatgttggggcttacttctagtgagtgctaccactcgagtgtagttttttctgcgaggcagctccatcgtttaacgccttggctgcgtgcaggtagcaga

SEQ ID NO: 8294 - DNA, 412 bp, Zea mays
  Clone ID: LIB148-056-Q1-E1-E11
accacgcgtccgcggacgcgtgggcgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacg

SEQ ID NO: 8295 - DNA, 364 bp, Zea mays
  Clone ID: LIB148-056-Q1-E1-E3
ggtcaaacagagctcaggaggaggctctctctcctgtcctacctgttcgctcccggctccccctccatctctttcgccacacgcgcgagaggggggagaggaaacagctagcagcgagcgaggaacgaagagggtgcttcgcacgtgcatgtgagatcgggcgatcccgatcgtcggccggcgcgaattgaactaacgacgacgtacgtgcgaccgggccgggcgttggattattccggcctgagcaatgggcaagatcgagtacggcgtggtggcgcgcggcgcggtggtgctggcggagcactacggcgcggcggcggccggcggcaacgcgggcgccgtggcgcggcaggtcctggagcgt

SEQ ID NO: 8296 - DNA, 428 bp, Zea mays
  unsure at all n locations
  Clone ID: LIB148-056-Q1-E1-E4
agaatactcccatgacgccactaacaaattcaacatttaccctgagcaaatcccttcctggcttgttgactggattcctgagaaaggaggttaccttatanggaatctgcagccagctcacatggattttaggttcttctctcttggcaacctttgggccatagcttcgtctctaactactccaaaacaagctgagggaattcttagccttattgaagaaaaatgggatgatcttgtagcaaacatgcccctgaagatatgcttccctgcaatggaagatgatgaatggcgcattattactggcagtgatcctaaaaataccccatggtcatatcataatggtggatcttggccaaccttattgtggcagttcacattggcctgcataaaaatgggcagaccagaattggcccggagagccattgctg

SEQ ID NO: 8297 - DNA, 402 bp, Zea mays
  Clone ID: LIB148-056-Q1-E1-E7
accacgcgtccgccacgcgtccgaaactatggggcaagccttcccacggcttgtcctcctcgccctcgtggcgttgttgtctgccggcctcttcccgcaagcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgaccatttggccgtgctgaacatgcaggtggccgcattcgccaagcgcacagcgcaggcgcggaagcacgtcgcggtggcggcccgcactattccaccgccgcaggcacaggccctcagaacctgcgacacgatgtacatgaacacgcaggacgccatcggcgc

SEQ ID NO: 8298 - DNA, 407 bp, Zea mays
  Clone ID: LIB148-056-Q1-E1-E8
accacgcgtccgccacgcgtccgaaactatggggcaagccttcccacggcttgtcctcctcgccctcgtggcgttgttgtcggccggcctcttcccgcaggcgttagggaacggcaagggcaaggtgcatggcggcggtgccgtcaacccgctggatgccggcatctgctctcgcgccccattcccagacgtttgcacggccacagccgggcgccatgcatccaagtacccggtcatcgaccatttggccgtgctgaacatgcaagtggccgcgttcgccaagcgcacagcgcatgcgcggaagcacgtcgcggtggcgggccgcactagtcgagcgccgcagggacaggccctcagaacctgcgacacgatgtacatgaacacgcaggacgccatcggcgcggcgc

SEQ ID NO: 8299 - DNA, 127 bp, Zea mays
  Clone ID: LIB148-056-Q1-E1-E9
acgcgaccagcgaggactgcagtgttgcttggggagtctgtaatcatgcttttcacttccactgcatcagcaggtggcttaagactcgtcaagtgtgcccaggatataatagtgagtgggagttcgt

SEQ ID NO: 8300 - DNA, 428 bp, Zea mays
  Clone ID: LIB148-056-Q1-E1-F1
ctgacatcaacggcctcatgaccgacatggtcaagttcctgcacgaccacggcgcgcccttcgtcgtcaacatctaccccttcctcagcctgtaccagagcgacaacttccccttcgagttcgccttcttcgacggcggcaagaacatccaggacaagggcggcgtcacctactccaatgtgttcgacgccaactacgacacgctcgtgcacgcgctgaagaaggccggcgtgcccgacctcaaggtcatcgtcggcgaggccggctggcctaccgatggcaacaagtacgccaacttcaagctggcgcggcggttctacgacgggctcctcaggaagctggccaagaacgaaggcaccccggtccggaagggcaagatggaggtctacctgttcggcctattcgacgaggacatgaagagcatcgcg

SEQ ID NO: 8301 - DNA, 434 bp, Zea mays
  Clone ID: LIB148-056-Q1-E1-F12
tcgcgagtcgatacacgcctctagcatgtatcgtgaaagcgacgaggctggccttggcagcggcgttggttctgtgcctgcttctggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatgggcctgtttggttcagcttttttctgaccagcttttctgaaaatctggttgtgggaagaatctagctgtggggagaatctgagtatcattacgattacgtgtgaggaagataaagttgttcatagggctcaggatctagaaagtaacggattcctactattac

SEQ ID NO: 8302 - DNA, 435 bp, Zea mays
  Clone ID: LIB148-056-Q1-E1-F2
ctaccctcgacgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactg

SEQ ID NO: 8303 - DNA, 417 bp, Zea mays
  Clone ID: LIB148-056-Q1-E1-F3
aaagacgacacgtatcctaagaaacaagctttgtttgatggggaaacacaattagctggagacgagcattctcagtcacagaaaatttcgcgtgggcggattgaacatcctcacgtgtcacctcgtcacgaggaacttatcgccacttcaattcatacccctggatcaccctattcttgtgatgtcgcgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctggggaagttctcggtgctgccataggtggagctaccctctcagaa

SEQ ID NO: 8304 - DNA, 261 bp, Zea mays
  Clone ID: LIB148-056-Q1-E1-F4
gacgacaacgtgtcctaagaggacaagctttgtttgcatggggaaacacaattagctggtagacgagcattctcagtcacagaaaatttcccgtggccggattgagcatccgtcacgtgggagctcttcacgatgaacttatccccacttcaattcatacccctggatcaccctagtcttgtgatgtcgcgatgggtgaagaggccatagacgccatctgcaagagcgacgggacagcaccagagtgagaagattgccatc

SEQ ID NO: 8305 - DNA, 421 bp, Zea mays
  Clone ID: LIB148-056-Q1-E1-D5
aaacaaaccacagattgagcagctcatattttggtgtcagtattggattttagttgccctgttgacagttttggagagatttggagattttacaatatcatggctaccgttttactcagaagcaaaggtgttgttctttgtatatttgtggtaccctaagacaaagggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacgttttaaaatatgttgctgcccagtcgccttctcggaaatcaaggctgcaccctcatcaggaaccacagcagcagcaagcacaagtgcaggtggag

SEQ ID NO: 8306 - DNA, 377 bp, Zea mays
  unsure at all n locations
  Clone ID: LIB148-029-Q1-E1-H11
cgctgagcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcnngccgcaccatcccgccgc

SEQ ID NO: 8307 - DNA, 367 bp, Zea mays
  Clone ID: LIB148-029-Q1-E1-H12
gaaaaatcgtggatggacgggatgccaggcacgcagtgccccatcgcgcccaacaccaacttcacgtacaagtggcagcccaaggaccagatcggcagcttcttctacttcccgtccatcggcatgcagcgggcggcgggcgggtacggcgccatcagcgtggtgagccgcctcctcatcccggtccccttcgaccagccgccgccggagagcgaccacgcggtgctcatcggcgactggtacaccaaggaccacgaggtgctggcgcgccagctcgacgccggcaagagcgtgggccgccccgcgggcgtgctcatcaacggcaagggaggcaaggacctggaggccgccgcgcccatgctcacct

SEQ ID NO: 8308 - DNA, 268 bp, Zea mays
  Clone ID: LIB148-029-Q1-E1-H2
aacgtgaggtccataattctcgtctgctccctctagtgcgattcagtcatatgacgtgtaggaagctgtggaaggtcctgaggagcagcagcggtggcggcgatctggatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaacgatgaggtcaagacgg

SEQ ID NO: 8309 - DNA, 224 bp, Zea mays
  Clone ID: LIB148-029-Q1-E1-H3
ccgagagcacaacgtgtaccgtctctccccagcgtgcgcgcgcgcgtggtcggaggctgccgtcgctcgcgtcggccgcccccgccggccagcgagagcgagggacaacgaccgaccgaccgaccagctcgaggtgaatgaacagccgcataccgttcctccagaaaatgcaccgctggatcatccctagctgcggcgacacccgccagccgcgcccttcctcc

SEQ ID NO: 8310 - DNA, 266 bp, Zea mays
  Clone ID: LIB148-029-Q1-E1-H4
gcgaaaggcaagggacgtaagaagtcgtctacttcatgaattaaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgc

SEQ ID NO: 8311 - DNA, 273 bp, Zea mays
  Clone ID: LIB148-029-Q1-E1-H5
tgcatgagatctgcgtagtcagccacccatcgaggttggggccgccagcacgttcagccgttcctgttcttgatataacgagagaaggatggcagtgtttcagggagctgtcgtattcttgtttctcctcctcgtcgcagcagaagtgggaaccatcgatgccaaaatgggagtagccatgcccatgcatgccttgataatggagaaagcgaaacagcatgagacggagaataaggaggagaaaagcagggagaaggaagagagtcaatgctt

SEQ ID NO: 8312 - DNA, 297 bp, Zea mays
  Clone ID: LIB148-029-Q1-E1-H6
tctagaagtcccgggccgacttcgcctcgacgtcgtctaatccacccggccttaaggctctctagtgcgattcagtcatatgacgtgtaggaagctgcggaaggtcctagcctgcacagatatagaccacgagcaagcaaccaagtgtgtcaccgaggctcttctgttcaaagctgatgcaccacaccggcaacgagctcttgcagcggacgcaataacctgccggaaattcgccgagcgggcttacaagtacagaccactcaaagttgttgagtttgatcggccctacccacagtg

SEQ ID NO: 8313 - DNA, 269 bp, Zea mays
  Clone ID: LIB148-029-Q1-E1-H7
gctcggcgcgatgcggcatgccaacctgctgccgccgctggcctaccactaccgcaaggacgagaagctcctggtctacgattacatccccaagggcagcctgctgtacgtcctccacggcgaccggggcatggactacgcggcgctggactggccgacgcggctcaaggtggccgtcggcgtcgcgcgcggcacggcgttcctccacacggcgctcgccggacacgaggcgccccacggcaacctcaagtcggccaacgtcctcctcg

SEQ ID NO: 8314 - DNA, 389 bp, Zea mays
  unsure at all n locations
  Clone ID: LIB148-029-Q1-E1-H9
caacttcacgtaccactggcagcccaaggaccagatcggcagcttcttctactaccccagcaccggcatgcagcgggcggcgggcgcctacgggctgatcagcgtccacagccgtgacctgatcccggtgcccttcgacacgccggccgacgacttcccggtgctcatcggcgactggtacaccaaggaccacgccgtgctggccaagaacctggacgccggcaaggggatcgggcggccggcggggctggtgatcaacggcaagaacgagaaggacgcgtcgaacccgcccatgtacaacgtggaggccggcaagacgtaccggttccgcgtgtgcaacgtgggcatcaaggcgtccttcaacgtccgcatccangaccacatcatga

SEQ ID NO: 8315 - DNA, 429 bp, Zea mays
  Clone ID: LIB148-030-Q1-E1-A1
ggctccccaaagatagcatagcagcagcactcacaatagcaaaaaccaccatccgtcgtcgccaaccgtagcaaggagccaaggacatcaccaccgcccagcaataatggcgcagagcatgaagattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccaaggcgccggtgccgccggcgccgcgccggcttgatcgcccagcgcattcatcgcttcagctcgatataatcgctgctccgtcagcaacccacatatgattcgatcaatcttcctcctctaatttctcgaccccgtcgaattttt

SEQ ID NO: 8316 - DNA, 420 bp, Zea mays
  Clone ID: LIB148-030-Q1-E1-A10
cccacgcgtccgcccacgcgtccggtcaaggtctcctccatgcccgcgctctcctaccgtgagccggatgggtccaggatgctgccagcccatggcgccgggagcgacggcgacgtctcctcgctggggcactgccctccgggacaggacctccaccgtggtgcgacatgggacttcaccttcgcggccgcgaagccggcgaagaggaagacggcgagcgatgtggggttctccgacatgttcgccgtcgcaccggcgggggattggttcggcggcgggtcgacggcgccatcgccggggccgtcatcggccgtcaccgacgaagagtttaacctggagatgcatcagttcatgtcaatgctaccactgtctgacgagcacggctggaacgcataatgcggccgggtaaaatggaaatcg

SEQ ID NO: 8317 - DNA, 392 bp, Zea mays
  Clone ID: LIB148-030-Q1-E1-A11
cgatcgccgtcggtgcagccattctggcagccggcgccaacaccgacgccgacgcaaaggccaaggacgcccctgtcatctcgccgcccttcgagagcatcccggagctccacgagggcgccatgaagggaaagtgggaagctactccttcgccttcccaaacttggtagaggacaagatgaactactccaaggagccgtctcagcaggacctccagccggagccagcagcggcatcggcggaggcggccaacaaggccgtgccaacaccggcagaagctgaagcgagggcagacggcagaggcgcagccgcagacgagcagcaacccggaggcgactccggttccgggagcaggacgaaagggcggcttgttctcaagcttcccctgctgc

SEQ ID NO: 8318 - DNA, 400 bp, Zea mays
  Clone ID: LIB148-030-Q1-E1-A12
cccacgcgtccgcccgtcgcgcgtccgcgaccgcatctcgcgctcggtgcgccaggagctggaccagccgctcaactacgcgcgcgtctacctcgccgacacgctgccgcgcgacgtgcgccgcgtcacgtacctcgactccgacgtggtcgtggtggacgacgtccggacgctggcgtccgtggacctcgcgggccacgtggtggcggcgcccgagtactgccacgccaacttcagcaactacttcacggacgccttctggtcgcacccggcgctcaacggcaccttccacgggcgccgcccatgctacttcaacacgggcgtcatggtcatggacgtcgacaagtggcgcgccggcgggtacacgcgccgggtggaggagtggatggccgtgcagaag

SEQ ID NO: 8319 - DNA, 382 bp, Zea mays
  Clone ID: LIB148-030-Q1-E1-A2
gtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcccggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactac

SEQ ID NO: 8320 - DNA, 360 bp, Zea mays
  Clone ID: LIB148-030-Q1-E1-A3
caggccacgcgtccggcggactttagatttaagagacgaagcatctagagttatggttgccgctcctattctagcatttgtgacaacccacattctgtacctcaacttctacgaacttgacaaaggcctgaacatgaaggtttgtactgtgataatcattgctcagtgtctcctatgggcactgtgggctgtcatgactcggcatccttcacggctgaagatcatatttgttgccatcggaggtgcggctgcagtacttctggaagcttctgacattcctccgcgatggggatatgtggatggccgtgctatatgccttgctgtggctatccccctttcgtacctttggtggagctttgc

SEQ ID NO: 8321 - DNA, 440 bp, Zea mays
  unsure at all n locations
  Clone ID: LIB148-030-Q1-E1-A4
agaaacaggcacacaagaacaaatacctcgccaccaacaatggcctccaggtcctccatcctacttgcaacggcgatgctggttgcgctgtttgcggttggtttgtgcaccaccccgctcaccttccaagttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaanggcgggaacaccttataagacacactcaacatctaatcaacctctgatgatgaattatatttcaaaagagctca

SEQ ID NO: 8322 - DNA, 375 bp, Zea mays
  unsure at all n locations
  Clone ID: LIB148-030-Q1-E1-A5
cgttcagcctcttcagggcgatgttcctgtccttcggccggagcgacgacagcatgaagaagacagacgacgacaccacgagccccaagaagagagccatcgcggctgctgatgacgattgcaagcctgccggtgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaggtgggcatgaccagccgctacgcgtccgctgaggatctngcacagatggacagcgaccaggaag

SEQ ID NO: 8323 - DNA, 269 bp, Zea mays
  Clone ID: LIB148-029-Q1-E1-H1
aggatgcatcggcataggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcc

SEQ ID NO: 8324 - DNA, 379 bp, Zea mays
  Clone ID: LIB148-029-Q1-E1-F12
acacacacgtccgctgcgcggcgccaatccgctcggctaactcaacgacgtgccgctggccatctgcgcctcactgctcaaacacttggactctgacaacgaccacgatcagtaataccacatcggcgatcacgatcgatatgtaagagcacgtcgtcaacgacggagcgcagtcgtcgcagactggctggcactaaaccagatctcctcttcacgtgaatgacacatctgtaactgagataggaaaggacaacagcaatgtaactgcgtggctgtatcaaattctgagtgctggaatcatgctattgtcacccagtgttcgttttatcatacaagttgcagcgcagctcaagacggctaaggacctgttcgtttgtgt

SEQ ID NO: 8325 - DNA, 266 bp, Zea mays
  Clone ID: LIB148-029-Q1-E1-F2
gaagattccactaataggtatgcaactttttacatcgtttcatatctaataatccaaatttcagtagttatatatagttatttactgcaagaagttaatttttagtttcagttactggaacttggaagaactaaaactttttacacatgtatattattcctgcgcatggagactaaaatgaaaaaaagaacaatcggcccataatttatagctttcaatatagaactacatgatttggtgcaaaatatgtgattataatttttgtt

SEQ ID NO: 8326 - DNA, 262 bp, Zea mays
  Clone ID: LIB148-029-Q1-E1-F3
gggccgacacacgcgtccaagcggacgcccattatttttttttttttttttttttttttttttttttttttttttttttttttttttttttttttttttttttttttttaaaaaaaaacccaaggcattaaaaaaaaaagcggggtaaaaaggttgatcgatgggaaatgagaatgaagaacaaggcaagaagatacaaacaaagacccaccaggaggtcagacccggcattgacgactcaactacaagcctaggagaaaaa

SEQ ID NO: 8327 - DNA, 267 bp, Zea mays
  Clone ID: LIB148-029-Q1-E1-F4
gcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaag

SEQ ID NO: 8328 - DNA, 271 bp, Zea mays
  Clone ID: LIB148-029-Q1-E1-F6
ccacgcgtccgcgcagccggtgacaaccgaacgcgagctacccttcggccacgacgccgtcacgttttccttcttggtggcgtgcgtggccgccaccgtcgcgctcgcgtcgtccatgtgctcggcgtgcgaccgcaagccaaaggcggccaccaacgcggacccggctgggacggcctcctccatctccggtggtagcggcagccaggaggctggcgcggaggaggcagcggtagaggaggaggtggtgaggctgtcgccggagctggcg

SEQ ID NO: 8329 - DNA, 287 bp, Zea mays
  Clone ID: LIB148-029-Q1-E1-F7
gtcgatacaagcctctagatcgagtcgtattaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgc

SEQ ID NO: 8330 - DNA, 273 bp, Zea mays
  unsure at all n locations
  Clone ID: LIB148-029-Q1-E1-F8
tacgatacctggctcaanggcgtcatgacgttcatggacacctgcgtcgacggcttcgtcgacgagaagctcaaggccgacatgcactccgtgctgcgcaacgccaccgagctcagcagcaacgcgctggccatcaccaacagcctcggcgggatcctgaagaagatggacctcggcatgttcagcaaggactcgcgccgccgactgctgtcgtcggagcaggatgagaagggctggcccgtgtggatgcggtcgccggagaggaagctgctg

SEQ ID NO: 8331 - DNA, 384 bp, Zea mays
  Clone ID: LIB148-029-Q1-E1-F9
tacatgaactcgcctcatgaagcagagaagtcatccccgccactggcaccgatcagctcaccgccatcagagcccaagtcaccgtcgtcacctccaatggtagagaaaacttctccaccaccggcaacggttagctcaccaccacctacgcctaagtcgtcacctccacctgctcctgtgagctcaccacctccagtggtgaagtcttctccaccaccggcaccagtcagctcaccaccaccgacacctaagccattacctccacctgctcctgtgagctcaccacctccggtggtgaagtcttctccaccgccgacaccagtcagctcaccaccaccgacacctaagccattgcctccacctgctcctgtgagctcaccacct

SEQ ID NO: 8332 - DNA, 269 bp, Zea mays
  Clone ID: LIB148-029-Q1-E1-G1
gcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggaggaggacacgtggtcctgcgacgtctgctgcaagcacgccccatccacgcccgtcaaaaccacgctgctc

SEQ ID NO: 8333 - DNA, 379 bp, Zea mays
  Clone ID: LIB148-029-Q1-E1-G10
cacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaag

SEQ ID NO: 8334 - DNA, 375 bp, Zea mays
  Clone ID: LIB148-029-Q1-E1-G12
acggacacgtgggtcaagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagc

SEQ ID NO: 8335 - DNA, 284 bp, Zea mays
  Clone ID: LIB148-029-Q1-E1-G2
gggccgacccacacgtcaagcgtggcgaggactacaggaggttcggagggataagactcagggcactacatggacgtcgtcacgggaggcgacatgtggcagttgctgaactattgcacgggggagatgaatgaggcgctggtcaatcttcaccacagccaaggcatgctgcagaagtgcaacctctacaagttgagcctgttcttgcacaggtggcaggaggagtcttagcccggcgacatcggctggaatctttcgacatggtcgccggtcaggacgatgct

SEQ ID NO: 8336 - DNA, 268 bp, Zea mays
  Clone ID: LIB148-029-Q1-E1-G3
ctcgcttgtcctcatggccttgatgatcacatggcactacgtccacgtgatgaagtactggtacgagctggaccacgtcgtgccagccaacgaagtgacaacgctgcttgagaagcatgaggtgcggcggatccccggggtgggcctcctttactcggacctggtccaaggcatcacccccgtgtttccacgtctggtgcagaggataccctccgtgcacgcggtcttcctgttcatgtccatcaagcacctgccgatcccacacgtg

SEQ ID NO: 8337 - DNA, 267 bp, Zea mays
  Clone ID: LIB148-029-Q1-E1-G4
accacctttaccaccgaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacat

SEQ ID NO: 8338 - DNA, 256 bp, Zea mays
  Clone ID: LIB148-029-Q1-E1-G6
cccctcccttccttaaccgcggcggcttattccccatggcttcaccgaacaacgacaaccgcaaggcggcgggcatcctgcggctgctgatggggatggcggcggcggcggcgcccgcctcggcattgcctcggggcggcggcctgatgatggtgcagcacgtcatcctcgacgtcaacggggaactgttctcgggcggggtcggcggcggcggcgtgccgccggcgtctaaggccgcgatcgccgcgctgaagga

SEQ ID NO: 8339 - DNA, 277 bp, Zea mays
  Clone ID: LIB148-029-Q1-E1-G7
ctctacacagcaccatgttcatccacatgaacatgtacaagtgcaagaacatgctgatcaaggacgtgaccgtgacggcgcccggggacagccccaacacggatggcatccacatgggcgactcatccgggatcaccatcaccaacaccgtcattggcgtcggcgacgactgcatctccatcggccctgggacctccaacgtgaacatcactggcgtgacctgcggccccggccacggcatcagcatcggcagcctaaggcggtacaaggacgagaa

SEQ ID NO: 8340 - DNA, 392 bp, Zea mays
  Clone ID: LIB148-029-Q1-E1-F11
ctccagtgaagtcaacgccacctccagcaccagtgagctcaccaccacctccagtgaagtctcctccgccaccagcaccagttagctccccaccacccccaataaaatctcctcctccaccggcaccagttagctctcctccaccagcaccagtgaagccaccatcactaccaccaccggccccagtaagctcacctcctccagttgtcacccctgccccgccgaagaaagaagagcagtcattaccaccaccagcagaatcccaacccccaccatcattcaatgacatcatccttccacctatcatggccaacaagtacgcatctccgcctccccctcagttccaagggtattaagcgccacagagacatggttgatgaagcatgaatggg

SEQ ID NO: 8341 - DNA, 290 bp, Zea mays
  Clone ID: LIB148-029-Q1-E1-G8
gggtcgagcacgcgtccgagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaacgatgaggtcaagacgg

SEQ ID NO: 8342 - DNA, 361 bp, Zea mays
  Clone ID: LIB148-029-Q1-E1-G9
ctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctg

SEQ ID NO: 8343 - DNA, 268 bp, Zea mays
  Clone ID: LIB148-029-Q1-E1-D3
gccgtcctgagcctccgtttgcggtgcgacagctcctccaggaccggcccccgcgcgcgtgccgtacgtgccagggacgacgccgggcggccgatggagttcacgtcgtcctacttccacgccttcggcaaccccgacctcgcggcggtggtctccggcgacggcggcagcgcgcaggcccaccggccgcgccgctccaccgacggcgcgaaggcggaggacggcaggagccccaccaccacaacggcgaggcgcgcgccgtccatgt

SEQ ID NO: 8344 - DNA, 280 bp, Zea mays
  unsure at all n locations
  Clone ID: LIB148-029-Q1-E1-D5
cccacgcgtccgcggaacgcgtgggctgataattgcaggttccaattccaaccgggaatttttaagaagcaataaattaaaaggcttttcanaatggaggatgtgagcatgggcatgtgggtagagcggttcaacaacaccagacttgttaaatatgtccacagcatcaaattttgtcaatttggatgcatagatgattattacactgcacactaccaatcaccaatgcagatgttgtgtttgtgggacaaactgcaggctggaaaagcccaatgctgca

SEQ ID NO: 8345 - DNA, 244 bp, Zea mays
  Clone ID: LIB148-029-Q1-E1-D6
agcgtccccgaaccaagaacatgaccataaccggcgtgctccggccgctcctcctccctgggcctccccccgccgcggataaaaatttccgccgaaggcgaaggcgaaggcaacggcggtttgaaggccgttgccgatgccggcgccggcggcaatccaaccccaaccaaggaacgccaaccaaacctggccgctgggaaaacaacaacccctcctcaaggcggcggttactcaaccccaacca

SEQ ID NO: 8346 - DNA, 270 bp, Zea mays
  unsure at all n locations
  Clone ID: LIB148-029-Q1-E1-D7
cccacgcgtccgcggacgcgtgggccgccgtcctaccttcatatacctagcagtgtctctgcatagaaagataaaaggtangaggaggcgcagtgcgtggtgggattatttgtgaggagatattggagttattatatatatatatatataggtagacgatagatagacagctagatctatataaccatggtggatgggttccgatggatcagaccgggctctttcgtcctgtacttggtcttcttcttcctgtccgcagccctgtcggag

SEQ ID NO: 8347 - DNA, 272 bp, Zea mays
  Clone ID: LIB148-029-Q1-E1-D8
cccacgcgtccgcccacgcgtccggttcagggcacgcctcaagaacggcatcctcgatctggggttaacgatccaggcccagaagcagtcggagctccctgagcaggtcctctgctgcgtcaggttgaacaagatcgatttcactgaccaagaagttccaacaatagtcaccgttgatgacacctgacgcatttgatcaaaatggtcatcagacgtgcgagctattattaactgctgcaaggctagatccatgggattcagaggcgacacag

SEQ ID NO: 8348 - DNA, 378 bp, Zea mays
  Clone ID: LIB148-029-Q1-E1-D9
atctacggcaaggccatggagcagctgaccgccgcaatgggcgcctccgagagctgcgaggacgcgtggaagggcgaggaggaggatgtccccgtcgccgcgcacgacagggagtacggtcggatggcgcacatcgccttcggattcacacaccacgccgccgtcgccgccgccgccgcatgaatcgattaattattatatatatatatgcatgctatctactatgatcgatcgcttctcgaccttcttgcatcgatctgcatgcatattataatttatattatattgatgccacgccgcatgcaggtctttccaaggcgtacgtactatatcaaattattttaatttccttacatgtatatgtatgtgctgctgttg

SEQ ID NO: 8349 - DNA, 268 bp, Zea mays
  Clone ID: LIB148-029-Q1-E1-E1
cgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaa

SEQ ID NO: 8350 - DNA, 406 bp, Zea mays
  unsure at all n locations
  Clone ID: LIB148-029-Q1-E1-E10
cgtggncttgctgagcgtggccctagtgggcctgctcctctgaccagctcgcaattaccgcatccgcccagcagaacagacttccacgtcctcggtagcgtcgacggctctagtgactgcagcaggtgcgtgtcagaatgtcgcgtcctctaatcagatatgaatctggctgagacagactccgagtcgccggcacatgcgccggcgccagggccgtcgtccggttgaactgagaatcgtgcgtccagccatgcaaggtggtcagaatgtacaactaattagtggctcaatcatgtgtcaggctaatagtgctcttgccataattatatagatatacgcacagtgtgtgctaagctacccacatgcattctattgcagggcgccgcagatatattaaacaactgtg

SEQ ID NO: 8351 - DNA, 384 bp, Zea mays
  Clone ID: LIB148-029-Q1-E1-E11
gcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatcctccacaacctgcacg

SEQ ID NO: 8352 - DNA, 267 bp, Zea mays
  Clone ID: LIB148-029-Q1-E1-E2
caggcgggtggtcggcgtctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaaccccca

SEQ ID NO: 8353 - DNA, 268 bp, Zea mays
  Clone ID: LIB148-029-Q1-E1-E3
taaacagacttgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtg

SEQ ID NO: 8354 - DNA, 268 bp, Zea mays
  Clone ID: LIB148-029-Q1-E1-E4
ctctctcctcggtttcctctcccaccaccaacccccagatcgcagcgatctccgccgccgccctctctgggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggac

SEQ ID NO: 8355 - DNA, 271 bp, Zea mays
  Clone ID: LIB148-029-Q1-E1-E5
ctagcagcaaagcaaagaggatcggatcagaagaaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagt

SEQ ID NO: 8356 - DNA, 246 bp, Zea mays
  Clone ID: LIB148-029-Q1-E1-E8
gcagcatcgacgacactcgggtcctgtgtggtcacgccgacggtcctgctaggtagctggatgcgctcgtctgctgctccgagatcgatggagcttctgaatcctaggtagctcacgctcgttcacctatcggtcccgtgcatgtacatagttggggacacacgtcgctaggacgatgagagagagagagagagcatggtagggtgaagactggaagatgcttgtaaactgtaatttgatcttggc

SEQ ID NO: 8357 - DNA, 368 bp, Zea mays
  Clone ID: LIB148-029-Q1-E1-D11
ctcacgcgtccgcccacgcgtccgcccacgcgtccgcgtgaagcagctggacaggaacgggttccatggcaaccgcgagttcctcgtggaggtgctgatgctcagcctcctgcaccacgcgaacctcgtcaagctgctgggctacagcaccgactccaaccagcggatcctggtgtacgagtacatgcccaggggctcgctggaggaccacctcctggacctgcccccgagctggaagcccctgccgtggcacacgcggatgcgggtcgcggtgggcgcggcgaatggcatcgagtacctgcacgaggtggccaacccgccggtgatctaccgcgacctcaatgcgttcaacatcctccttgacaagg

SEQ ID NO: 8358 - DNA, 378 bp, Zea mays
  Clone ID: LIB148-029-Q1-E1-E9
ggccatcgagatcttggaatatgttgttggaatgcgcgaggagaagctaggtacggcaaacccagatgtcgacgacgagaagcggaggcttggggagctattgaaggaggctggccgggtgcgaagcagaaaggcaaagtccctggagaatctgctcgagaccaacccatatatcgccaccaagagaaatgcagttgctgcatgaatcactgttctgaagatgaaaggcgaggattgttactaaggtattcaattggttcgttcagatgggggtaacgggaatattggtgcttacctattaagaaaatatgaaatgatcaaatcactgatctcaaattctttgctgtaaagttttcaaatactattaccgttacatgt

SEQ ID NO: 8359 - DNA, 268 bp, Zea mays
  Clone ID: LIB148-029-Q1-E1-F1
gccaggaccaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacc

SEQ ID NO: 8360 - DNA, 382 bp, Zea mays
  Clone ID: LIB148-029-Q1-E1-F10
gagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatc

SEQ ID NO: 8361 - DNA, 410 bp, Zea mays
  Clone ID: LIB148-056-Q1-E1-C11
cccacgcgtacggcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtactttaatttgggtctgaacatgt

SEQ ID NO: 8362 - DNA, 409 bp, Zea mays
  Clone ID: LIB148-056-Q1-E1-C12
gccgcactgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctccagggcgccatcaagttcaacggcggcggtca

SEQ ID NO: 8363 - DNA, 395 bp, Zea mays
  Clone ID: LIB148-056-Q1-E1-C3
gaaaaaaccaccatccgtcgtcgccaaccgtagcaaggagccaaggacatcaccaccgcccagcaataatggcgcagagcatgaggattgtggcgctggccttggtggccctgctggtggtggccgcggcggcgcccgtggccaccgcgtaccgctgctacgacgactgctacgagcgctgcgccaacgggaagaaagaccccgcctgcaccaagatgtgcaaccacgcgtgcggctccacggaccagggcgccggtgccgccggcggccgcgccggcttgatcgcccagcgcattcatcgcttcagctcgatataatcgctgctccgtcagcaacccacatatgattcgattaatcttcctcctcgaagttctcgaccgcgtcgaatttttttc

SEQ ID NO: 8364 - DNA, 417 bp, Zea mays
  Clone ID: LIB148-056-Q1-E1-C4
gggaatatatagttcgtgaatccctgaagcgtgcatatatatattcctgccacgatgaaggtaatggagtcgtcacgcaggttccagccgggcgtcatcctgcgtctcctgctcattgtgtccaccgatatggcacaggcaagggaattccaaaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggtgactgtcatgtatattctgatgactgtcatgtat

SEQ ID NO: 8365 - DNA, 405 bp, Zea mays
  Clone ID: LIB148-056-Q1-E1-C5
acacaacctatctcaaaacttgaatttgagtttgagaagcggaaactggccaaagatgatgtccgagaattgatttaccgagagattttggagtaccatcctcaaatgctacaagaatacctacaaggagcagaccacaatcagatgaccttcatgtatccaagtggggtggatcgcttcaggcgccaatttgctcatttggaagaaggtactgcaaagggtgaaaaacacagtccacagctgcgacagaatgtttctttgccaagggaaagagtaattggcaataaacatggagatggcaatacaggtgataagctagcgcatgcctcagtgacggatggcatcagccaaccgagcttgagtgagagaagctttctgaagagtgaaagcatcagtgcttccaag

SEQ ID NO: 8366 - DNA, 426 bp, Zea mays
  Clone ID: LIB148-056-Q1-E1-C6
agacggggaagctgggcgtcaagtcggacatctactcgctcggcgtgctcctgctgcaggtggtcaccgcgcggccacccatggggctcacgcaccacgtcgagaaggccatcgacgcgggcaccttcgcgcagatgctcgacatcaccgtcaaggactggcccgtcgaggaggcgctcggctacgcaaagctcgcgctcaagtgcacggagatgcggcggagggaccggccggacctcgcaaccgtcgtactgccggagctcaaccggttaaggaacctcggccacgcgtacgaggcacgcatgagcgccgtcgggaccaacagtggaagtggcgaaagtaatgaccaggtcagcgggagctcgccgacggcgggtggttcatggagaacggcggaaagctagcgggtggtacggcgtggccatg

SEQ ID NO: 8367 - DNA, 426 bp, Zea mays
  Clone ID: LIB148-056-Q1-E1-C7
agcgcgggagcgcggagtcggagcagggcatcaacgagttcaacacggagatccagatgctgtcgaagctgcggcaccggcacctggtgtccctgatcggctactgcgacgagaaccaggagatgatcctggtgtacgagtacatgcacaacggcgtgttccgggaccacatctacggcagcgaggggaaggcgccgctgccgtggaagcagcggctggagatctgcatcggcgctgcccgggggctgcactacctgcacacgggcacggcgcaggggatcatccaccgcgacgtgaagaccaccaacatcctgctggacgacaacgtcatgggcaaggtgtcggacttcgggctgtccaaggacgggcccggggatgaccagctgcacgtgagcaccgccgtgaagggcagcttcgggtacctgg

SEQ ID NO: 8368 - DNA, 418 bp, Zea mays
  Clone ID: LIB148-056-Q1-E1-C8
agcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgcc

SEQ ID NO: 8369 - DNA, 410 bp, Zea mays
  Clone ID: LIB148-056-Q1-E1-C9
atccggagaggaggggcaggaggaggccgcaccaaatctatctggggatcggagcgcgggcgacaagatgccacgcggcggcaagcccgcggcttcgtcgaagccgaagccgttcgactcggactcggactcggagtccagcagtaagccggcgaataagtccggggcgtcgtcgtaccaggctcccgccgacgccaagaagcggtacaaggacgggttccgggactcgggcgggctggagaaccactcggtgcacgagctggagcactacgcggcgtacaaggccgaggagacgacggacgcgctcgccggctgcctgcgcatcaccgaggacatcaggcaggacgccagcgacacgctgattacgctgcacaagcagggggagcagatcagccggacgcacgagaagg

SEQ ID NO: 8370 - DNA, 431 bp, Zea mays
  Clone ID: LIB148-056-Q1-E1-D1
aacagggtcaaggcgctcgtcggcgccttcgagactgtcatagacacccagaaggacgccgccgccggcaggccacaacacatctaccgcaagtcagcttaaaacatactgcggcggcggggacgcatcgatcctccacgcttcgtgtcttcgccttaattaattaattaattgttatgatcatgtcggccagcccaacgccgtatgcatgcatgcacacggcgctaattaatccctgtttatttactactccgtgaaatgtagtttctccgtatacacggagcagtagtattctgtaaagaggaaaatggtggaaaccgatgttgcattctgcataaatttattaatagggctagtttcacaaccttattttttctaagaggttttagtttttcaagggaatttaattcattttctcttgaaaaaatagg

SEQ ID NO: 8371 - DNA, 411 bp, Zea mays
  Clone ID: LIB148-056-Q1-E1-D10
cacctcctaaagttgattatgccactgatctctttaacatgttgtcaatggatggaacaacagagaaagagtcagcttcatcttcaaacgacgataatggctgggatggcttccagtctgcacaaccagtacctagttcagagaaaaaagattctgccaaaccagcagaaagcaagacccagtctacatctggaatggaagacttatttaaagactcaccagctgtgccattatcctcagctccagctgtttcccaagtaaacgctaagaatgatatcatgagtttgtttgagaagtccaatatggtatcacctttcgctgcccatcaacagcagctggcgctcatgtctcagcagcaagctcttctaatggctgctctcaaagctggaaatgcaccacagatgatgattc

SEQ ID NO: 8372 - DNA, 407 bp, Zea mays
  Clone ID: LIB148-056-Q1-E1-D11
cccacgcgtccgcccacgcgtccgatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccatcaggtacggcgagggctcccacaccgtggtctcctaccgcggcacgccgctgtgctccgggaagctcccggccttc

SEQ ID NO: 8373 - DNA, 408 bp, Zea mays
  Clone ID: LIB148-056-Q1-E1-D12
cgcaggcccatcggatccgtttcgagttccacaagggagcagcggagcacacgttcatgaggatcgacggggagccatggaagcagcctctccccaaggaggacgacaccgtggtggtggagatctccaacctccgtcaggtggccatgctggccaacgacccgtgcaggtccaagagcgtgaacgagccgtcctccccgtcgtgccacggccatgaggacgacgacagcaacagcctggaggacgaggacgaggacgagtgggaggacgggaggaagaagttcggtgcggcggccaccttcaagattcccgacgaggtggacatcgctcatctcagttagaacctagaaaccccgccggctgcttctgcgtcggttggtggtgctgactgctgagtctgtgcatttc

SEQ ID NO: 8374 - DNA, 300 bp, Zea mays
  Clone ID: LIB148-056-Q1-E1-D2
caactgcttcctcttgctctgcctgctccgccaatgcccggcatgggtggccctccacctccgatgggcggaatgggcatgcctccgatgggcgggatgggcatgccgccgatgggccctggtccgatgccagcattcgggatgccaccaatgggaagctactgagatgagatgtttttttgttgttgttgcagagagcttagatgatgatttgatatgttcctgtgtaagcagaggcggaaacctcattggagttgtagatggttacattttggaattaatattctttatggtaccagg

SEQ ID NO: 8375 - DNA, 419 bp, Zea mays
  Clone ID: LIB148-056-Q1-E1-D4
cagacgcgtgaggggagcacagagctagctagccagccaagcagcagccaacttgctcgccgcgcccgtccttcttcctcgcctccgttccattccgttccggcctccaccggcgccgccgcattcagggatggagatgaagaagatcgcctgcgccgtcctcgtcgccgcctcggcggccaccgtggcgctcgccgcggggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacaccttttgtcctc

SEQ ID NO: 8376 - DNA, 429 bp, Zea mays
  Clone ID: LIB148-056-Q1-E1-C1
cacgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctagcagctgaagttgttttgtgacaaggactatccggagaagccaccatctgtcagattccactcaagaatcaacatgacatgcgttaatcacgagacaggaatgggtgatccaaggaagtttggtttgctagcgaactggcagcgggactacacaatggagaacat

SEQ ID NO: 8377 - DNA, 161 bp, Zea mays
  unsure at all n locations
  Clone ID: LIB148-056-Q1-E1-A4
aggcccccggggaaaggcccaaacagggacggatccacatcggcgactccagcaacgtgaccatcagcagcacaccatcggcgtcggcgacgactgcatctccatcggncccgggagcaagatgatccgcatccatggcgtcaagtgcgggccaaggccac

SEQ ID NO: 8378 - DNA, 418 bp, Zea mays
  Clone ID: LIB148-056-Q1-E1-A5
cgcgtgaggatgccttcgggaagccgtggcgcacctcagcgccctctcccgcgacttctccgacgccaggttcctcgaggtcaagtcctggctcacctccacgctcggcggcaccgccacctgcgaggacgcctgcaaggacgcccccgtcagcgacatcaagaacgtctgcataaccaagagcttcgagtttgagaagctgctgcgcgtcacgctggacctcatcaccgaggcttccggctccatgtcggccgaggtcgcactgccgccgtcggatgcgtcggcgccgtccggagggtacggctcgtcggctggcgcccccgcctacggcgccccgtctcctgatgccccagcttatggcgccagcgtaccagcgccagcgccgagctcggggcagagcactgcttcgactgcatga

SEQ ID NO: 8379 - DNA, 349 bp, Zea mays
  Clone ID: LIB148-056-Q1-E1-A6
aaaaaaaaaaaaaaaaaaaaaaaaaaaaaaaaaaaaaaaagacaaacgaacataaaaagaaaaaaaattaaataaaagagaaatcaaaaaacaaaacacagcaaaaaaggcacagcaaattgagggcggcggccctaggggttccagcctcagttacgtgaaaaccctccgtttaaccactttaatcgggtctcagaatttccttcttgtggcactcgttttcaacatccatgattgggaaaccccgtcggttgccgacattaagcccctttcagcagatcccgcttcctcccgtgggtgtagctcctaagcggccccccccgtttacctttcccacaatttggccacc

SEQ ID NO: 8380 - DNA, 128 bp, Zea mays
  Clone ID: LIB148-056-Q1-E1-A7
ccggggccacccacgcgtccggatacgccggcgacatctggagcttcggcctcagcatcctcgagttctacatgggccgattcccgctgggcgagaacctggggaggcagggcgactgggccgcgctc

SEQ ID NO: 8381 - DNA, 395 bp, Zea mays
  Clone ID: LIB148-056-Q1-E1-A8
agcacctcctcttcccccgccgggcaacaactcagccgccgcaaccgccacatcagccatgggcgcctgcgcaaccaagcccaagacgcttgaggggcaggccccagctgatgccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaatgaggaggaagccgtggagaagaccgtcgtcgatgaggagaagccagcggcagcagcccatgcagaggaaaaggtcgccatcgccgccgagaccacgacga

SEQ ID NO: 8382 - DNA, 377 bp, Zea mays
  Clone ID: LIB148-056-Q1-E1-A9
agcgccgccgccgctagggaccggcctacagccagcacgggcgcgtggccctcggccggcgcgggggcgcggcggtcatgacggctcgggcgcggtagcctcggccccggcgtctccgtcccggtgcgtctccccgtggtacggcggaccccggactcaacagctcgggggcgcgactccctgcgacgcgtggcctcatggccctgatggctcgtgcgctgttgcccacggtgcgcggccccacggcccggcggctcaggcgcggctgcctgctacgcacggcccccagccccggcagctcgtgcacggctgcctgcgacgcgcgcacccccggatccagtggatcgggcgaaggccccctgcacgcactggtgagg

SEQ ID NO: 8383 - DNA, 408 bp, Zea mays
  Clone ID: LIB148-056-Q1-E1-B10
attaccccttcggcctccacctatcaccacccgggacgtcttccatggcctcctcgtagtagaatagttctatctcaccgcaacaactcctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggattaactgctcctccaacaacaacatcgtcgtcaacgtcttcaaccagctcgaccatc

SEQ ID NO: 8384 - DNA, 413 bp, Zea mays
  Clone ID: LIB148-056-Q1-E1-B11
ccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtc

SEQ ID NO: 8385 - DNA, 429 bp, Zea mays
  Clone ID: LIB148-056-Q1-E1-B12
ctcgcgagtcgacccacgcctctagtgtgaatcatacataatcttgctggggataggcgtaggaccgttatgaggccaccacaagttcttagggagggaacaaagaagacagtttttgttaactttatggatttgtgtaaaacgatgcataggcaacctgagcatgtgatgatgtttttacttgctgaaatgggaacaagcgggtcacttgatgggcagcaaaggttggtgatcaaaggaagatttgcccccaaaaactttgaagcaatcctgaggagatacatcaatgagtacgtcatctgcaatggatgcaagagccctgataccattctgtccaaggaaaatcgtctgttcttccttcgctgcgaacagtgtggatcttcaaggtccgttgctccaatcaaagctggattcgttgctcaagtcggt

SEQ ID NO: 8386 - DNA, 410 bp, Zea mays
  Clone ID: LIB148-056-Q1-E1-B2
atctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtat

SEQ ID NO: 8387 - DNA, 403 bp, Zea mays
  Clone ID: LIB148-056-Q1-E1-B3
atccgaaggcacgcgcccgcttcaaccactgcctgcagcagtacggcggcgccgccgacctcctccgcgacgcgctggacaacctcaaggcgaagatctacggcaaggccatggagcagctgaccgccgcaatgggcgcctccgaaaactgcgaagacgcgtggaacggccaggaggagggtgtccccgtcgccgcgcacgacaaggagtacggtcggatggcgcacatcgccgtcggattcacacaccacgccgccgtcgccgccgccgccgcatgaatcgattaattagtatatatatatatgcatgctatctactatgatcgatcgcttctcgaccttcttgcatcgatctgcatgcatattataatttatattagattgatgccacgccgcatgcaggt

SEQ ID NO: 8388 - DNA, 251 bp, Zea mays
  Clone ID: LIB148-056-Q1-E1-B4
gcccgcttcaaccactgcctggagcagtacggcggcgccgccgacctcctccgggacgcgctgggcaagctcaaggcgaagatctacggcaagggcatggagcagctgaccgccgcaatgggcgcctccgagagctgcgaggacgcgtggaacggcgatgaggaggatgtccccgtcgccgcgcacgacagggagtacggtcggatggcgcagatcgccgtcggattcagacagcacgccgccgtcgccgc

SEQ ID NO: 8389 - DNA, 413 bp, Zea mays
  Clone ID: LIB148-056-Q1-E1-B6
aaaaaaaaaaaaaaaaaaaaaaaaaaaaaaaaaaaaaaaaaaaaaaaaaagaataaaaaaagaaaacatacataaatattaaaaaatttgtatacacatacatcatatcatcttaaattttctcgcatgtcactttcatttcgtttctttggccgatccttttgtttattcgcgtcgtggaatatccatatattcacccacttttatcatcttgctcggtgtcacactttttccttgtggctatattatttcttctctagctacgaattacgattcacatcttttctcgctgtctctctctctcgctcttctccctttgtttcggcgtatgtgccgcgctgtctatggtgcttacccgctctatgggctctttccttacttacgccttaatgccatttcctttctcttccctt

SEQ ID NO: 8390 - DNA, 423 bp, Zea mays
  Clone ID: LIB148-056-Q1-E1-B7
accacgcgtccgcggacgcgtgggttcgttatcctcctcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgc

SEQ ID NO: 8391 - DNA, 441 bp, Zea mays
  unsure at all n locations
  Clone ID: LIB148-056-Q1-E1-B8
tccgggtcgnnaaagcgtccaccacgcgtccgcgagatcgcaacaacgatattgctaagcaagataagatttcaactttttttcccctggatcgatctcagattaggaggagcaaataaagcaagaatagaaagatttttgggggagaaggcatgatgctggaagggaagtcctaccttgtgtcacgctccgtgccgagctcctgcgagccggaggcggagtgggagtacctcgcccacgcggtcctcagcggcaagcgcccggcgccggaagatgacgtcgaggtcgaagacccggacgaaactggcagcggcggcaagcgcagcaagccggcgtctccgcagccgcacacgccggacatctgcgagggccacggctccaaccgccacgccactggttccggagagcagcggatcaccgggagcaaccccatgacttcga

SEQ ID NO: 8392 - DNA, 438 bp, Zea mays
  Clone ID: LIB148-056-Q1-E1-A3
tccacgcgtccgaacacgcgtcaggttgacctatgccttgatcgcatcaggaagcttgccgacaactgcactggtctccagggcttcctcgtcttcaacgctgttggtggaggaacgggctctggccttggttccctcctcctagagcgcctgtctgttgactacggcaagaagtcgaagcttgggttcactgtgtacccttccccccaagtttctacttcggtagttgagccatacaacagtgtactgtcgagcgattccctcctcgagcacactgatgtggctatactgctggacaatgagggcatctacgacatttgccgccgatcccttgacattgagcgcgcaacctacaccaacctcaacaggcttgtgtcgcaggttatctcatcgcttactgcctccctgaggttcgatggtgctctgaacgtggatgtt

SEQ ID NO: 8393 - DNA, 425 bp, Zea mays
  Clone ID: LIB148-056-Q1-E1-B9
ctccgaaagaggcgtaagacggacacgtgtgaagccgcaccaaatctatctgagggatgcgagcgcgggcgacaagatgccaagcggcggtaagcccgcggcttcgtcgaagccgaagccgttcgaatcggactcggactcggagtccagcagtaagccggcgaatcaagtccggggcgtcgtcgtaccaggctcccgccgacgccaaaaagcggtacaaggacgggttccgggactcgggcgggctggagaaccactcggtgcaggagctggagcactacgcggcgtacaaggccgaggagacgacggacgcgctcgccggctgcctgcgcatcgaccgaggacatcaggcaagacgccagcgacacgctgatcacgctgcacaagcagggggagcagatcagcctgacgcacgagaaggccgt

SEQ ID NO: 8394 - DNA, 377 bp, Zea mays
  Clone ID: LIB148-053-Q1-E1-H10
caactcgttgctgggggcgggatcccggccgagcaccatgcgaggaaataacatgccgcggcacacgtcgccgttactttttgccttgttggcgaccctgctcagcgtcggcgacgcgttggtcgtcgacggcctgcaggtggggttctatggaaagacgtgcccggcggccgaaggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtccggctcagaaacatcgaca

SEQ ID NO: 8395 - DNA, 382 bp, Zea mays
  unsure at all n locations
  Clone ID: LIB148-053-Q1-E1-H11
ctgctttgttctcaggcaacattttgttcactagtgtggtagctttgttgattggagtgcgcaatgggaggctgtgcgggaaaggtacgtcgtgatgacgaagaaaagcttgattttaaaggtggaaatgttcatattataacaagcaatgagggctgggaccagaagattgcagaagcaaacagagatgggaaaactgttgttgcaaatttcagcgcttcctggtgtgggccatgccgtgtcattgctcctgtctatgctgaaatgtcaaagacttatcctcaactcatgttcttgacaatagacgttgatgacctgatggacttcagctcttcatgggacatccgtgcaancccgacattcttcttcctcaagaacgggc

SEQ ID NO: 8396 - DNA, 390 bp, Zea mays
  Clone ID: LIB148-053-Q1-E1-H12
cggacgcgtggccagattcagaggaattgaaaaaaatgtcagaaaaggcactgaaattggcccaaccagaagctgtctttgacattgtcaaagacatgcatgagctctcccaggagcaaggtgtcatatcacagatatctagttccttgacttcatccttcttcttaccatcgcctgaaagcacccctctccaacttatctgaaaccatcaagctaggattgatattgttgacatcgtgaacttggcattgtccctacagtgtgggcgtgctttcggctgatccgctcacatggtagttacgggcagggtcgtttgactgacaggttctcgcgtgtgatgatgtttgccttcatgttaacttttggtaaaaaaaaaaacattcattcata

SEQ ID NO: 8397 - DNA, 268 bp, Zea mays
  Clone ID: LIB148-053-Q1-E1-H2
aaaaaaaaaaaaaaaaaaaaaaaaaaaaaaaaaaaaaaaaaaaaaaaaaaaaaaggacagacacacaaaaaaggtaaagggttcaaaaggcgtaaacgcttacatcatcatgggtctaaggtgcaaccttcttctaaattgccaccccgttgcttttcaatggctttacttggaaaacctcgtcattgcaaaactcaggcggtttacaacctatccccctttgcacaaaatgccttttacccaaccggccgtaaacgatatcgggtcc

SEQ ID NO: 8398 - DNA, 167 bp, Zea mays
  unsure at all n locations
  Clone ID: LIB148-053-Q1-E1-H3
ggaactctctgaagcacggggtcagggtagttcatgttgcttcgattcgatcgtangggagataatgccggatggctttgtaaagtttgggaggacatgcatcataattgaagtcaagtgataggatcctgttttttaagtacacgatacaacacaatcttaacata

SEQ ID NO: 8399 - DNA, 418 bp, Zea mays
  Clone ID: LIB148-053-Q1-E1-H4
caggctgctctgaatctcgtcgtcgccttggcgacgtgtacaaacaagtctgttgatgcccgcgtggtccaccccatcgtcaccctcgaggccgatggctcatctcccacctctggcgatggtcgtcgcctgatcagctccaccaaccaagatgaacttggagcgttatgccaacagatgcactacaagacgttgtgctccacgatgacgacactgcctggggtgactacgccagagcaactcttagatgcatccctgcggattacagcggtgaaggcagcgatggcggagatgaagctagacaatgcaataaaatcaggcagtgctcaaggtaacccgatgatgtcgtcgctaaagacatgcaaggagagctacgcgtcgctggtagactccatcaattacacgcggaacacgctca

SEQ ID NO: 8400 - DNA, 364 bp, Zea mays
  Clone ID: LIB148-053-Q1-E1-H5
gccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgtcggcatctccgacagcctgcgccccgccaacccgctcggctacttcaaggacgtgccgctccccgtctgcgccgcgctgctcaagcagctggactcggacgacgacgacg

SEQ ID NO: 8401 - DNA, 422 bp, Zea mays
  unsure at all n locations
  Clone ID: LIB148-053-Q1-E1-H6
agaagtacttcagaaaaggaacttgtaagagagcaggtctttgtccttggtcgaatgggaaatgctaaggaacctctttcgacaattataaataaactggaagacattaatacatatttagcctctattactgcatctgaggtctggtctgtttacatgaaggtctgaacaagtggaacctgacaaggatgggtgtggctggattacaacaggattgaagttgattggcaggaaatgatgctacttagcaattgttccctgactataactgcctacaaagttgtgcaattgtgatgtcgcatcgctggagaagacgggcacggcgacgagtccgacctggtcaagagctgcaactgcgaaatggacaaaaaaggtacctcgtggagttttgtgtgggggatcangtcgttgggtacatccac

SEQ ID NO: 8402 - DNA, 373 bp, Zea mays
  Clone ID: LIB148-053-Q1-E1-H7
gggcgaggagcaccacaagaaggacgacggggagcacaaggagggcatcgtggagaagatcaaggacaagatcaccggcgagcacggcgacaagtccggcgaccacaaggacaaagaccataaggagaagaaagataagaagaagaagaaagagaagaagcacggggaaggccatgaccatggtgatggtgacggccacagcagcagcagcagcgacagcgactgatctcgcctcgccgagcgccgtacgcacaaatgcaccgcgcaggttataatacgagctgtccgccgaacaccatgcgcatatattatacagtactcgccaagattgttgttctgcaatcttcgggataaaaaggttctttttttgttt

SEQ ID NO: 8403 - DNA, 427 bp, Zea mays
  Clone ID: LIB148-053-Q1-E1-H8
cccacgcgtccgggcgccgacgacctggtgaccgaccccaggggctcgcgggcgctgtacgagcgggcctcgtccgcggacaagtccctcaagctttacgacgggctgctgcacgacctcctgatcgagcccgagaaggacagggtgatggacgacatcgtcgcgtggctgagccccagggtctgacgccgccggcgcgttgcggtgctggccgtaggacgcgagcggcttttcgaccatctgcaggccaaggacgcctcgcctccggatggtgggtgatgacgcggtctggtctggtaggctgcggaccgagggagagcgggtgtgccttctcgcccccttggtgtgctgaactgctgatacgatacgaggagcaggacaggagtacggagaactactactacctacggctatgggcgatggcttt

SEQ ID NO: 8404 - DNA, 368 bp, Zea mays
  unsure at all n locations
  Clone ID: LIB148-053-Q1-E1-H9
gagccgttgagacttgggaggcaggcgacatgggtggcgggaaggacgacggccacgatccctccaaggcggacaagggattccacggaggagggtacccggccgccggtggatactacggcggccagtaccccggcggcggctaccctgctccaccgggcggcggtgcgtaccctcccgggcctgggtacccggtaccacctggtgggtacccgcctccgggtggctaccctcagcctggcggatacccgccgtcgcacggggcgtacccggcgccgggtgcangcgcgtatcctcccagcgggtacccccatcaaccggtctacccacagcctggctatccatcgatgcccggtcatggtggcatg

SEQ ID NO: 8405 - DNA, 445 bp, Zea mays
  Clone ID: LIB148-056-Q1-E1-A1
gggtccatgcacgcgtctgaacacgcgtctggcacctcagcgagaactgcaagaggtcctgcagccctcctccttcttgaagcgaagccccttgaaatgaatgaagcatgcatgcatgcatgtatgcatgcgccggggtgacgtggcgttcagctcaggcgctgagcaagtctatacgtacgtcgtcaccggctggccacgcatgcgataaccatctgatatggacgggactatatattgtagtcctaagaatctgggcattttctaagctaagtgtttttttccaaatatagcgtcgatggaactccagagtgtaaaggtcacgcagatggtgtgtttttcagcgattgaatgggtaataataaaaaggcatgctggcagttactagtaggagagaggcgaggggggcgggggagggagggagggaggggggggggggaggggg

SEQ ID NO: 8406 - DNA, 413 bp, Zea mays
  Clone ID: LIB148-056-Q1-E1-A10
agtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgaccccctactacgttcggtaacgtcgtcgtcgtcgtcgtcgtcgtc

SEQ ID NO: 8407 - DNA, 424 bp, Zea mays
  Clone ID: LIB148-056-Q1-E1-A12
tcgatacaagcctctagactgagtcgtaatagtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacct

SEQ ID NO: 8408 - DNA, 432 bp, Zea mays
  Clone ID: LIB148-056-Q1-E1-A2
gggacaatggacagtgtccgcactggaccctatgggcagatcttccgccctgacaactttgtgtttgggcaatctggtgctggcaacaactgggcgaaggggcattatactgagggcgctgagctcattgactctgttctcgatgttgtgaggaaggaagccgagaactgtgactgcttgcaaggattccaagtatgccactcccttggtggcggtactggatctggtatgggtacgctgttgatctcaaagatcagggaggagtaccctgaccgcatgatgctgacattctcagttttcccctcaccgaaagtatctgatactgtggttgagccatacaacgccactctttctgtccaccagttggttgagaacgctgatgagtgtatggttcttgacaacgaggccctctacgacatttgcttcaggact

SEQ ID NO: 8409 - DNA, 357 bp, Zea mays
  Clone ID: LIB148-053-Q1-E1-H1
ctgacggccagcgccgcgcgccccaacccgcaaggctcctaccactacggccagatcaacatcacccgcaccatcaaggtcatggtctcccgcggccacatcgacggcaagctccgctacggcttcaacggcatctcccacagggacaccgagacccccctcaagctcgccgagtacttcaacgtcaccgacggggtgttcagctacaaccagatgggcgacgtgccccccgccgtttacgggccactccatgtcatccccaacgtcatcaccgccgagttccggaccttcatcgagatcgtcttcgagaaccccgagaagagcatagactccctccacctcgacggctacgccttc

SEQ ID NO: 8410 - DNA, 267 bp, Zea mays
  Clone ID: LIB148-029-Q1-E1-B2
cggacgcgtgggcggacgcgtgggcggacgcgtgggcggacgcgtgggcgacgtcattgacatcgcacatgccgcgatctccattgtggagagcagtggcggcggcggcgacggcagcgcggggagcgacgaggcggcatcgtccatgttccagaggttctgggactccgccatggccttgggccccctggacgacgagacggacacccagtcccagatgagcgaggcgtcgaggtcgcagatgatgatgtccgatgtccaccacca

SEQ ID NO: 8411 - DNA, 271 bp, Zea mays
  Clone ID: LIB148-029-Q1-E1-B3
aagatggcaaatgctctcctaggtggcctgtgggcgatcgtcgtcgtcgcggtggtcgtcggcgttgtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaacgtggcgc

SEQ ID NO: 8412 - DNA, 265 bp, Zea mays
  Clone ID: LIB148-029-Q1-E1-B4
gctaacttgtaatctgcaggatctaagcaaagacttgatttagttatggacggattggtacgcctcttgaaagttcgcgtggtccggggtatcaaccttgcctaccgcgacgcaagaggcagcgatccgtatgtcgtcctacggcttggcaagaagaaactgaatacaagcgtgaagaagagatccgtgaaccccatatggcaagaggagctaactctgaccgtcacagatcccatccaaccactgaatctggaggtgttcgaca

SEQ ID NO: 8413 - DNA, 268 bp, Zea mays
  Clone ID: LIB148-029-Q1-E1-B5
cccacgcgtccggcagcggtggccgtctccacctctgtgtgcacgtcctcaaggcgtagcacgggctgtccgaacgtgaggccccaggcccgtccgctcctaggcaggccgtcgccgcgccggaggctgcagacggccttggccgcgacgggcaagacgccgggcgaggcggaggagcaggtccccgcgtgggccaagcccggcgcggacgagccgccaccctgggagcgcgagggcggggccgcgcgtggacaggaggcccggcagg

SEQ ID NO: 8414 - DNA, 273 bp, Zea mays
  Clone ID: LIB148-029-Q1-E1-B6
acgtagccgtatccaccagcaagggagcggtcacggcgacgacggtgaccaagagtcgcgctacatcaacacagccgatgcccacgtcaaaaaccggtcgctacctctctcgacattgatcgagatgctgaaggataagactgggaaggactacattgatgtagggtcaatccggctaacgctttttaacctcttcaaagacgatgccagcccgaagataaagaagttcatgaaggtcatgctgaacaagttacagcatgggcagcacggagg

SEQ ID NO: 8415 - DNA, 271 bp, Zea mays
  Clone ID: LIB148-029-Q1-E1-B7
acagacagtcacaagtacgagctcataaggaaggcatatgcaaaagcagccatggcgaactcgtcgtccggccttgcagtgaacgatcagtgcaaggtgaacttccgggagctgacgtcgcggcggagcttctggttcatcatgtgcaggatcgactacacagacatggagatcaaggtggacctcctcggcggaccgaaccagtgctacggccacttcaccgacagcctcccggccaaagaatgccgctacacgatctacgacctcgact

SEQ ID NO: 8416 - DNA, 393 bp, Zea mays
  unsure at all n locations
  Clone ID: LIB148-029-Q1-E1-B9
cccacgcgtccgggcgccgtgggcgagtgcggcgtggacgaggaggaggagctcgggctgagcggcggcggcggcatcggcgccggcgacgcgctgcggcggacgcttgcgcagcgcaagccgaccaaccggtacatcagctacgcggcgctgcgcgcggaccaggtgccgtgcaacaagcgcggccggtcctactacaccaactgcgcggcgcagacggccgccaacccctaccgccgcggctgctccgccatcacgcgctgcgcccgcagcatgaactgagcgccaaggcggcggccggcggtctgatctgcctgctggctggctgggcanggggcacgcagctggcctggctcgatcgcacaccatgcattgacgtcgtcgccggggggg

SEQ ID NO: 8417 - DNA, 267 bp, Zea mays
  Clone ID: LIB148-029-Q1-E1-C1
cgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggaca

SEQ ID NO: 8418 - DNA, 113 bp, Zea mays
  Clone ID: LIB148-029-Q1-E1-C10
aaaaaaactcagataacaaacaaaagttacaactctggtacaacatggctgcgtgataacatgcatgtatctgaccaaacaaaggtgacggcggcaagcaagcacacgcagat

SEQ ID NO: 8419 - DNA, 400 bp, Zea mays
  Clone ID: LIB148-029-Q1-E1-C11
atacaagcctctaaagtgagtcatcttactccattagttgccagcacatccaaatataaccgatagacctcagccctcatgcaagccgaccgcctacgtaccaccgcgccaacccgaaagtaagatggagatgatcatgacgatcctcatcgccgcgctcctcgttgtcgccgtctcgggcaccgcagtgctggcctctaacgacgcagctgcagccggtgccgaatccgcatccgcgtcgtccaattatgtggaatcctcccgctggagcccccggttacgtctacagcactggcaccgcctcgaggctgacagctagaggtccagcccttgccatagccacggcattcatcgttacacgatgcatcatcatctgtaaatctgtgaaactcatcggttt

SEQ ID NO: 8420 - DNA, 387 bp, Zea mays
  Clone ID: LIB148-029-Q1-E1-C12
tacacgcatgccctgtgcgggcggcctcggacaacggtacgtcctcaacggcgtccccgccggccggcctcggccaaccccgggctgcctgcaagggcttctgatggccctcgacgccgtcctttcctccaattgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccg

SEQ ID NO: 8421 - DNA, 101 bp, Zea mays
  Clone ID: LIB148-029-Q1-E1-C3
aggtgaactcgcaacaccagtgttctgcaatattaagcagaagctattgtattgtttgggtcgtttgtcagctaattgaaatgcgatggacatttactagt

SEQ ID NO: 8422 - DNA, 255 bp, Zea mays
  Clone ID: LIB148-029-Q1-E1-C4
agcgatcagagctcactcaatatctctgagaggtccttcaatgtctttgagagcatcctctatgtctgtgcaggaagagcaaagttcctcaaacacgtcatatgaggaaacggaatctgtgttggtgaagctgatcgcacgtcagatcacacttttgctgtcatccatttgggctcaatcaacatcccctgaaaatactcctgtgaactatgaagccattgctcatacttacagtttgcatctgttgttctctgg

SEQ ID NO: 8423 - DNA, 270 bp, Zea mays
  unsure at all n locations
  Clone ID: LIB148-029-Q1-E1-C5
ccggtttttgagaggggaaagangaggcggaggagagggatggggaaggacgagaggttcccggtgtgggaggccgcgctcggcgccggaatcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatc

SEQ ID NO: 8424 - DNA, 293 bp, Zea mays
  Clone ID: LIB148-029-Q1-E1-C6
tcgtgggtcgatccacgcctctagagtatgtcgtactacatgcaaagacccgccttcgtcttctacggacgcaacatcggctacccggataagctgagggacatcggcttcatcgtctagtcgatctgcaagccgctcgacgcctggcttaaggacatgcgcgcggtcgcttatttcatccgagtttgtttttttgcaggattcttaaaagttggaccgtgctgctagtattccatgtttcgtgttttcataatggacgacgtctgtagatgtataaaaatcctctggcgctt

SEQ ID NO: 8425 - DNA, 276 bp, Zea mays
  unsure at all n locations
  Clone ID: LIB148-029-Q1-E1-C7
ctctacagtcatctacgatagctagccagctagtaacaagaacanaaaacacaatcatctcatccgcccgtctcaacgccaccctagccctgtgatatacaatggcggcccagagcacgaggatggtggcgctggccctggtggtcctcctggtggtggcgacggcgttggtgcccacggccaccgcgtacggctgctacgacgactgctacgagcggtgcgccaacggcaagaaggacgaccccgcctgcaccaagatgtgcaaccaggcgtgcg

SEQ ID NO: 8426 - DNA, 258 bp, Zea mays
  Clone ID: LIB148-029-Q1-E1-C8
gcatagagctccaccaccgccaccgccaccgcggatgcgtacgcgtctccaaagcagaaggtcgtcagcagccagcccatggccagcgccgctcctgacgagcttccgctggcggccaagagttccaccacctccgacgcgtacgcatctccaaggcagcagcaggtcgccagcagccagcccatgtctggtggcgctcccgacgagcttccaccggtggccaagacctctgccacgcccgaaccgtacgcatctctg

SEQ ID NO: 8427 - DNA, 386 bp, Zea mays
  Clone ID: LIB148-029-Q1-E1-C9
ctcgggctaggctagctagctaggttaccactctggtacaacatggctggtgatggcatggaggtatctgccagcgggggtggcggcggcaacaagcagccgcagatcagccttttggggctgttcctcgcctgcatggtcgccggcggcgtgcagtacggatgggcgctgcagctctcccttctcaccccctacgtccagacactggggattcctcatgctcttacatcagtcatgtggctctgtggacctattgctggcttacttgtacaaccctgcgtcggcctctatagtgacaaatgcacttctaagcttgggagacggaggccattcatctttacaggatgcatcatcatctgtatatctgtgatagtcatcggtttctc

SEQ ID NO: 8428 - DNA, 268 bp, Zea mays
  Clone ID: LIB148-029-Q1-E1-D1
cccacacgtccgcccacgcgtccgatcgcggcgtaccacttcgatttagcaggcacggcgttcggcgccatggccaagaacggcgaggaggagaagctgcgcaaggcgggcatcatcgacatgcagttccgaagggttaagtgcaagtacgactccaaggtcaccttccaccttgaaaaggggtgcggccccaactacctggcactgttggtcaagtacgtcgacggcgacggtgacattgtggcagtggacgtcaaggagaagggct

SEQ ID NO: 8429 - DNA, 329 bp, Zea mays
  Clone ID: LIB148-029-Q1-E1-D10
cagctgacccctgcactggacccttccgagagctactaggacccatcgaacgtgaacgaggaagcagtccccttcatgcgcacacaacagggagcttggaccggtcacccatagcaccatcggattcagaggcaacactgtcatcaccacagggcactcatcaatcaatgaaatctaagacaaacccatgaatcccagccagtacaacttgatcgcttcaaaagctgtcgcgacaaccatgctcatacaggggatgtaatgacaaccccttcacctgaaatgcatgttgatgctgtcgctggttccaacttcattttcagtaataacaa

SEQ ID NO: 8430 - DNA, 365 bp, Zea mays
  unsure at all n locations
  Clone ID: LIB148-028-Q1-E1-H4
gtccgggacgagtcacgcgtctagccaggttaccagcagcaagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcnggcgtcacgaaca

SEQ ID NO: 8431 - DNA, 335 bp, Zea mays
  Clone ID: LIB148-028-Q1-E1-H5
cccacgcgtccgcggacgcgtggggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgaca

SEQ ID NO: 8432 - DNA, 323 bp, Zea mays
  Clone ID: LIB148-028-Q1-E1-H6
acccacgcgtccgatcagccaagagctatccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcagtgctgatcgcgt

SEQ ID NO: 8433 - DNA, 326 bp, Zea mays
  Clone ID: LIB148-028-Q1-E1-H7
cccacgcgtccgcccacgcgtccgggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgct

SEQ ID NO: 8434 - DNA, 349 bp, Zea mays
  Clone ID: LIB148-028-Q1-E1-H8
gtccaatacgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtct

SEQ ID NO: 8435 - DNA, 384 bp, Zea mays
  Clone ID: LIB148-028-Q1-E1-H9
agtggccgagtcccaagcaacggtggtaaagagagcaattggggattatcgcaaggctactgaaggaggctctctgctgaaactcccattcaccacgatatttgagtatcttcagttactgaagatggttgctacatccatgagctgtgtgggtctccacgggatgttctatctcgctgcagctgtgtctgacttctatgttccatgggatagcatggcaaaacataagatccagtcagcccgaaggcccactggatatgaagctcagccaggttccaaaaatgctccccgttctgcgcaaccattgggcccccttggccttctgcgtatccttcaagctggagacggatccagacattctagttcagaaagcagagacggctc

SEQ ID NO: 8436 - DNA, 399 bp, Zea mays
  Clone ID: LIB148-029-Q1-E1-A10
cgggtcgatacacgcgtctacacacacgcctgctaacgcgtccgcccacgcgtccgcccacgcgtccgcccacgcgtccgcacaccttgagacctgcgttgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgac

SEQ ID NO: 8437 - DNA, 362 bp, Zea mays
  Clone ID: LIB148-029-Q1-E1-A11
gccagtcttcgtcatgagtgccgctggacaccgtcaaggattgcggcaccgcgctgcaccgccgcaaggcggtgcatgccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccatgccgtcatgtccttccaccagtgcggcggcaacgtcggcgactccgtcagcatcccgctgccgcggtgggccgcggaggagatggagaaggaccaggacctctgctacaccgaccagtggggccgacgcaac

SEQ ID NO: 8438 - DNA, 390 bp, Zea mays
  Clone ID: LIB148-029-Q1-E1-A12
gcggcgctacgaccactcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgccccccc

SEQ ID NO: 8439 - DNA, 269 bp, Zea mays
  Clone ID: LIB148-029-Q1-E1-A2
agtggttctacatcgcgatggccgcccttttctttttcatatcgagtttgcaacctgtattgaaattactacgtggacggagagccagcggcagcagcccatgcatcggaaaaggtcgccaccgccgccgagaccacgacgacggtggaggcgaataagaacgccgaggaggccgggaaggagaagctggcgcagcaacgctgatcgactgtccgtgcatgcgtgccaattaatataattggctgatgatgcctgatgttcagtgtgtg

SEQ ID NO: 8440 - DNA, 291 bp, Zea mays
  Clone ID: LIB148-029-Q1-E1-A3
ggactagcaggccgaggcacgcgtccgggcgatcatcagcagtgcggcgatgaacgcagccgtggccgctctgctggtgttcgccgcggtgtcgcctgccgcgcgcactgtggccgcagaggcagacgccaatgcgaacgctgtgggaagcgcgccatcggtgcccgctggctcgctggacatcgcccagctaggcgccaagggcgacggcaactcggacagcaccccgatggtgctcaacgcgtggaagcacgcgtgcgacgcgacagagcaccataagatcgtcatccc

SEQ ID NO: 8441 - DNA, 267 bp, Zea mays
  Clone ID: LIB148-029-Q1-E1-A4
ctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccacaggagatgaccaacatcattaaggacttcgacgagcctgggtttctggccccgatctgcctcttccttggccccaccaa

SEQ ID NO: 8442 - DNA, 213 bp, Zea mays
  Clone ID: LIB148-029-Q1-E1-A5
gacccacgcgtccagacgccctttttttattttttttttttttttttacataaatatcgtatattacttcatgcaaggaaaacatgtggtgatagacatatcagatcaacgattcacagtcatttcatagtatgataacaaatatcccaaaatacatgtgaacttggcagtcttatgtatcatgccctaaagaaaatctaatggcagcacact

SEQ ID NO: 8443 - DNA, 116 bp, Zea mays
  Clone ID: LIB148-029-Q1-E1-A7
tcaacacgtaggagatggccgcacctattgcggctctaccgaggtttcaacctgtgtcaccagtagcacgcacagtagaagccaacgccaacacgacaggcaaaggtataggacgc

SEQ ID NO: 8444 - DNA, 273 bp, Zea mays
  Clone ID: LIB148-029-Q1-E1-A8
cgctcgctcgctccatcattcctccctctccgccggcgtgcccgcccgcccacatgacggagtcagagggcgagacggaggctgcgcgcgcggccgtgctgacgccgccgctgtcgctggggggcggcgggctcgcgggggagctccgcccggccaacctcggccaacgggtgctcagcctcttccgcaacgtccgcccgggctccgacctctcccacttccagctgccggcgacgttcaacctgcccaagtcgcagctgcagctgtacggcg

SEQ ID NO: 8445 - DNA, 375 bp, Zea mays
  Clone ID: LIB148-029-Q1-E1-A9
tcgtgggtcgatacaagactctagagagagtctacttactggcgaaaagagagaattcagtcgactcgtcatatttaccaagcggtgagacctgttgtggatcctggagtatgacctatttaattcgttgatgttgtcgttatagttcctctacactacactcgttgaccccgcctgcatctagttttgcccgtccatgggcggagaatctgaccatgggtttgtcccaagcttgcatcacagtggcgcatccagtgacccacgtgatctctgctttgccgcagaaaatttttgcggagcaactgccgggtgctttgtatttcagctttgtaaatttacttttatccagtcgttctgagtccaagccgtcagtgc

SEQ ID NO: 8446 - DNA, 357 bp, Zea mays
  Clone ID: LIB148-028-Q1-E1-H3
aggaattttcgtgttgacaagtggctgtctatccagttggagagttcatgcttcaatagtctggttgttcacgggatgttctgttctccctatcacggtaactatatgatgatgatccttgctttaattcatgaacacttgtttcaagattatgtccattacattttgcttgcattgtcaagattgtggattcttggtgttcatgacgttgtaatgttaatgaaccggctggtaacgccatgtggtactggtacccctgtattttcagttgctgtggcaccttggctctctctttgaaaaaccagtatgtatatgacaatgatcaatttatccatattcctacttcattcccaaaaa

SEQ ID NO: 8447 - DNA, 292 bp, Zea mays
  Clone ID: LIB148-029-Q1-E1-B1
cgggtcggtacaagcctctacacagacgcctgcatacaccatcgctcgcccggatcgtcaacatggcagccgccctccgtgtcgtcatcgccgtcctcgccgtcgtctcggtctctctccggcgcgccacggcggccacggtccccaccgtcgacgaggcgtgcaagcagtacaccaagtacccggagctgtgcgtcaagtccctgtcgtccgcggcgccggaggcgaaggcgaaggcggagcggggcgggctggcggggctggccgggctggcgctggcgcaggcggcgca

SEQ ID NO: 8448 - DNA, 363 bp, Zea mays
  Clone ID: LIB148-029-Q1-E1-B11
ggtggggcatcgccgaggccgacgggcccgggcagtacaacttcaacgggtacatggagctcatggaaatggccagaaaaaccgggctcaaggtccaggccgtcatgtccttcaaccagtgcggcggcaacgtcggcgattcagtcaccataccacttccgggatgggtcttggaggagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggaga

SEQ ID NO: 8449 - DNA, 376 bp, Zea mays
  Clone ID: LIB148-028-Q1-E1-F9
ggcgctggccctggtggtcctcctggtggtggcgacggcgttggtgcccacggccaccgcgtacggctgctacgacgactgctacgagcggtgcgccaacggcaagaatgacgaccccgcctgcaccaagatgtgcaaccaggcgtgcggcagcaccgacaagggcgccgccgccggcgcgccggcttgatcgacccgggctttatcggcgcgcgggctcagctcgatatcatcatatacaatcgtttgctagctccgtcgttcacgtcagcccatgcatgatctctcgacccggcccattgaatcttctccctctactacattatcgctttgttgcatgtcatcgttctcatacatcgatccactcatccttttt

SEQ ID NO: 8450 - DNA, 364 bp, Zea mays
  unsure at all n locations
  Clone ID: LIB148-028-Q1-E1-G1
cggcgcctggtcgtgccgggaggccgcggagcgggaggcgcacggcgtcgcgcaggccaccgggtcgctggtgcacgaggccgccgtcgcgctgcggagctgaccggccgggacgggacgggacggaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcagtgcagtgcagctccggcgtagatgagattgtattgtgaccaagccgggagggaaagcanggangggaagacaaagatgttttgtcacgtttc

SEQ ID NO: 8451 - DNA, 384 bp, Zea mays
  Clone ID: LIB148-028-Q1-E1-G10
cggacgcgtggggccgacggtctcggtctcgcaggggcagggctgggcggtcgacggaggccaattctccaacttcctccctccgtcgatcatccagcaccagcaggagaatcccgtcgaatccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttctgttataattactaccgagctactatctccacattattattggtaaagaaagaaagggcgcctcctctaatttgatgggcattccgtt

SEQ ID NO: 8452 - DNA, 389 bp, Zea mays
  Clone ID: LIB148-028-Q1-E1-G11
acacacgcgtctgctctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgc

SEQ ID NO: 8453 - DNA, 368 bp, Zea mays
  Clone ID: LIB148-028-Q1-E1-G12
gcatgatgcgtcgccgagccatgacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaagcggcggcgggctggaccccgac

SEQ ID NO: 8454 - DNA, 365 bp, Zea mays
  Clone ID: LIB148-028-Q1-E1-G2
aggctgaggcgcaccacgttcagggagacctcgcggcgttctacaactgccggttcgacgcgttccaggacacgctgtacgtgcacgcccggcgccagttcttccgcaactgcgtcatctccggcaccattgacttcatcttcggcaactcggcggcggtgttccagaactgcctcatcgtcacgcggcggcccatggacaaccagcagaactcggtgaccgcgcacggccgcacggaccccaacatgaagtcggggctcgtcatccagaactgccgcctggtgcccgaccagaagctcttccccgaccgcttcaagatcccctcgtacctgggccgaccctggaaggagttttcgcgcctcgtc

SEQ ID NO: 8455 - DNA, 351 bp, Zea mays
  Clone ID: LIB148-028-Q1-E1-G3
cccacacgtccgcccacgcgtccgcccacgcgtccgctcacgcgtccgcccgcctccatttcttcatggtcggcttcgcgccgctgacgtcaacggggtcccagcagtaccgcgccctgaccgtcccggagctgacccagcagatgtgggacgcgaagaacatgatgtgcgcggccgacccgcggcacgggcgctacctgacggcgtcggccatgttccgcgggaagatgagcaccaaggaggtggacgagcagatgctgaacgtgcagaacaagaactcgtcctacttcgtggagtggattccgaacaacgtgaagtcgagcgtgtgcgacatcccccccacgggcctgg

SEQ ID NO: 8456 - DNA, 364 bp, Zea mays
  unsure at all n locations
  Clone ID: LIB148-028-Q1-E1-G4
cccaggcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcncgcgcattcccgatg

SEQ ID NO: 8457 - DNA, 364 bp, Zea mays
  Clone ID: LIB148-028-Q1-E1-G5
cggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaagtgcgcaggccgcactctgggcgcgcccaaaggggtcccctaaa

SEQ ID NO: 8458 - DNA, 209 bp, Zea mays
  Clone ID: LIB148-028-Q1-E1-G7
gagatgctcatcctgcagggccacgcgcagcaagggtatgtggtgaggcaagttgcatcgccctcgacatcctcacgtcgtgttcgggcagcgtgagacgcatcacgggctccgcagcggcggctagcacatccattaccaggcgtaggcgcctggggtgacgtacgactcccaacggtacgaggccgtaccaggctatggtcatgttg

SEQ ID NO: 8459 - DNA, 367 bp, Zea mays
  unsure at all n locations
  Clone ID: LIB148-028-Q1-E1-G8
gcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgaccccctactacgttcggtaacgtcgtcgtcgtcgtcgtcgtcgtcgtccggcctaaaacatatgtaatttgatgctggtcgcgtgtgtctgtcagtcgatagactggacgcatgccgacttcatgcggacctancgcgtgtc

SEQ ID NO: 8460 - DNA, 346 bp, Zea mays
  Clone ID: LIB148-028-Q1-E1-G9
ctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactataccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagcttgtcaaag

SEQ ID NO: 8461 - DNA, 328 bp, Zea mays
  unsure at all n locations
  Clone ID: LIB148-028-Q1-E1-H1
ggccgggggcctcccgccgtcggagccgccgcacctgcanggccagccgccgcaagagtacgggtacggcacgttccaaggccctcgacatcctcccgtcgggttcccgcagcctgccccgcctcccgggctccgccggcggcggctatcacaaccagcagcagccgtacgcgcctgcggagacgtactacgcccaggggtaccaggccgtaccaggctatggtcctgttgctgaaggaagacctgtgagaatgaggcgtctcccatgttgtggcctcggcttaagctggtgtctgttcataaccgggtttttcctggctgccattcc

SEQ ID NO: 8462 - DNA, 334 bp, Zea mays
  Clone ID: LIB148-028-Q1-E1-H10
accacgcgtccgcacattcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggtcgtcgccgagcccgaccacaaggaggacgaagccgtggaga

SEQ ID NO: 8463 - DNA, 394 bp, Zea mays
  Clone ID: LIB148-028-Q1-E1-H11
atttcgttatcctcctcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtccggcatctacgacgagcccatgacccccg

SEQ ID NO: 8464 - DNA, 351 bp, Zea mays
  Clone ID: LIB148-028-Q1-E1-H12
aagaacccatccgcggtcgccagagcacaagaatctaacctcgcgcttctcacgtacgggcagctcaacaacgtgtgggaggcagtctacatccaatacctgatgggcgtgcacggcgtcatcgttgaccgggtggaggagatctcggacgccgtggccggttttggtctggggaaaccaggccttggccggggcggtgctggcgtggacggagcgaaaacgcatcaggctcaggccttctcgcagcagcagctggggttcctgctccggcttatccctgaactgattgagcagcggcactgaaggacggtacaccaccatatgtaacatcccagttttttgaccccctcg

SEQ ID NO: 8465 - DNA, 383 bp, Zea mays
  unsure at all n locations
  Clone ID: LIB148-028-Q1-E1-F8
cccacgcgtccgcccacgcgtccggaagtattcggtgcgacccaacactggggttgtcttgccacggtctacctgtgatgttgttgttacgatgcaagcacagcgggaagccccgcctgacatgcagtgcaaggataagttcctagtccaaagcgtcgttgcccctgctggtataactgtgaaggatgtcactggggatatgtttacgaaggagtctgggtataagatggaagaggtcaaattgcgagtgacctatgttgctcctccacagccaccctctccagttccagaggaatctgaagaaggttctccacctanggcttctgaatcagaaaacggagatggaccttctggaggattcaccagagcactaagagaacgca

SEQ ID NO: 8466 - DNA, 351 bp, Zea mays
  unsure at all n locations
  Clone ID: LIB148-028-Q1-E1-H2
cgacccacgcgtccacccacgcgtccggtnagagttgatgtacttggatgggtagtttggggaagagtatgggtaagggacgttctgaggtcgtcgaaatcctcgcgtcgggttcgatcagggtgacccgcctctcgggctcggtggtggcggctatcacaaccagcagcagccgtacgcacctgcggagacatactatgcccattggtaccaggccgtaccaggctatggtcctgttgctgaaggaagacctgtgagaatgaggcgtctcccatgttgtggcctcagcttaggctggtgtctgttcataaacgggtttttcatggctgacattccatggttcattggagc

SEQ ID NO: 8467 - DNA, 362 bp, Zea mays
  Clone ID: LIB148-053-Q1-E1-F6
cagaacatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgct

SEQ ID NO: 8468 - DNA, 369 bp, Zea mays
  Clone ID: LIB148-053-Q1-E1-F7
acggaggccaattctccaacttcctccctccgtcgatcatccagcaccagcaggagaatcccgtcgaatccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttctgttataattactaccgagctactatctccacattattattggtaaagaaagaaagggcgcctcctctaatttgatgggcattccgtttccttctcaacttcaacgccaacaacagttgatgctac

SEQ ID NO: 8469 - DNA, 411 bp, Zea mays
  Clone ID: LIB148-053-Q1-E1-F8
gatgggttttgctagaggttcttgacaaaatttctccagggtcagttaactggaagcatgcatccaaaccaccaatcattatgccgtttagaaaggttgaaaactgcaaccaggttatcaaaatcggcaaggagctaaacttttctctggtaaatgtagcaggaaatgatattgtgcaaggaaacaagaaactgattctagctttcctgtggcaactcatgaggactagtatcctacaattgctgaggaacttgagatcccactctaaagagaaagagatgacagatgctgacattctcatttgggctaatagcaaggtcaaggaatcaggcaaaaattcacatattgaaagcttcaaggacaaaacgatagcagatggggtgttcttccttgagctcctaagtgctgtgc

SEQ ID NO: 8470 - DNA, 403 bp, Zea mays
  Clone ID: LIB148-053-Q1-E1-F9
caacgtcatggactgcacgcttaagaagacggccaatggcgtccgcatcaaggcatatgaggacgctgcctccgtgctcaccgcctccaagatccactatgagaatatcaagatggaggactcgggctaccccatcatcatcgacatgaagtactgccccaacaagttatgcaccgccaatggtgcctccaaagtcaccgtcaaagacgtcaccttcaagaacatcaccggcatctcctccaccccggaggccgtcaacctgctctgctccgccaggatcccatgcaccggtgtcacgatggacgacgtcaacatcaactacagtggcaccagcaacaagaccatggctgtatgcaagaacgctaacggcagcgccaaaggttgcctgaatgcgctcgcatgc

SEQ ID NO: 8471 - DNA, 407 bp, Zea mays
  unsure at all n locations
  Clone ID: LIB148-053-Q1-E1-G1
ggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacgcanatgtgtgtttttcatcgattgaatgggtaataatanaaaggcatgctggcagttactactaa

SEQ ID NO: 8472 - DNA, 395 bp, Zea mays
  Clone ID: LIB148-053-Q1-E1-G10
tcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaccagctcgtcgtcgtc

SEQ ID NO: 8473 - DNA, 420 bp, Zea mays
  Clone ID: LIB148-053-Q1-E1-G11
gcggcatttcgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctacggccacctggtacggtcagcccaacggtgccggcgctcctgacaactgcggtgcgtgcgggatcaagaacgtgaacctgccaccctacagcggcatgacggcgtgcggcaacgtcaccatcttcaaggacggcaagggctgcagctcatgctacgaagtgagatgcaaggaaaaacctgagtgctcgggcaatccagtcacggtgtacatcactgacatgaactacgagcctatcgctccctaccac

SEQ ID NO: 8474 - DNA, 383 bp, Zea mays
  Clone ID: LIB148-053-Q1-E1-G12
aacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccat

SEQ ID NO: 8475 - DNA, 416 bp, Zea mays
  unsure at all n locations
  Clone ID: LIB148-053-Q1-E1-G2
agtcacagtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttcntcatccgcctcaacagcgagtccggcaagaaggtcatcgccaaagacg

SEQ ID NO: 8476 - DNA, 407 bp, Zea mays
  Clone ID: LIB148-053-Q1-E1-G3
caacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatgaaggatgaacggttgcggccgatgatcgatgtgtccgtcggcatgtcgatcactcattgaaaccccctctaatcctgtgcggtattattttcatggcacctgtggccattaaagatccatggacacgtacagtaccaatacatgattcttcacagttcaactatcgatgatactgttcatgg

SEQ ID NO: 8477 - DNA, 397 bp, Zea mays
  unsure at all n locations
  Clone ID: LIB148-053-Q1-E1-G4
gttctagatcgcgatctagaacgaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgaaggcatgctgcgaagcgtgcgccaacctcaaggccgccttcctggtgtccgtggtgttcctgngcctgtccacggtggtgaccatgatcttcgcccgcgaggtgccgctggacccggcggcg

SEQ ID NO: 8478 - DNA, 396 bp, Zea mays
  Clone ID: LIB148-053-Q1-E1-G5
ccaaaacatagagtgtcgacttttctattggtgtgattgggggcactaaatacctaccacattgcactcagactacatatactgtgtttgtgtgttgtatgccgtatgcgtgtgtgagcttgcgcaaattggacatctaggccgtgcgtaccctgcgatgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtgaagtccatcaagtccttctgccagcccgtggactacagggagacgtgcgagaaggcgctggaggcggcggccgggaacgccaacaagcccacggagctggccaagggcat

SEQ ID NO: 8479 - DNA, 435 bp, Zea mays
  Clone ID: LIB148-053-Q1-E1-G6
cgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggg

SEQ ID NO: 8480 - DNA, 402 bp, Zea mays
  Clone ID: LIB148-053-Q1-E1-G7
ataaaatttccaacatttctggaagacgactccagtccatctgcagcggtccttgttgggataggtttcaaaggcatgagagtgatgagggtcaaaaatctgaacctctacgcttttggtttatatatgcaaccgacttctatccgtgagaagttgggtcctaagtatgcttcatttccaactgacaagctgatggagaaccctgatttctatagtgatcttctcagagaaaaccttgatataagggtcaggttggtggttaactacaatggccttagcgttggtgcagtgcgagatgtgtttgagaagtcccttggcctgcggctgcagaagatgaatcctaacacagactttcactgcttgaagacctttggttctcacttcacagaagatatcgctata

SEQ ID NO: 8481 - DNA, 406 bp, Zea mays
  Clone ID: LIB148-053-Q1-E1-G8
acaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacct

SEQ ID NO: 8482 - DNA, 414 bp, Zea mays
  unsure at all n locations
  Clone ID: LIB148-053-Q1-E1-F5
gatcgatccaagaggaggaggtgtgtccgtgcgtacgtgtgtgcagcgagcagctagggcatatgcattatttcagaagagaactagctactccgatcaagatgagcgacgaaggattgtacgtatattgctgagaggagatcgaagagacggtgatgagttggcggaagatcgatgcatgcgtggatgatcatcacagccaatcgtacgtgtgtaaaaggtcggccggaggggggaataatcgtgcatgagacacctctctcgctcgctcttcctctcctacgtcttaattcattgggttcgtcgatccgagatcctacgtacgtcgtcgtttttgtattgtatatattataggtcatcatctcgtgngggtcatcanatctggccggtttggtggtgtgttgtaatttgtaa

SEQ ID NO: 8483 - DNA, 386 bp, Zea mays
  unsure at all n locations
  Clone ID: LIB148-053-Q1-E1-E1
gcgcgtggtggagatgaggaagattggcggtgactcgcccgagttccgagagttctacaggcaggaactgaagccatcgttaggtgacattgtatggtcgtggcagggcagtgattcgcctcctactcccttgctgccgccggcgctgaggcaggcaaccaaccaacgtccatgatttcctctgcataaaaaaatttgcagtggaattttggcacttatggttcactaaaaacatgatgttaaacatattgttactattaagggtggctggcaaatgatttgtcactgtcatanggacgctgtactagtagcataacatttgtgataatatatcatcacgggctcataatagatatgacaatgaaaatgatttttattganaaaaa

SEQ ID NO: 8484 - DNA, 377 bp, Zea mays
  Clone ID: LIB148-053-Q1-E1-E10
cccacgcgtccgctatttacacccaaggaaggccatggatacagtgaagatgaggatcacttggctttaatgatggaactacttggcaagatgccgaagaagattgcaaccatgggaacacgatcaaaggaatattttgaccgccatggagatctgaagcggatacgaaggctgaaattgtcatccattgaacgtgttctcgttgacaaatacaaaatttctgaatctgatgcccgggaattcgccaattttctttgccctttactcgactttgcaccagagaagaggccaacagctttagattgcctaaagcatccatggcttaaacatgacgaggataaaacatgtgggtctcttaacaataatgatgccaagag

SEQ ID NO: 8485 - DNA, 421 bp, Zea mays
  Clone ID: LIB148-053-Q1-E1-E11
ggcaacttcactgtaggcacttgccacactcccaatgcaaagcagatcgttgagaaggaatgcctcgacaagccatcctgcatgctgccggtggatcacacggtgtacggcgcggacatcaactgccaatcaacgactgctacactgggggtgcaggtgagatgcggagggggcaagaagggtgcctgagaataacaagatggatgctgctaattaatggacgtttcagcttgtttgtttgttcatcccttcggtttggcactgatgcttacattgttctgacattgcaattgaaatgtgattggaacattcttgatcgggaactaacatgaaatgagtggagggtagatgctgatcagaccaaagatgtgtatttcccccctctttccttctgtctcgtgttgtttcatgtaaccatcac

SEQ ID NO: 8486 - DNA, 390 bp, Zea mays
  Clone ID: LIB148-053-Q1-E1-E2
cccacgcatccggtcgtcgtgggccttcatttctcctagaaggtagaaggtcgagaggagaagaaggcgagacgtgcagtccgtcgggcaccgatcgagaacagggaagcaagaggctgctagagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaggtggaggacaaggcggtgaagctgggaactgtggccaaggacatcgccagcgccatggccaccacgacggacgagaagacggcgttctgggaacctgaccccgagaccggatactaccgtcgggtcaccggcacg

SEQ ID NO: 8487 - DNA, 334 bp, Zea mays
  Clone ID: LIB148-053-Q1-E1-E4
accacgcgtccgcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcatcttcgccaaggtgtaccacgggccggaacctcgcgtccggcgagagcctggccatcaaggtcatcgac

SEQ ID NO: 8488 - DNA, 371 bp, Zea mays
  Clone ID: LIB148-053-Q1-E1-E5
acccacgcgtccggctccccgtccttcggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaaacaca

SEQ ID NO: 8489 - DNA, 376 bp, Zea mays
  unsure at all n locations
  Clone ID: LIB148-053-Q1-E1-E6
attatatcattctctatacacatcattcgggcgacaagaaagaagagtactatctcagctactggattgggaaggatagcttggtggacgatcaagtgtcggcatctcaaataatcaatacaatgtggaattcattgaaaggacggccagttctgggccgtatataccaagggaaggagccaccacaatttgttgctcttttccagcccatggttatcttgaagggtggaatcggatctggatacaagaagctcatagaagaaaaaggtgctatgggtgagacttatactactgaaggcatagctctaattcgagtatctgagacatctatctacaacaacaagactcttcaagtagatgcngtagcaccgtcttt

SEQ ID NO: 8490 - DNA, 384 bp, Zea mays
  Clone ID: LIB148-053-Q1-E1-E7
cggcggcggcggctctggacaaggggttcgagttcgacgccaccaccgcgcggtgcgtgacgttcgcggccagcggggaggtcgtggccacgcacgccgtcgcgccgggctccgcgtgcgcggtgaacggcacgggtcacttcggtatagcggtgctgctgcccgagacgccgccgccagcctcggccgtgagggccaggtggtgggcgtggacggtgggtgtcggcgccggtggggtgctgggagccagcgccttgacgctctctgtggccggcgcggtgagctggaccaggatgcggcgaagggaggagatggatcggcgggcgatggccggggaggagctggggaggatgacggtgcgcggggagcaggatgccatcggcg

SEQ ID NO: 8491 - DNA, 63 bp, Zea mays
  Clone ID: LIB148-053-Q1-E1-E8
cggctgctctgtacaaggggttcgacttctacgccaccaccgtgctgtgcgttactttcgcgg

SEQ ID NO: 8492 - DNA, 425 bp, Zea mays
  Clone ID: LIB148-053-Q1-E1-E9
ggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaa

SEQ ID NO: 8493 - DNA, 375 bp, Zea mays
  Clone ID: LIB148-053-Q1-E1-F1
gcgtggtcggctcgggaggcgaaaccctagccgctgccccactctccgtctcgccgctgccagaggggctggccgggttggccgcgcgggcccccaggacggcggcggcgaggcatcccctgttggcgttgagagctcccagattcgtgcggggaaggagctcgtggccaaggcttgatcttggtggccgtggtggtgctgtgcgacctcgtgggcacctcatgggcacattcgtgctgtgcggcgaggcataccatgttggcgttccggagttttggcctgacgattgtgctggagcttcttgggcgaaagcctcgggacggtgatacccatgggcgcggttttccctcttgagggcgtcgcacggtgaaagcc

SEQ ID NO: 8494 - DNA, 411 bp, Zea mays
  unsure at all n locations
  Clone ID: LIB148-053-Q1-E1-F10
gcgcctaggggcggaaggccgccgtgcccgttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacganggggatcacggtcgggtgaggtgactaagctggcggacggaacgccgctcctctacgacgtcggaaacccgttcgcgttgctctccagcatacc

SEQ ID NO: 8495 - DNA, 423 bp, Zea mays
  Clone ID: LIB148-053-Q1-E1-F11
cggacgcgtgggcggcgggaggcaggggacgcacgggcaggcagccatgaacggcatcaaccccaacggcgggttcctgtcgtacgggaacatggagagctatgcgatgtgggtggcgaccggcgtggcgtcggccttcttcgcgtccctcgagcgctgctcctgcatccacctccacaccgcggaggacgacggcgacgaggaggaggaggacctcgaggaggcccgccgctccttctcccgcccgatccctgagtactactacgaccggtccggctcctccgcctccgtcgccaagatgtgacctgaccgaaccgcgcctccctccgcccaagaaatgcgtggtgatacgatccgtttcttgatctattatgtgctcttgcttgattcgttgagtctctagccaagaagatgaacaacaac

SEQ ID NO: 8496 - DNA, 401 bp, Zea mays
  Clone ID: LIB148-053-Q1-E1-F12
acaaagccacaacacatacaggaaagcaagcaagaatcatcggaataatggcccgtgcatgcgtgttcctcgtcgtgctcctcctggccgccatcgcggtggcaccgttcgcgggcgccgcacgcgtggacgttgtggagggtaggtccatggcatccgccgatgcaccggaggcggcggccgatgctcccgctcctagccccgactccgcctcatccccagactcgtcatcggaggcgccctctagcagcagttcctccgactagacgcaaaaacctcttcattctctggaaataactaacagtatatacgttgcaccctgatgatatagaaacatgtacgtgcatcagtgtatggaatgcgagtggcaaacacatggaatgtgcttgcctaattattgt

SEQ ID NO: 8497 - DNA, 401 bp, Zea mays
  Clone ID: LIB148-053-Q1-E1-F2
gctcccctgccgccctgcgcatgcacgcgcgatgccggccggctgctccggcagtccggccccttcccttcccttccctgcccgtgcctggcccttgagcccctgacgcgcgcgcatgcatgtggcgtacccgcccggcggtggccgtgcgtgccctcatgcatgctgccgcctgccgcgcgcggagccccgcgcgagccgcccacaggccacagccgagcgagggaggcaggcagagcagcggccagcgctgaagcccacggtggcagcaagcagcttgcgcatgtggcctgtctaccggccgccggcccgggtaggcgggcgagccccgtcgtcggatggatccgtcggctttcggtttcttcagccgtggagtctcgtgcgcgcgcgggacgggactc

SEQ ID NO: 8498 - DNA, 390 bp, Zea mays
  Clone ID: LIB148-053-Q1-E1-F3
aaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaacgg

SEQ ID NO: 8499 - DNA, 397 bp, Zea mays
  Clone ID: LIB148-053-Q1-E1-D9
ccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggcggcggctaccgcggtgccgcctgcaggtgccagtgccaagacctccagcagcaacgatgcccgcgacggcgccatgggcagcgtgcaggacgagccgcggcagcagcgccacgatgactatcaccccgagatcgtccccgagaagatcatacacgaggacgcgttgccggtcgttgctgcagagaaggagaccgccgccgccgccgccgtct

SEQ ID NO: 8500 - DNA, 390 bp, Zea mays
  unsure at all n locations
  Clone ID: LIB148-053-Q1-E1-F4
ccacgcgtccgactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccggtnttcacctcgtgt

SEQ ID NO: 8501 - DNA, 438 bp, Zea mays
  Clone ID: LIB148-053-Q1-E1-C2
ctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacgggcggaacctcgcgtccggcgagagcgtggccatcaaggtcatcgacaaggagaaggtgatgcgcgtcggcatgatcgaccagatcaagcgcgagatctccgtcatgcgcctcgtccgccaacccaacgtcgtgcagctgcacgaggtgatggcaacaagagcaggatata

SEQ ID NO: 8502 - DNA, 365 bp, Zea mays
  Clone ID: LIB148-053-Q1-E1-C3
gcaataacccctctctcccttcgtcaccatcacatccagccagccaacaaaaatgtcgcgcgtcacagctgcggtgctcttctacatcctcgccgttgctgccctcagcgcggccgaggccccggcagagtcaccgaatgaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacagccccttcttccacggacgaggagttgagcccttcgccgccagcatccaccgccgcggcgtcccctgcggctg

SEQ ID NO: 8503 - DNA, 308 bp, Zea mays
  Clone ID: LIB148-053-Q1-E1-C4
gccgcaagccgctgcgcgggcactgccgggacagtggacaaccgtgaataagtacaacgccacgatcgacgccagaacgcagcaagctttcgacggcgtgggggccggcgctacggcacaaaagcggtcccacgccgtggccgccgtgctgcaacagcagctgaacatagacgtggtccctgtccaaagccacgtcttccggagaccagatcacataccttaccgtggcccccgcatacgagaaagccgcgggcaccgtcagcgcggccacgcccgacaagaagatccgcgccaatgagcttcccgtt

SEQ ID NO: 8504 - DNA, 413 bp, Zea mays
  Clone ID: LIB148-053-Q1-E1-C5
accgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaaggagagag

SEQ ID NO: 8505 - DNA, 363 bp, Zea mays
  Clone ID: LIB148-053-Q1-E1-C6
gcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttc

SEQ ID NO: 8506 - DNA, 402 bp, Zea mays
  Clone ID: LIB148-053-Q1-E1-C7
acaagcctctaaactgagtcgtatgactcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggatgaggcgttgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagac

SEQ ID NO: 8507 - DNA, 347 bp, Zea mays
  Clone ID: LIB148-053-Q1-E1-C8
acacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccggcgtcggcgccgccctcggggccgccgtcgcctccttcttcggctactacattcagtgagccggccggggctcccggaggccgaggaggagacgaaggcgagagagagtgacatg

SEQ ID NO: 8508 - DNA, 425 bp, Zea mays
  Clone ID: LIB148-053-Q1-E1-D10
acggacgcgtggggcatttcgaataacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcaaggaaaaacctgagtgctcgggcaatccagtcacggtgtacatcactgacatgaactacgagcctatcgctccct

SEQ ID NO: 8509 - DNA, 421 bp, Zea mays
  Clone ID: LIB148-053-Q1-E1-D12
aaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgaggggcatgctcgagatggccggcgg

SEQ ID NO: 8510 - DNA, 408 bp, Zea mays
  Clone ID: LIB148-053-Q1-E1-D2
catggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtgac

SEQ ID NO: 8511 - DNA, 371 bp, Zea mays
  Clone ID: LIB148-053-Q1-E1-D3
cgacgagctgctgtgggccgcgacctggctgtacctggcgacgaggcggcaggtgtacgcggacttcatcgcccacgaggccatctcgtcgagcgtggccgagttcagctgggacctcaagttcccgggcgcgcaggtgctgctggccgagttcaacatgacctcggcgggcggcgcgcagaacttcaagtcgcaggcggacaactttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctg

SEQ ID NO: 8512 - DNA, 374 bp, Zea mays
  Clone ID: LIB148-053-Q1-E1-D5
gtcgccgccgcagctgaccacaacatcatcgaactgacagggacagacaggccaggactgctctctgaggtcagcgctgtgctcatcagcctcaagtgcaacgtggtcagcgccgagatctggacccacagcactcgagccgcggccgtgatgcgggtcactgacgaggacactgggctggcggtcacagacgctgagaggctcgagatgatcagggatatgctgtcatacctgtaccgtggacgcaatctctcacgaggtggcagacagtcctcgacgactgccagaactcatagtgtgagtatgctgcaacgtaggaatcactatgaccgcgttcacgcaccactatctcagctccatccacgacgatctca

SEQ ID NO: 8513 - DNA, 396 bp, Zea mays
  unsure at all n locations
  Clone ID: LIB148-053-Q1-E1-D6
ctcatcgagaggctcctcaagacctcttccttccaagtgaccactgtcgactccgggagcaaggcgctgcagttcctggggctccatgaccaggacagcacggttcctcctgtccacacgcaccagctggatgtggctgccaatcaagatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaatangtgcctggaggaaggagctgacgagttcttcctaaaacctgtgcggctatcagacatgaacaagctcaagcccacatactgaaaagcagatgcaacagga

SEQ ID NO: 8514 - DNA, 395 bp, Zea mays
  unsure at all n locations
  Clone ID: LIB148-053-Q1-E1-D7
gaaaaactcaagctgcacctcccgcccgtgctcctcctggcacggtaatagcaaagaagagtacgggagccgagaactatgtccccatccagaggacgacgagcgtgccggcggcgagaccaacagagacgctcaagaacgaggaacaggaggtcgacgagctgctgatgcagttcgacgagaaggagagcataagcacctcctccattgaggagcacctgcaagaacggctccctgaccctgtcgatctgaaatccgtggatctcgacagcagcaagacgacgtcctcctcctccagtcaggaggagtgcaaggatcaagaagagaacacgggggacattctggaggagaagcgtgacgggaaagacagcgangacctgagcagcaaaggcgac

SEQ ID NO: 8515 - DNA, 381 bp, Zea mays
  Clone ID: LIB148-053-Q1-E1-D8
accaacgtgtggctggaccacctctccctctccaactgccaggacggcctcatcgacgtcatcgccaagtccactggcgtcaccatctccaactgccacctcaccaaccacaacgacgtcatgctcttcagctccagcgacaagcatcccgaggaccagatcatgcagatcaccgtcgccttcaaccacttcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacg

SEQ ID NO: 8516 - DNA, 411 bp, Zea mays
  Clone ID: LIB148-053-Q1-E1-C12
tacacacgcgtctggcagcaagatggacatggacgcatcctccacgggcaccaacatgcagggcagcctgctgtcacgacgcgcctcagactggctcgcgctgctcgtcatcaagtccggctagctcctggtgcacctcctgctcacgatcctctacgtcgtcgtctccgtgttctcagtagcctcagtctactctgctaagcgcaactcgctgaccttcacgcgcgtggtctccgtagtacctcgcgtctggcggacgctcgccgcgacgttcatcgcggcgttcacgatcttcttcacctagcaggctgtcgccgtgctcgtcttcatcggcctcactttttcagcagacaactgttctgggtcgcgtacctgctcgccttcctcgtcgacgttgcgtatcagctcgga

SEQ ID NO: 8517 - DNA, 426 bp, Zea mays
  unsure at all n locations
  Clone ID: LIB148-028-Q1-E1-E2
aaaatgagaaaagctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccganagcgcgcgcgaggactgcaaaaagctccctggagacaccgcccaaaaactgaaggggcatacccaaaaatgccggggggaa

SEQ ID NO: 8518 - DNA, 363 bp, Zea mays
  Clone ID: LIB148-028-Q1-E1-E3
gtttgggcagctccggggcgtggccctggtagtcttcgccgccactgctggcgcttcttcgtgctatttcctgtcgaagatgattgggaagccactggtgttcacgctgtggccagataaactcagcttcttccagagacaggttgctataagaagagagaagctcttgaattacatgcttttcctcatggtgaccccaacattgccaaataccttcatcaacttggcttcaccgatagtagatgtcccctaccatatattcttactgggaactctcattggccttatcccagcttcttatgtgactgtcagggctggaatcgctcttggagaattaacttcgctaagcgacctttacgacac

SEQ ID NO: 8519 - DNA, 382 bp, Zea mays
  Clone ID: LIB148-028-Q1-E1-E4
ggtcgatgcaagcctctacagtgagtcatcgaacagtctcgcaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctacgagctccactgagcgacgacgcgcggggcggcaacgttgggatgcatcgtg

SEQ ID NO: 8520 - DNA, 355 bp, Zea mays
  Clone ID: LIB148-028-Q1-E1-E5
cgagccgcagaagtgcaagtggacgaagaaggcgcggaagaaaaagaagacgaagaatgagcagaacgggctggcagccctagtggaggagatctcgctctcgaacagtcccaagcacagggcagcagcaggggagatactgcggatcggcaaccacaacatacccagcagggtgtttacgttccgtgaactggtggacgccaccaactctttctgcccagaaaacctgctgggcgagggcggcttcgggagggtgtacaagggatgcattccagacaccatggaagtcatagcggttaagcagctcgacaaagatgggctgcaaggtaaccgtgagttcctcgtcgaggtgctg

SEQ ID NO: 8521 - DNA, 385 bp, Zea mays
  Clone ID: LIB148-028-Q1-E1-E6
gggctagctagctagacaaggtccattgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcagatacaatttccgagttggatcgagaagagtgcgtgcatccgatccgtccgtccacgttcgtggttcgtataagctaggtttcatcaaccatgggcacaaagatgaagaagggcatcctgaagccgttccgctatatctcgaacatgatggacggtaaggagcctgaaatgcaaattgggctccccacggatgtaaaacatgtggcacacat

SEQ ID NO: 8522 - DNA, 355 bp, Zea mays
  Clone ID: LIB148-028-Q1-E1-E7
gccgccggccgcggagggtgtccaggaaggcgacgtgctggtcgcgttccgggacacgctgcgcggtctggacggcgcgccgccgggcccgctgcggaactggggcacgccgggtccgtgccggggcaactcctcctcctggtacggcgtgtcgtgccacggcaacggctccgtgcagggcctgcagctggagcggctcggcctgtcgggtggcgcgcccgacctgtccgtcctcgccgtgctcccgggcctgcgcgcgctcagcctctccgacaacgcgctcaccggcgccttccccaacgtgtccgcgctcgccgtgctcaagatgctctacctgtcgcggaaccgcctgtcc

SEQ ID NO: 8523 - DNA, 356 bp, Zea mays
  Clone ID: LIB148-028-Q1-E1-E8
cgccattttcctctcctctcctctccctccatctaaggagaggagagatatgcagctcacgagctccaccaaatgctgacctcccaaagctgtggtcgcgatccaaacagaagggaaatgatcaggcgacaacccggcatggatcggttcctgcagctgctggccgccggcgtggccgtgctactgctagtggcaccgcgggccatggctgacgacgacattgtagaagtcggcgtcaactggggatcgcagctctcgcacccgcttctccccggctccgtggtgaagatgctcaaggcgaaccgcatcgccagggtcaagatgttcgacgccgactcctggcccgtcggagcgct

SEQ ID NO: 8524 - DNA, 383 bp, Zea mays
  Clone ID: LIB148-028-Q1-E1-E9
gccaccgacgccaacatcaacaaggcctacgcggagggggacaaggacaagatcgcaaaaatccttgctgcatacggccaggcggccgacgcggtcgctgcggccccgcctcccgagaagctcaaagtcatggagaagaccttctcggcggtcgccgccgccgctcatcaggaggcggcggcggctgctgctgctgctgcagtgattaaggtttaagggagagctcctgcatgaaattaaccacacgtccacacgtatacactacggaacaagtgtttccatcagacgaccatcagtgaaaaaaaaccatccttctctgtgtgtgtgccgtgtttttgtcatttcttctttccattggcaaagaaaccgggtaaccttttttt

SEQ ID NO: 8525 - DNA, 76 bp, Zea mays
  Clone ID: LIB148-028-Q1-E1-F1
ttttttttttttttttgagtttgcacattgattttccaacgttttgatacttataaaatgctttttttgttgtttc

SEQ ID NO: 8526 - DNA, 371 bp, Zea mays
  Clone ID: LIB148-028-Q1-E1-F10
cgctcttggtgctagccctcgcgctagtggcggccaccgccccacaggtagcggaggcaaagaagaagagagcggcggagagcggcaatgacaacggcggcggtgatggtagggcaagtattccaggcaatgcggagccagccgaagccgaagagaacggcagccggttgccgccatccttgcagtggctcaacagcctgttctcgccatcggcgcagtcctccggtagcggcagcggcagttcgcatcattgggagaattgagcaataatgcaatataaggatggatgattgttgctgcttgagcccattggtgccaatgtacataggaagagcaggagcatgccggcatgaaaatttggagcccttttt

SEQ ID NO: 8527 - DNA, 374 bp, Zea mays
  Clone ID: LIB148-028-Q1-E1-F11
gacacacgaatctacactcatgccgctaaccctcgcactagtggcggcaatagcaccacaagtaacggcagcacgaaacagtacagcggagaacagcggtactgacaacagcggcggtgatggtaaggcaggtattcgacacaatagcgcaccagccgaagccgaagacaacggcactgggttgccgccatcactgcaatggatcaagagcttgttctcacgcatcggcacaatcctccggtcattccagcggcagatcgcatcattgggagaattgagcaatacctcaatataacgataggcgactgttactgcttgagcccattggtgccaatgtacatacgaacatcacgagcagttctgcatgcaaattt

SEQ ID NO: 8528 - DNA, 387 bp, Zea mays
  Clone ID: LIB148-028-Q1-E1-F12
tagtgcgacttggataataggaaggacctgtacggcaacatcgtcctctccggtggcaccaccatgttccctgggatcgctgacaggatgagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtg

SEQ ID NO: 8529 - DNA, 364 bp, Zea mays
  Clone ID: LIB148-028-Q1-E1-F2
cccacgcgtccgctcgtcgcggtactgcccggcactgggaacgcggtggggaagaaggttgacgccgtcgtccacactctcagctaaccagtgcctgggccgcggttggccacggtgggcgaccctggtggttcaccggtgcactgcgaatctaggcgggtcttcctggggctcgatctgggtctcatggttggctaatttctcaccggagcatttgggggacgggccgtgcgcctccaatttctcgccgtcgacgtgttctccgccgcgggactacagcgtgccatgggcgggactcctgggagcttaatccgcgcgcgaggtcacgagtcacctgaagatcatcctggtacctggaatctca

SEQ ID NO: 8530 - DNA, 329 bp, Zea mays
  Clone ID: LIB148-028-Q1-E1-F3
acggacacttgggggcgcggcctgcggcgggtgctacgaggtgcgctgcgtggacagccctagcgggtgcaagcccagcgcggcgacactggtggtgacggcgaccgacctgtgcccgcccaacgaccagcagtccgcggacagcggcgggtggtgcaacccgccgcgggagcacttcgacctcagcatgcccgcgttcctccagatcgcacaggagaaggccggcatcgtgcccatctcctaccgcagggtggcgtgcacgaagcagggtggcatccggtacaccatcaccgggaacaagtacttcaacatggtgacgatcaccaacg

SEQ ID NO: 8531 - DNA, 349 bp, Zea mays
  Clone ID: LIB148-028-Q1-E1-F4
gaggactcgggctaccccatcatcatcgacatgaagtactgccccaacaagttatgcaccgccaatggtgcctccaaggtcaccgtcaaggacgtcaccttcaagaacatcaccggcacctcctccaccccggaggccgtcaacctgctctgctccgccaagatcccatgcaccggtgtcaccatggacgacgtcaacatcaactacagtggcaccaacaacaagaccatggctgtatgcaagaacgctaagggcagcgccaagggttgcctgaaggcgctcgcatgcttctagacccaccattgacccatctctgtagttatacaatgtgtttggttgttggatgctg

SEQ ID NO: 8532 - DNA, 357 bp, Zea mays
  Clone ID: LIB148-028-Q1-E1-F6
acccacgcgtccgcgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcatcctccctggcatc

SEQ ID NO: 8533 - DNA, 343 bp, Zea mays
  Clone ID: LIB148-028-Q1-E1-F7
cccacgcgtccgcgagcggcaggtaccgctggtacagctcgccgccgttggtcccgccggcccagccgccaccgcacacgcccgcgtcctcgatgcagctctggatccgacgccacgtctcatagtccccgaccatgtcctgcagccagtcggagtagtccgcgatccggtactccccgtacccggccccggacacggcggaggcggcgccccggttggtgacggcgaacgcgaaggcggtggccacgaacatgccgatgaggatcacgaagatggcgacgacgtacgcccagaggagcggcgtggcgcggcagcaagcgccggccagagccaggagcgacag

SEQ ID NO: 8534 - DNA, 377 bp, Zea mays
  Clone ID: LIB148-028-Q1-E1-E11
cggacgcgtgggcggacgcgtgggcggacgcgtgggtgcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcaga

SEQ ID NO: 8535 - DNA, 363 bp, Zea mays
  Clone ID: LIB148-028-Q1-E1-C5
cccgtcctacgccagggggctgcaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccacagccttcttcgacgacttcggccgcgccatggagaagctcagcttgttcggcgtcaagaccggcgccgacggcgaggtcatgcggcgctgcgacgcctacaacagcggccccgccgtcgccgccaccatacccaagatgtgacgacgctg

SEQ ID NO: 8536 - DNA, 342 bp, Zea mays
  Clone ID: LIB148-028-Q1-E1-C6
gcttccccgaccacacgcaccgaggcttcgagaccgtcacctacatgcttgagggcgccgtgacgcacgaggacttcgagggccaccgtggcaccatcaaggccggcgacgtgcagtggatgacggccggccgcggcatcgtgcactccgagatgcccgccggccccggcacgtccaggggcctgcagctctgggtcaacctctcctccgccaacaaaatggtcgagcccgggtaccaggagatccagagcaaggacatcgcgtgcacgtccgacggcgacggcggcgtcacggtgcgcgtgatcgccggccacgccatgggcgtgcgctcgccggtgcgca

SEQ ID NO: 8537 - DNA, 352 bp, Zea mays
  Clone ID: LIB148-028-Q1-E1-C7
agcttccctcaccacacgcaccgaggcttcgagaccgtcacctacatgcttgagggcgccgtgacgcacgaggacttcgagggccaccgtggcaccatcaaggccggcgacgtgcagtggatgacggccggccgcggcatcgtgcactccgagatgcccgccggccccggcacgtccaggggcctgcagctctgggtcaacctctcctccgccaacacaatggtcgagcccgggtaccagcagatccagagcacggacatcgcgtgcacgtccgacggcgacggcggcgtcacggtgcgcgtcatcaccggccacgccatgggcgtgcgctcgccggtgcgcacgcgcacgc

SEQ ID NO: 8538 - DNA, 332 bp, Zea mays
  Clone ID: LIB148-028-Q1-E1-C8
cggcggctcgtgctcctcctccacggcttcggcgcgtcggcgacgtggcagtgggccccgtacctccgcagcctcctcgcggccggcctcgaccccatcgtcccggacctcctcttcttcggcgcctcctcgtccacggtccccgaccgctccgacaccttccaggccaggaccgtgaaggccgccatggacggcatgggcgtgcgccgcttcgccgtggtcggcgtcagctacggcggcttcgtcgcgtaccggctggcggccatgtacccggaggccgtggagcgggtggtcctcgtgtcgtcgggcgtgtgcctggaggagggggacct

SEQ ID NO: 8539 - DNA, 384 bp, Zea mays
  Clone ID: LIB148-028-Q1-E1-C9
ctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccagcaaacatcgccgccaaagtgatcaccaagcactacgcggaagaaggcgtgtggaagaactgggtgtggcacacggatgacgacctgttcatg

SEQ ID NO: 8540 - DNA, 348 bp, Zea mays
  Clone ID: LIB148-028-Q1-E1-D1
gtggtatcggtgattgatgatggcctgatcaacaaggaagaattccagctagcactatttaagaatcagaggaaagaaaatcttttcgccaatcggatatttgaccttttcgatgtcaagaaaaggggtgtcattgattttggtgactttgtccgagctctaaatgtgtttcatccaaatatcccaatggaagaaaaagtcgatttctcgttcaagctatacgatatggatggcacagggtttattgaacgaaaggaggttaagcacatgttaattgctctcctaggagaatcagaaatgaggctatctgatgagatcattgagaaaatccttgataagacattttca

SEQ ID NO: 8541 - DNA, 349 bp, Zea mays
  Clone ID: LIB148-028-Q1-E1-D10
aatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcga

SEQ ID NO: 8542 - DNA, 203 bp, Zea mays
  Clone ID: LIB148-028-Q1-E1-D11
gacctgatgatcgatggtagctgctgttcctgtcgccattgcctcctgctggcaggaacaggaactctctgaagcacggggtcagggtagttcatgttgcttcgattcgatcgtaggggagataatgccggatggctttgtaaagtttgggaggacatgcatcataattgaagtcaagtgataggatcctgttttttaagtac

SEQ ID NO: 8543 - DNA, 397 bp, Zea mays
  Clone ID: LIB148-028-Q1-E1-D12
ctctaaagggagacatagcagatcggcaaccacaacatccccagcagggtgtttacgttccgtgaactggtggacgccaccaactccttctgcccagaaaacctgctgggcgagggcggcttcgggagggtgtacaagggatgcattccagacaccatggaagtcatagcggttaagcagctcgacaaagatgggctgcaaggtaaccgtgagttcctcgtcgaggtgctgatgcttagcctgctgcaccatccaaacctagtcaccttggtcgggtacagcacagactgtgaccagaggatcctagtgtacgagtacatgtcactcggttcactgcaagaccatctcctcgatctcagtccgaaatcccagccactttcctggcacacaccgatga

SEQ ID NO: 8544 - DNA, 331 bp, Zea mays
  unsure at all n locations
  Clone ID: LIB148-028-Q1-E1-D3
acccacgcgtccgcaccaccatcgccgtcggcgacgactgcgtctccatcggccccggaagcaagaccatccgcgtgaagggcgtcaagtgcggcccgggccacggcatcagcgtcggcagcctgnggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctg

SEQ ID NO: 8545 - DNA, 314 bp, Zea mays
  Clone ID: LIB148-028-Q1-E1-D4
cacaaatgtgcgaccggcggcgcccttcaccaggtcttcgtcgggcccttcaccggcaacaagcatctaccagaaacgtggatctcatagcattggtgcctctttcctctttcaccgaagattccggtgccttatgtcacaggacgacatgaatcacatgggtcttgattcttgtatgaactcaggatttatagtggatcttggatctgttcgatgcaagacctggtctagccactaaatgatgaactcttctgctgatataatatcatttctagaagaattcctttgctggacagtatattacttatgtgcag

SEQ ID NO: 8546 - DNA, 358 bp, Zea mays
  Clone ID: LIB148-028-Q1-E1-D6
gaagggcctccgcgacccggtgctcccgatcgccgaggggcagcacgggacgcacacgtccagcaccgcggccggcgcgttcgtgcccaacgccagcgtcttcggcaacgggctcggcacggcggccggcatggccccgcgcgcgcacatcgcgttctaccaggtgtgctacgaggacaagggctgcgaccgggacgacatactggcagcggtggacgacgccatcggggacggcgtcgacatcctgtcgctgtcgcttggccacgaggatgccatcgacttctcggacgaccccgtctcgctcgccgggtacacggcgatcctcaacggcgtgttcatctgcgccgcggcgggcaac

SEQ ID NO: 8547 - DNA, 357 bp, Zea mays
  Clone ID: LIB148-028-Q1-E1-D7
cgaccaaccggatccccgtgagagtccccacccacaccccgagggcggcgtcgggtcgtcggggacagctgatttcacacgacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggcggaggttgctcgccgacgctgcgactccagcgaacaactctcttgtgctggctgcggcgaggactcaccggagcgaccccttcgccaaac

SEQ ID NO: 8548 - DNA, 327 bp, Zea mays
  Clone ID: LIB148-028-Q1-E1-D8
ggcaagggcgcaaccaataatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagga

SEQ ID NO: 8549 - DNA, 372 bp, Zea mays
  Clone ID: LIB148-028-Q1-E1-D9
ctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgaga

SEQ ID NO: 8550 - DNA, 352 bp, Zea mays
  Clone ID: LIB148-028-Q1-E1-C4
cccacgcgtccggtgaccacggcgaccgccaaggtccgagagcctgtgaagaattgccaggcaagatggataacgaccgtgccgatcgtcaacgcttgaaagcctgcgaattctcagccaagatggacaacaaccatgccgatcgtcaagtttcgaaagcctgcgaatcgaaaggcaatgcctgtgaattgccaggcaagatggataatgacgaccccgtccgtcaaggtttgaaagcccgtggactactgcaacctaagtcggatgctagtgaagatggcgtatgcgaaggtttgaaagcttgtggattgacagccaacaagatggatgctactgaccaatgcgagcacaa

SEQ ID NO: 8551 - DNA, 314 bp, Zea mays
  Clone ID: LIB148-028-Q1-E1-E1
cccacgcgtccggtcgtcatcgtcgtgggccttcatttctcctagaaggtcgagaggagaagaaggcgagacgtgcagtccgtcgggctccgatcgagaacagggaagcaagaggctgctagagatcgagctcatcaaccaatcaagtcgtacgtcgtcagcatcacgcgaccggatggcgcgcgccgcgtccagctatgtatccaggagggggctctccgcagcgatgacggtggcggaggactccgtgaagaatgtggacgacaacgctgtgaagctgggaactgtggccaaggacatcgccagcgccatgg

SEQ ID NO: 8552 - DNA, 377 bp, Zea mays
  Clone ID: LIB148-028-Q1-E1-B10
atccatccccaatccccaaaggcgaggatagaactatcatcggggaaatggctgcttccacaaacaacactctcagggtgctgttcaccctacatggttgttatgcgccgcagtatgcacagctaacatgactgtatcaaaagcaggagacttgtcgccagcccctgctccgttacgatcaggaggcgccaccgcagccccaaaaagtgcggctacagccaacaagacgttcgacatatcgaagttcggctcgaccaccgacggcaagacatgactcgacacaggcagtccaggacacgtggacgtcagcgtgcggaccgatgggagacgcaaccatgctcatccccaatggcgactacctgctgggccctctctac

SEQ ID NO: 8553 - DNA, 377 bp, Zea mays
  Clone ID: LIB148-028-Q1-E1-B11
gcgggggcttttcgaaattccgggccgcggcgggcgccgacaacgccttgattccgagcgcgacgccctctcgattccgacggcgacgggctgccctgcgccgctgcgcgccgtgccagagacgggtcgggtcagggtcagggtcagggtcaggccgtcagtcgccgccctgtactgcggccgggacgtgtgtcggggtgcgattcgtgccgcccgctcgtgctcggccccgcggttcacgccagcgattgcggtgtggcttccccaaattccagaacagcgtcgtttgctcgtttcgaatggagagatcgatctcactctcactcactgtcttcgcgcctaaacaatcgtccgtgcggccatcattcctattattt

SEQ ID NO: 8554 - DNA, 370 bp, Zea mays
  Clone ID: LIB148-028-Q1-E1-B12
tacgcgctgtcgtacaacgacgccggcgcggcggacggcgggcgacccatcgtgcacggcaccatccaggcgtacctccgcgacgcgcgggaccggctggaggccatggtgcttggcgcggagcgggagcgcgtgcggctggggctcaaggtcgtgcgcggtgcgtacctgacccgcgaggcccggctcgcgaccgcgctcggcgtgccgtcgcccgtgcacggcagcatccaggagacccacgactgctacaacggctgcgccgccttcctcctcgaccgcgtgcgccgcgggtccgcctccgtcatgctcgccacccacaacgtggagtcaggccaactcgcggcggcgcgtgcccaggagctgggga

SEQ ID NO: 8555 - DNA, 374 bp, Zea mays
  unsure at all n locations
  Clone ID: LIB148-028-Q1-E1-B2
gtcgtcgacggtgcagctcgatccgcctcgtcgagcatgtcgaggagggtcccttgcaaattcttcatgcatggagcttgcttcaaaggagattactgtgaattctcncatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcatcctccaattcttctcagctagttgcttcttccagagatccccattgcagcgaatgccaaacggatttatgtgaccaaacacagcagatttgcaagtcaacagcagcactttctgcacatcaaactgc

SEQ ID NO: 8556 - DNA, 317 bp, Zea mays
  Clone ID: LIB148-028-Q1-E1-B3
tacccacacgtctgccaacgcgtccgccctcgtctcaccctccctcgctcagacaaataataatgaacggtcccgcccttttcctccgacatccacaacgggggaggggaaaacacgtacattcatccggcggcaataatggcctcggttccggctccggcgacgacgaccgccgccgtcatcctatgcctatgcgtcgtcctctcccgtgccgcggctgaccacccgaaactccccgactacgtcatccacggccgcgtgtactgcgacacctgccgcgccgggtttgtgaacaacgtcaccgagtacatcgcggg

SEQ ID NO: 8557 - DNA, 336 bp, Zea mays
  Clone ID: LIB148-028-Q1-E1-B4
tgcaatcgcgtgcgttgctagcttgctcgatctgcctctcctctggatcccctgtcctgtccctgttaatcgcgcgcgcttgcctatttacaaggcgaaacaagcgcgcagcagtggccatgtcgtccgacgcggtggccgccagcagcaggaagggccggctgaagcagcgctacgacaacgagttccgcctcgtcgcagggtgcgtgccgtaccgggtgaacaagaaagacgacgagggcggcaacccgtgcagcagcctcggcgacgacacggcggcggaggtggaggtgctcatgatctccacgcctaaccgggccgacatggtcttcccca

SEQ ID NO: 8558 - DNA, 361 bp, Zea mays
  Clone ID: LIB148-028-Q1-E1-B5
gtgatcatgatcaacgactaccagaagagccggttcgtgaaccgcgtcgtgtcgtccatgttcaacaccgttgccggcaagaagatcgccgtcctcggcttcgccttcaagaaggacaccggcgacaccagggagaccccggccatcgatgtctgcaagggcctgctgggtgacaaggcccagatcagcatctacgacccccaggtgacggaggaccagatccagcgggacctagccatgaacaagttcgactgggaccacccgatgcacctgcagccgacgagcccgacggccgtgaagcacgtgagctgcgtgtgggacgcgtacgaggccaccaagggcgcccacgggctgtgcaacc

SEQ ID NO: 8559 - DNA, 343 bp, Zea mays
  Clone ID: LIB148-028-Q1-E1-B6
gtgctgcctgcggttcccgggccagctgaactcggacctccgcaagctggcggtgaacctgatcccgttcccgcggctgcacttcttcatggtggggttcgcgccgctgacgtcgcgcgggtcgcagcagtaccgcgcgctgacggtgccggagctgacgcagcagatgtgggatgccaagaatatgatgtgcgcggcggacccgcggcacgggcggtacctgacggcgtccgccatgttccggggcaagatgagcaccaaggaggtggacgagcagatgatcaacgtgcagaacaagaactcctcctacttcgtggagtggatccctaacaacgtcaagtcc

SEQ ID NO: 8560 - DNA, 271 bp, Zea mays
  Clone ID: LIB148-028-Q1-E1-B7
agtgctgcttgcggttcccgggcgaacgcaacgcggacctccgcaagctggcggtgaaactgatcccgttcccgcggctgcaattcttcagtggtggggttcgcgccgctgacgtcgcgcgggtcgcagcactaccgctcgctgactgtgccggagctgaggcaacagatgtgggatggcaaaaatatgatgtgcgcagctgacccgcagcacaggcggtatctgacggcgtccgccatgttccggggcatgatgagcaccaaggaagtgg

SEQ ID NO: 8561 - DNA, 353 bp, Zea mays
  Clone ID: LIB148-028-Q1-E1-B9
gggctggccgcctccgaccaccgtacgtcctccaccgcgtcgccgccggccggcctctgcccagcccgggctgcctgcgagggcttctgatggccctcgacgccgtcctttcctcctaatgcccagctttattgcagatccagccctctgatcctcgtcttctttcatctctccaacatgaaggtcaacaccaagatcaagctggagccggtcatggcgccatcgtcgtcactgccgcggagcgccagcgagctacccgacccgccgtcaccgttcagctccaacacggtgcaccaccccgtctccgtgcccaccacacctaagttgtccttatcgtgctcgtcgttcggcca

SEQ ID NO: 8562 - DNA, 381 bp, Zea mays
  Clone ID: LIB148-028-Q1-E1-C10
cccacgcgtccgggagtagcagccaaaattgttgtgatactgctcctttccaattgccttcgtctagtaagaaagtgcatggatattgcagaagcaatcggcatctggatctagcccttggcttctcatggcctagataaagactccaactttaaccaaagcttcaggagtaagctagtgaaggaatatctcaaattttttcagcacttcgactaacattctatgcgaaggaaagcatatcccagctttcatgaaacttcggaaaaccactactccgatccatctgactcgggaagaagaacagtgctctctcctccggctctcactatggatatatcatgaaaatattttcccttcattgtctcaatttgtcctttcttg

SEQ ID NO: 8563 - DNA, 387 bp, Zea mays
  Clone ID: LIB148-028-Q1-E1-C11
cacgaatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgatgcgacgggggtacagaagatcgtcatctcgccgggcaactacctgacgggcgggctggagctgaacggcccctgcaagtcctccatcatcatccgtctcgacggcaacctgctcggcaccggcgacctcagcgcg

SEQ ID NO: 8564 - DNA, 362 bp, Zea mays
  Clone ID: LIB148-028-Q1-E1-C12
aaacctgcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgcc

SEQ ID NO: 8565 - DNA, 372 bp, Zea mays
  unsure at all n locations
  Clone ID: LIB148-028-Q1-E1-C2
atgtgtactgaactcagaaggtttagcatttagggtattttagctaatgctaattcggtgaaagagtgtaacacccttcttgcagatatgaagttagtagaagggtgcaatgctctgctcctctttgttagtgaaaaccctatcagatcggggggaggggggatgtgtgctcggatcacctgtggcactgaactttttttgttgtggtgtggacattggctgccctctaaaatggaagtttgtttgcgcatcgagatgcgtcagctgatgaaagaaccaaatacaaggagcaggagtgatcttcctttttctcagatggaaactgcaaacgggaaacagtgtggtgtangaagaactctaacgaactcaaga

SEQ ID NO: 8566 - DNA, 343 bp, Zea mays
  Clone ID: LIB148-028-Q1-E1-C3
atgaagacgaaggtgacgacggtgaactgaaagaaagcataaatggttcagaggatgaagctttagaccagaatgaagacagcgaagaggaagacaagtcaaaaggcagtggctctaaagcgcagaagaggaagttaaatgattatattggacagctaagttctgctgatgcaagccttcgggttctgaagaggttagcaactgccaagaaggctgaagttccatctgatgaaactggtaaaattctatccgatgaagatttcaaacgcatcaaagaactcaaggcaaagaaagaggcgaagctggctttggctcagcatggactaatcaagggtgtcgacac

SEQ ID NO: 8567 - DNA, 388 bp, Zea mays
  unsure at all n locations
  Clone ID: LIB148-028-Q1-E1-A9
gatacacgactccaggatgagtcataggacatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcanggcccagccgtgtggagcaaga

SEQ ID NO: 8568 - DNA, 399 bp, Zea mays
  Clone ID: LIB148-053-Q1-E1-A4
acacgctgcaacggcaggtgcagcactacgaatcccggctctcggaatgcgaggtcaggatgaaatctgtggagaggcagatcacttcgttacagatggctcacagtcacagccagaccgctggcgtaagcgtaaggagagatggatcgacgaggcacatccagggatcatctcgtggaggccttccgccgtcgtctcagccatcgtcagtgaggcgccagcagcgcggttccgagcccgccgctgccgacgagagcgagaagacgacactggcggagccggtagtgaaccagctggccagggagttccagacggggagggaggcgttcgagcacaacgcgcgcgcggtggcggaggccagcaggctgccgacgtcgtcgtccactcctggcaacgcca

SEQ ID NO: 8569 - DNA, 376 bp, Zea mays
  Clone ID: LIB148-053-Q1-E1-A5
tcttgggtctcccaatagtccgtaatcctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcat

SEQ ID NO: 8570 - DNA, 344 bp, Zea mays
  Clone ID: LIB148-053-Q1-E1-A6
agttctcgaagctgatattgttattgttggcgtcggcggcaggccattgacgcgtctcttcataggccaagctgctgacgagaaaggtggactcaagaccgatgcattcttcgaaacaagtgtagccggggtatacgcgatcggcgacgtggccaccttccctctgaagctctacaacgagcagaggagagttgagcacgtggaccacgcccggaagtccgccgagcaggccgtgagggcaatcaaggccaaggagtccggcgaatcggtggccgaatacgactacctgccctacttctactcccggtcgttcgacttggcgtggcagttctacggcgacaacg

SEQ ID NO: 8571 - DNA, 364 bp, Zea mays
  Clone ID: LIB148-053-Q1-E1-A7
acgccccgtcgccatgggcaactgctgcccgggctccggggatgcgagcccgccccgctgcctccgccgatgctcctccacctcaaccccggcaccttgttcctcaaggccggcgcctcggcaggctcggcgccaattcccaaaaagcggcccgcgccaaccggcccggtcctggaacggcctatgaaggacttgcgcagcatctacactgtcggcaaggagctcgggcgtggccatttcggcgtcaccagcctgtgcacacacagggctaccggagagcgcttcgcgtgcaacactattgccaaccggaagctctccaccaaggaggacgtggaggacgtgcggcgcgaggttcagatcatgt

SEQ ID NO: 8572 - DNA, 423 bp, Zea mays
  Clone ID: LIB148-053-Q1-E1-A8
gtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttcctttggtttgtttttttccct

SEQ ID NO: 8573 - DNA, 386 bp, Zea mays
  Clone ID: LIB148-053-Q1-E1-A9
agtgactcgtattaacgcgtgggcgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggataaatgaattgccaagtccggcaagcctctgtggtacaacgggtcgacgttccaca

SEQ ID NO: 8574 - DNA, 287 bp, Zea mays
  Clone ID: LIB148-053-Q1-E1-B10
atcaagcgtcgatgcagatggcggcaggacgcgctgatcaagagcaagttcggcgtcacgcgcgggctgtccatcgagttcatcgccgtcatgtacgggctgttcggcgtcatgggctacgtcgcgttcggcgacgccactcgggagatcatcaccaccagcctcagagccgggtcggtgtcggccgccgtgcagctggggctctgcatcatcctcttcttcaccatgccggtgatgatgaaccccgtgtaggaggtcgccgagcgcctgctccagaggaagcggta

SEQ ID NO: 8575 - DNA, 409 bp, Zea mays
  unsure at all n locations
  Clone ID: LIB148-053-Q1-E1-B2
ggccttcatttctcctagaaggtanaaggtcgagaggagaagaaggcgagacgtgcagtccgtcgggcaccgatcgagaacagggaagcaagaggctgctagagatcgagctcatcaaccaaccaagtcgtacgtcgtcagcatcacgaccggatggcgcgtgccgcgtccagctatgtatccaggagggggctctccgcagcgatgacggtggccgaggagtccgtgaagaaggtggaggacaaagcngtgaagctgggaactgtggccaaggacatcgccagcgccatggccaccacgacggaggagaagacggcgttctgggaacctgaccccgagaccggatactaccgttccggtcacggcacgaaggaggtggacgccgccgaactgcgcgccgagatgctca

SEQ ID NO: 8576 - DNA, 123 bp, Zea mays
  Clone ID: LIB148-053-Q1-E1-B3
atcagccatgcgcaccagatgggcttcaacgtcaatgatgatgacaggcgtgtacctcgtgatccgcatcgacatcgggcatcggctcagcgtaggctccaacgtgttcccctccaacacgct

SEQ ID NO: 8577 - DNA, 399 bp, Zea mays
  Clone ID: LIB148-053-Q1-E1-B4
ggaaagctctcttcctcctcctcctccctctcgaaattccgtctccttgtcccctgtcctcctcccccggtttccccggtttttagagggaaagaggaggcggagagagggatgggaaggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctc

SEQ ID NO: 8578 - DNA, 361 bp, Zea mays
  Clone ID: LIB148-053-Q1-E1-B5
cccacgcgtccgcctgaaaccagcgtgctgtgccgcccgggacgatggcgccgcgccagccgctgctccccagtttcctctacgcggcgtcgtccggcgtcaacggcagcagggaggcgcctccggtggtggcgggcgccccgagcgagccgctcggcaagatcgagatgttctcggccgcatactacgcagcgggcgccttgggaggcgccgcgggctgcgggttcacgccagccgccgtcaagccgctcgacgtcatcaagtgcaatagccagatcgacgccgccaagtacaaggagacctcgtcggcgttcaacgtggtgattacggagcacgggctccggggcctctacagggggtg

SEQ ID NO: 8579 - DNA, 352 bp, Zea mays
  Clone ID: LIB148-053-Q1-E1-B6
cccacgcgtccggtcaactggagcataacctttatgtgcctggctcaaatacaattgagccactgtctatctttgttaaaaattacattgaccttatctcggccaagtacccatattggaataggacaaaaggagctgatcatttctttgttgcttgccatgactgggggccttacacaacaaaattgcatgatgaattgcggaagaacactattaaagctctctgcaatgcagatctctctgaaggattttttatccgtggaaaagatgtttcccttccagaaacattccttaggtcaccaagaagacctctaagagatattggaggaagaccagctgcgcagaggactat

SEQ ID NO: 8580 - DNA, 367 bp, Zea mays
  Clone ID: LIB148-053-Q1-E1-B7
gggtcgaccaacgtccaacacacttctggtcaactggagcataacctttatgtgcctacctcaaatccaatttaaggcattgtcaacctttttaacaaataaattgaccttatccccggcaagtacccatattggaataggacaaaaggagctgatcatttctttgttgcttgccattactgggggccttacacaacaaaattgcatgatgaattgcggaagaacactattaaagctctctgcaatgcagatctctctgaaggattttttatccgtggaaaagatgtttcccttccagaaacattccttaggtcaccaatacgacctctaacagatattggaggaatagcacctgcgcagaagacta

SEQ ID NO: 8581 - DNA, 367 bp, Zea mays
  Clone ID: LIB148-053-Q1-E1-B8
cccacgcgtccgcccacgcgtccgcccacgcgtccgcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatg

SEQ ID NO: 8582 - DNA, 352 bp, Zea mays
  unsure at all n locations
  Clone ID: LIB148-053-Q1-E1-C1
attcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtangggaggcangggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacg

SEQ ID NO: 8583 - DNA, 420 bp, Zea mays
  Clone ID: LIB148-053-Q1-E1-C10
cccacgcgtccgcccacgcgtccggtggggccatctgagggacctgcacctggcgctgaagctgtgcaagaaggccctgctctgggggaagacatcgacggagaagctgggcaagcagttcgaggcgagggtgttcgagatcccggagcagaaggtgtgcgtggcgttcctctccaaccacaacaccaaggacgacgtgacgctgacgttccggggccagtcctacttcgtgccgcgccactccatcagcatcctcgccgactgcaagaccgtcgtcttcggcacccagcacgtgaacgcgcagcacaaccagaggacgttccacttcgcggaccagacgacgcagaacaacgtgtggcagatgttcgacgaggagaaagtgcccaagtacaagcagtccaagatcaggctgcgcaaggc

SEQ ID NO: 8584 - DNA, 353 bp, Zea mays
  unsure at all n locations
  Clone ID: LIB148-053-Q1-E1-A2
gcttgcacctcgatccatcaattgcaagaggagcatgataccaccaccgtagcaccacacgcacgtacgaagaaggcgacgaacatggcgaggctgggcttggtancggccgtggttctgtgcctcctgttagcgacagggccgcatggggccatcagcgccgaggggatggtgtcatttgacaatttgatcagctgcaaggtactgggcaactgcgacaagaacctgagccccgaggcctcccgcccaaggaaaaccgccaacgactacacccgcggctgcaacccgattaccggctgtcgcggctgatcatatctctctggtcgatgtgcgcgcaatgtcaatgtcgcacg

SEQ ID NO: 8585 - DNA, 402 bp, Zea mays
  Clone ID: LIB148-052-Q1-E1-G8
ccgacgcgtccgagcggttcggcttcaacggcgtgtcgcacgtcgaccgcgagacccccgtcaagctcgccgagtacttcaacagcaccgacggggtgttccagtacgacatcatcggcgacgtgccgccctccatgtccgcgcccaccaagatggcccccaacgtcatccgcgccgagttccgcaccttcatcgaggtggtcttcgagaaccccgagaagagcatcgacaccatccacatcgacggctacgccttcttcgccgtcggcatgggcccgggcaaatggacgccagcgtcgcggagcacgtacaacctcctggacacggtgagccggcacacgatccaggtgtaccctatgtcgtggacggcggtgatgatgacgttcgacaacgcgggcatgt

SEQ ID NO: 8586 - DNA, 428 bp, Zea mays
  unsure at all n locations
  Clone ID: LIB148-052-Q1-E1-G9
aagaagcccattgctgcgcgctttcatccttccgctccaaacaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattctgttcttgagacactgaatttctttctaacagatctcagggcatccccagagtatcttaccctccttgtgcgcaactgtcaacgattgaaaactctgaagattagtgaatgtttcatgcncgatctggtcagtttgttccgaactgcacaaacactacaagagttcgc

SEQ ID NO: 8587 - DNA, 425 bp, Zea mays
  Clone ID: LIB148-052-Q1-E1-H1
gttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaagggacaatggtgcaagccacgc

SEQ ID NO: 8588 - DNA, 61 bp, Zea mays
  Clone ID: LIB148-052-Q1-E1-H10
ggccgacccaatcctccacaactcgttgctggagtagtgatcccggccgatcaccattcca

SEQ ID NO: 8589 - DNA, 417 bp, Zea mays
  unsure at all n locations
  Clone ID: LIB148-052-Q1-E1-H12
acaggccgccttcaaacggtagatctagccgatgtcgtcgtcgatgggacacgagagtagcggtggcggcgccgacgaagaggaccccgccggcctccagcgggtcatttggttgcggcagatgctccaccgctggcagtcctccagctccaggattgccgccgagaggaggtccagcgccagcgacgacggcgacagagccaacccagacgacgccaacgccacgacagaccaaagcagcaacggcgaccccacgcctgccgctgcagacaatgccagcagcagcagcagcagcaggaaccagatgctgccggcggcgccgcatggtgcggcggacgaagaggacgangacgangaccggcggctcctgtcgcgggtgctgctggtggangagcgcaggcnggggtgcccccccga

SEQ ID NO: 8590 - DNA, 378 bp, Zea mays
  Clone ID: LIB148-052-Q1-E1-H2
acccacacacaaagaaagcaaaagcatcatcacaataatggcccgcgcgtgcgtgttcctcgtggtgctcctcctggccgccgtcgcggtggcgccgtttgcgggggctgcgcgtgtggacgtcgtggagggcaggtccatggcgtccgccgacgcgcctgaagcggcggctgacgcgcccgctcccggtcccgactccgcctcatccccggactcctcgtcggaggcgccctccagcagcagctcatccgactagccgcgcacaacgcagttcttgtcatgatctatctatcacataaaaagatcatatgtctcgtttgattctctggaataactaatagtatatatgctgcgcccggatgatatataaatatgtgc

SEQ ID NO: 8591 - DNA, 428 bp, Zea mays
  unsure at all n locations
  Clone ID: LIB148-052-Q1-E1-H3
ctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcncgccgggcaactacctgacgggcgggctggagctgaagggcccctgcaagtcctccatcatcatccgtctcgacggcaacctgctcggcaccggcgacctcagcgcgtaccagaggaactggatccagatcgagaacgtcgagaacctgtccatc

SEQ ID NO: 8592 - DNA, 402 bp, Zea mays
  Clone ID: LIB148-052-Q1-E1-H5
cttctttcttcctcctcctcgtcctctcgaattccgtctcttgtctctgtcctcctcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactcgaaatcctcactggccatcttgagaactatactaccgactacaccctacaggtgttggtacgctactgcgccgtgtacatcttcatgcagaccttcatgatcccaggaacgatattcatgtcactgcttgctggtgccctgtttg

SEQ ID NO: 8593 - DNA, 417 bp, Zea mays
  Clone ID: LIB148-052-Q1-E1-H6
acggacgcgtgggctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacccggtcgcggtccctg

SEQ ID NO: 8594 - DNA, 235 bp, Zea mays
  Clone ID: LIB148-052-Q1-E1-H7
cgacggcgtccagcggtggccggaggagtcctgtgttcttcgtttccttaggtgtacttatgtgggttttggggtggcaagagagtttttttttgtgaactctggtgtatcggatcaagtgaatatgtacctacatgttgtgttcttaattctgcattgtacagctatacactatacaagggtacgggaatgctgaggtgtaacttccatgcaatatacttagttctattcatct

SEQ ID NO: 8595 - DNA, 281 bp, Zea mays
  Clone ID: LIB148-052-Q1-E1-H8
ggaggaccgatcactgcatacacgagtggaaaatgctactgctgttcagtttaagttcgcgttgtacttgtatgtatagtggctgctacttatgtgagttttgtacctgtactgtacatgaagtctcttttcttttatataccatggctaagggggtgttgactaagggcctgtttgtttacctcccagattatataatctggattaaataatcctaagaggcaaacaaacagtctagcttatttgcccagattatataatctaaccccttggattatgat

SEQ ID NO: 8596 - DNA, 414 bp, Zea mays
  Clone ID: LIB148-052-Q1-E1-H9
cgcgcgatcgcccgccgcagcagcaatgcctccacctccgccgccggccgcccgcatcagggggcggtgcagcgcgctcagcttcgcggcggcgcgggaccgctgcttcagccaccgcttccgcagggcggggctgcgcccgctcgccgtgccgctccctggcccgggcccaggccccgacgccgacccggccaccaccgtccacatgtgggtgcccgcgggcccgccgccgcggaacccgctgctcctcctgcacggcttcggcgcctccgccacgtggcagtgggcgccctacctccgcccgctgatcgccgccggcttcgaccccatcgtgcccgacctcctcttcttcggcgcctcctgcacgcgcctccccgatcgctccgacgccttccaggcctccgccatcaaggc

SEQ ID NO: 8597 - DNA, 424 bp, Zea mays
  Clone ID: LIB148-053-Q1-E1-A10
accggataaacgatcatcctgttccagaggaagagataaagatgttgttacaagcgggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggatggtcgcatcagttacccagagtttgaattgatgatgaaaagtggatcggactggaggaacgcctctagacgttactcaacagagaatttcagcagcctcagtcaaaaactgtgcaaagatactttatgaaacaa

SEQ ID NO: 8598 - DNA, 448 bp, Zea mays
  Clone ID: LIB148-053-Q1-E1-A11
actcgcgggccgatacaagcctctacacagacgtcgtagcagcgcaagctcatggccgacgccgcggctgaggccacgtacaagcatgacccggtcgaggtcgccaaccaacttaaccgtgcagtccacagatccgtcgagaaggaggacattggcacgaggcgggagatgatggggacgacgacgaggaagtctaagttcagcgggccgtgcagggcgacgaacccgatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgacgtggtgaacccgcgccccggcacgctccggtggggcgtcatccagatcgagccgctgtggatcaccttcgccaagaaca

SEQ ID NO: 8599 - DNA, 412 bp, Zea mays
  Clone ID: LIB148-052-Q1-E1-G7
ccgcccgcccgcccctcccctctctctgtctcgccgcccggggagaaggagggctccgccgctcccggggaagagcgcgccattgccgccgccgcgctgactggggaagatggttgtccaggagttcacagttgatctcaacaagccccttgttttccaggttggccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcataccgttcaggacgtagctatgatggctcggtttgggatatttatttgggcgctgatcgaatacactttg

SEQ ID NO: 8600 - DNA, 426 bp, Zea mays
  Clone ID: LIB148-053-Q1-E1-A12
aagccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacgaccagcagtccgcggacagcggcgggtgg

SEQ ID NO: 8601 - DNA, 364 bp, Zea mays
  Clone ID: LIB148-052-Q1-E1-F2
gctccacgtccttcggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcg

SEQ ID NO: 8602 - DNA, 392 bp, Zea mays
  Clone ID: LIB148-052-Q1-E1-F3
ctcctcttacattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacat

SEQ ID NO: 8603 - DNA, 412 bp, Zea mays
  unsure at all n locations
  Clone ID: LIB148-052-Q1-E1-F4
gctggttcccatcgaccatggatactgtctgccggagagcttcgaggactgcactttcgagtggctctactggcctcagtgccgggagcccttcagcgacgagacggtggagtacgtgcggtccctggacgcggaggaggacgtgactatgctgaggctccacgggtgggaggtgtcgcgcgagtgcgcgcgcacgctgcgcgtcgccaccatgctgctgaagaagggtgtggagaggggcctcaccgccttccacatcgggagcatcatgtgcagagagaccctgaccaaggagtccgccatcgaagagatcgtccgtgaggcggcggaacggggaggaggatgcgagactgtcttcttgcaggctgtctcngagatcatggaccgccgtctcgacgacatcaaagaacat

SEQ ID NO: 8604 - DNA, 426 bp, Zea mays
  Clone ID: LIB148-052-Q1-E1-F5
cccgtttcggtgttatccattaatcatggccagaccgccagacggggcgcccgctggacctgatgacacgtcgccgccgccttcttccaactcgtcgactccgcctccttccgactcatcgacgccgccacccaattcctccggctcgggctcgccgtcgccatcgcgacccgcacagtcattgtcgccgccaccaacggcgtcgccgcaggatagcacggcgccaccggccagaggctcgccggccgcgcagtcgacggactccccgtcatcatcggctccaaagctcaacgacagtgactccgataatagtggtagcagcaggagcggaagcggaagcaggagcagatgcagaagcagcgggtcgacgcaggtggatgtcatcctgcccggcgtggtgattggggtcctggcctttagcctgct

SEQ ID NO: 8605 - DNA, 426 bp, Zea mays
  Clone ID: LIB148-052-Q1-E1-F6
cgaccaaccaccccgcgctcccgccccacgcacgccctcgcgctcaccggcgccccgcccctcccccacgctggccgcacccgcaatggggtgcgcggcgtcggccgccaacggggccgggccccggcggcgggggtgggcgcgggcgcggatgcggcggtacagcgaggcgtccacctcgggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggccgacgccgacgccgccgacgccgatgactccgtcagggtcagagcgac

SEQ ID NO: 8606 - DNA, 426 bp, Zea mays
  Clone ID: LIB148-052-Q1-E1-F7
agcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgc

SEQ ID NO: 8607 - DNA, 368 bp, Zea mays
  unsure at all n locations
  Clone ID: LIB148-052-Q1-E1-F8
caatccttcctcttgcacgcggagtcctcaagcgggcctcctcctcggccttggctcaaattccgggtgccataacacgacctccgccggcggccaccggcagccatgtcgcccttctacctcgctcgcggtgcttccaagctagtgagaaggattacctcggagacatcggtcgagctcaagattctatctgataaatggcggcttctcctcgctggcctcattttccagtacatacatggtttggccgctcatggggttcattatctgcaccggccgggccctacccttcaagatcttggcttcatgattcttccggagcttgggaaagaanagggttacatcagtgagacattgtttacattcgt

SEQ ID NO: 8608 - DNA, 424 bp, Zea mays
  Clone ID: LIB148-052-Q1-E1-F9
gccccttcgcgttgcgcgtgcgtatggcgctgagcctcaagggcctgagctacgagtacatcgagcaggacctgttccacaagggcgagctcctcctcagctcaaaccccgtgcacaagaaggtgcccgtgctcatccaccacggcaagcccatctgcgagtccctcgccgtcgtggagtacgtcgatgaggtctggcccggcgccgccaccaccatcctccccgccgacccccacggtcgcgccaccgctcgcttctgggccgcctacatcgacggcaagctgtttccggcgtggacagggatcatgaaggcggcgacggaggaagcgaaggcggataagctgagggagacgcacgccgcggtcctcaacctggagaaggcctcgcccagatcagctctagctccagcaacgacggcgcggcc

SEQ ID NO: 8609 - DNA, 175 bp, Zea mays
  Clone ID: LIB148-052-Q1-E1-G1
gcccaggcccggtccaggtccaagcgacggcgcgtccaaggtcacggagattcaggtcaccgtcgccttcagccacttcggcaacgggctggtgcagcgggtgccgcgctggcgtcacgggttcttccaggtggtgagtaacgactacacacacgggctcaggtacgcgatcggg

SEQ ID NO: 8610 - DNA, 366 bp, Zea mays
  Clone ID: LIB148-052-Q1-E1-G11
cccacgcgtccgaaagcaaagaggatcggatcagaagaaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtaaatccgacctgcaggaggaggcaacagctaccgtaataaccaaag

SEQ ID NO: 8611 - DNA, 430 bp, Zea mays
  Clone ID: LIB148-052-Q1-E1-G12
cgctgccttcaccgctgtaatccgcagggatggcggagatgaagctagacaatgcaataaaatcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcggggacaccttcgacgagcgaccagacctcaactcacccatacccggtgcgcagcgccacgtcaaccgcctcatcagcaactgccttgacctagcagccaccattaaggaacaaccctagatgcctatgatgtggacactaaaaaaatttatctacaactggctgaagaagaacagtcccacaacctacttcaaatt

SEQ ID NO: 8612 - DNA, 401 bp, Zea mays
  Clone ID: LIB148-052-Q1-E1-G3
aaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatc

SEQ ID NO: 8613 - DNA, 376 bp, Zea mays
  Clone ID: LIB148-052-Q1-E1-G4
acgacggcgtgctgtcgctggggaacggcgacatgtccttcgccgtccacgccgccaagcgcttcgggcagcgcttctccttctgcctgctcagcgccaacagctcccgcgacgcctccagctacctcaccttcgggcccaacccggcggtgatgggtccgggcaccatggagacggacatcctgtacaacgtggacgtgaagcctgcatacggggccaaggtgacgggcgtcttggtgggcggggagcggctggacatcccggacgacgtgtgggacgccgagaggtttgtgggcggcggtgtcatcctagacacgagcacgtctgtgacgtcgctggtgccggaagcgtacgcgccggtgactggcgcgctgga

SEQ ID NO: 8614 - DNA, 394 bp, Zea mays
  Clone ID: LIB148-052-Q1-E1-G5
atataacttgtcaatccatttcttaactcttctcttttaaacaacagcgaagtctcactctagctatatatggagatgaagaagatggagaaggaggatgacaccatcattgttggcgccagcatcactgtcgtaatagggtagtggtagcaaatagatatcacggtccaatgcatgcatgtgtaatgcattgcttgggatccaacccaatctagtatagctagcataggtcggcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcggtttgtcgctgtccttcct

SEQ ID NO: 8615 - DNA, 211 bp, Zea mays
  Clone ID: LIB148-052-Q1-E1-G6
acgcactcttctgttttcttctacgataggattacgtcgacttcgcaagacgtctcgttggtccatccatcgactctgaggctgccaacggctggacatgcatgagctggacagcgaggatcacattagggttgttgccgccagtaatagcgccggacacgattgctactgcccacttgaaggcaggggacatgtcaggtgtattttctgc

SEQ ID NO: 8616 - DNA, 409 bp, Zea mays
  Clone ID: LIB148-052-Q1-E1-F12
acaaaaatgtcgcgcgtcaaagctgcggtgctccttctaaatcctcgccgttgctgcccccaccgcggccaaggccccggcaaattcaccgaaggaaggcattgctgcaaaggcacctgagtctgccaaaaaaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgaaggaccggctgctgatgactccgccggtgctgctgcccttggaagtggagctgccatcgccggcgttgccgctgctgttgctaacatg

SEQ ID NO: 8617 - DNA, 420 bp, Zea mays
  Clone ID: LIB148-027-Q1-E1-H3
gaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggtgactgtcatgtatattctgatgactgtc

SEQ ID NO: 8618 - DNA, 426 bp, Zea mays
  Clone ID: LIB148-027-Q1-E1-H4
acagtattcttcactcatgagtcagggcatcagcaagttaacttcctgaattactagataatatggaatcgaatcaaaccaagtactagctcccttgttccatcctctgcatggctccgatctagtaaatagcatataacccccatagaagaaaagaaataagtaagctcagacagtgactggaccgcacagaatcatatttcatcagctcttttttcttgaaattttattggttatttacctatttgctatcatatattcataatccctatcccctagccttttatttcatttttcttgttacagtggtcatgtgccccatgcacatattctttgaaatgcactacatgtcttttcccatgcacaaggataaatagtctatttcctttcggagtgtaagattcatcatgaaaagcacttctcata

SEQ ID NO: 8619 - DNA, 363 bp, Zea mays
  Clone ID: LIB148-027-Q1-E1-H5
gcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatg

SEQ ID NO: 8620 - DNA, 430 bp, Zea mays
  Clone ID: LIB148-027-Q1-E1-H6
atacaagactctaccatgagtcatctcaagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactccgacccggtggcgctcggccactaca

SEQ ID NO: 8621 - DNA, 415 bp, Zea mays
  Clone ID: LIB148-027-Q1-E1-H7
tacaagactctaaaatgagtcgtattaactagaacacaaactgaacagagtggtgagtcctacgtacgtacgtgtaacaactagcaccggtcgatcgatacaatattcttcaacctgacacgtggggtctgcactaccggcgacggacgagggtgagctcgtcatattctcaaatttccaatatttaatatacgtgtgtgcgataatgtatttatttgtaatttcgcgattgtgtaatacttgggggatttgctatgtttcggtcgcctctaaaatacactatatttttagacaacgatctttatcgttaattagttcatgagcatgtaaagctaagattcattttaacgcaggaaaaaaaaacaagaacgaatggatacattgtctcttaaaaaaaaaaaaaaagggccgccgc

SEQ ID NO: 8622 - DNA, 405 bp, Zea mays
  Clone ID: LIB148-027-Q1-E1-H8
atgcaacgacgcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatataga

SEQ ID NO: 8623 - DNA, 360 bp, Zea mays
  Clone ID: LIB148-028-Q1-E1-A1
aaagaaacaggcacacaagaacaaatacctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctg

SEQ ID NO: 8624 - DNA, 338 bp, Zea mays
  Clone ID: LIB148-028-Q1-E1-A10
ctcaagctggctggatgacagcatggccccacaacgctacgggcagggcagacaatccgcatcgatccccaccgcaaattgcccctatctatccctccctacaaatcgaaacaaagaaagataaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcg

SEQ ID NO: 8625 - DNA, 380 bp, Zea mays
  Clone ID: LIB148-028-Q1-E1-A11
cccacacgtccggaggactcagccaaccccatcttcatcgacatgaagtactgccccaacaagttgtgtactgccaacggcgcctccaaggtcaccgtcaaggatgtcaccttcaagaacatcaccggcacctcctccaccccgggggccgttagcctgctctgcactgccaatgtgccatgcaccggggtcaccatggatgacatcaacgtctagtatagcggcaccaacaacaagaccatggctatatgcacgaacgccaaaggcagcaccaaaggttgcctcaaagagcttgcatgcttctagaccctccatcgactgagacatctctctacttataaattttctcccgtccttgcagtgcccactagatgctatcc

SEQ ID NO: 8626 - DNA, 378 bp, Zea mays
  Clone ID: LIB148-028-Q1-E1-A12
cccacgcgtccgcaatctgccatcctctccatcacgaagatggcgttcatcagcaatgtcgcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggc

SEQ ID NO: 8627 - DNA, 352 bp, Zea mays
  Clone ID: LIB148-028-Q1-E1-A2
gaacgtcgtacgagaacctttctccctcctccacctttctccttttcttgccacggcaaaacaccttcgccggcgagagcatggcgatggcgtaccgtgtcctggaggtcaccctggtgtcagcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcga

SEQ ID NO: 8628 - DNA, 364 bp, Zea mays
  Clone ID: LIB148-028-Q1-E1-A4
actccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccaca

SEQ ID NO: 8629 - DNA, 358 bp, Zea mays
  Clone ID: LIB148-028-Q1-E1-A5
gccgccctatttttttttttttgttttttttgttttggtgctattgatctctacgactgcgacagcgactgctacgacagttcagtcgcggcaggcggggctcacctctcgccaaacaggctctggattccgggcgtggcggagggatttgctgaggccggacaggacggccggcgaagcttgggcgccgccggcgcccaaggccaacaggaacgtcccaagacggcgcttcggtcgtcgttgactcacccagatgcagtcgcacccgcccaatcgccatcgtgtcatgacagatcgatcagaagatagctagcagttcccatctcactggtgtgtgttaatttagcttccgttaacg

SEQ ID NO: 8630 - DNA, 339 bp, Zea mays
  Clone ID: LIB148-028-Q1-E1-A6
gggatcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctccaacctgcagctgc

SEQ ID NO: 8631 - DNA, 326 bp, Zea mays
  Clone ID: LIB148-028-Q1-E1-A7
cccacgcgtccgcccacgcgtccgcccacgcgtccggcggcggcggaggggcagtgggtgctcatggcaacggggcggacgccgaccaacattgcggtgatcaagtactgggggaagcgggacgaggcgctcatcctccccatcaacgacagcatcagcgtaacgctcgacgccgaccatctctccgccaccaccactgtcgccgtcagcccctcattcccttccgaccgcatgtggctcaatggcaaggagatctcgctattacgaggaaggtttcagagctgcctcagagaaatcagaaagcgtgctcgtgactttgacgacaa

SEQ ID NO: 8632 - DNA, 317 bp, Zea mays
  Clone ID: LIB148-028-Q1-E1-A8
cccacgcgtctgaaaaaaaatgaaaaaaaaagataagaaaaaaaaaaaagaataataattgatatatgataaaaaaagatataagctctaacttaaataaatatataatgctaaaagaggaaatcaagatgtacaatacataaaggataaaagggggggccgtcttaacggttttggccttttattgctttgagcgcctcatagaagtttttgcattggatcatcaaggtgtagtttatgtggattgttttttacatcttcattctgggaaaaccttggttttatgcagttttaggcgtttttgtcaaacgcccttt

SEQ ID NO: 8633 - DNA, 423 bp, Zea mays
  Clone ID: LIB148-027-Q1-E1-H2
agccgagttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccg

SEQ ID NO: 8634 - DNA, 366 bp, Zea mays
  Clone ID: LIB148-027-Q1-E1-F5
ggggcggtaggccgccgtgcccgttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgattgcg

SEQ ID NO: 8635 - DNA, 417 bp, Zea mays
  Clone ID: LIB148-027-Q1-E1-F6
taccccacgcctcaccattccttcctcttccacggacacgggaggagaagggttgatcacgaccggggaggacgcgtggccagagatgggtctccacggaggcgtcgtcgtgctccgcgcggccgtgctcgccgccgtcctcggcttcgtcgccgctgccgggttcatctcaaacgacgcgctgctggagcgcgggcacgacaccaccggccggagcctgctgcaggccaagaaagattgcccggtgagcttcgagggcgccaactacacggtgatcacgagccggtgtaagggcccgctgtaccagccgacgctgtgctgcggcgcgctcaaagacttcgcgtgcccttactccacctacatcaacgacgtgagcaccaactgcgccgccacatgttcagctacatcaacctctac

SEQ ID NO: 8636 - DNA, 376 bp, Zea mays
  Clone ID: LIB148-027-Q1-E1-F7
gttcaggtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatggccccgccggcgcctccgagggccctgcg

SEQ ID NO: 8637 - DNA, 379 bp, Zea mays
  Clone ID: LIB148-027-Q1-E1-F9
gaggcacgcgtccacccacaacgtccgacaggctgaaaggtacacgctgcatcagcaggctgcctatgcctgcgcaaaccgtacagccgcgtctgatgttgctctggacatgagagcacccccttttcagcatctatcggcagggcagagaagtgactcttgtgataggctgacagcagagacaaacttgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgatgggtctatgctgccttcaggtggctaaacaccgacaac

SEQ ID NO: 8638 - DNA, 366 bp, Zea mays
  Clone ID: LIB148-027-Q1-E1-G1
ctcgtgggccgatacaagcctctaggatgactcgtgctagtcgctgacgttccgggtgatgaccagcgaccaccgcaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctcatgcattccgatatggtgccggagttaaaaaaatgtaaatcaatgtgcaaactcaaatgacatcttaaccagttgtgatcaatctcaaccgctaatgcattgcacacaccgaatgaag

SEQ ID NO: 8639 - DNA, 330 bp, Zea mays
  Clone ID: LIB148-027-Q1-E1-G10
ctagtctgactcatattatccactgcttccagaggcttcctctcgagtccgcagtctctcttccctacgaagttcagaagttgtcacaatgactcatatccttggccacacattgtttttttttctgttcctgttgttctatcgattcttgtaagggcgggttttgcagttcgttgctcttttatgtcatggtggactcgttgttttttatgttttctgttggaacggcgtgtttcggatgatggttccgtttcgtccttgacctgggctgggctgcacgcggcgaccagagggaacgcgaccggcagagggcgcaagcgcggcggcccg

SEQ ID NO: 8640 - DNA, 342 bp, Zea mays
  Clone ID: LIB148-027-Q1-E1-G11
agctcgacgtccttcagtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatat

SEQ ID NO: 8641 - DNA, 372 bp, Zea mays
  Clone ID: LIB148-027-Q1-E1-G12
ggtcgagacacgcctctacagtcactcggggcacatgcctttgatttatgcaaaactgtatatgtatcagatctgtagagccttggcatacattcacaacagcattggagtgtgccacagggacattaagcctcaaaatctcctggttaatcctcatacccatcagctaaaactgtgtgactttggcagcgcgaaagttctggtaaaaggcgaaccaaacatttcttacatctgttctagatactacagagctccagagctcatatttggtgctactgaatacacaacagccattgatgtttggtctgctggctgtgtgctcgctgagctgcttctaggacagcctctgttccctggagaaagcggtgttga

SEQ ID NO: 8642 - DNA, 380 bp, Zea mays
  Clone ID: LIB148-027-Q1-E1-G2
aggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtga

SEQ ID NO: 8643 - DNA, 373 bp, Zea mays
  Clone ID: LIB148-027-Q1-E1-G4
gcccacgcgtccacctagccttcccctgctcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcatcagcagcccgacgacgccggctgcggcagcagcgacgaccactaccagcacgacgtgatcatgctgaggcggacgatgagcgggcgggcgttcccgccgccgatctccgtgatgtgcaagggcgggcgggcgtggctctgcctgctggcgcaccgcgagggtggacgcctcgtgctgcggcagatgcgcctgccgtcgc

SEQ ID NO: 8644 - DNA, 397 bp, Zea mays
  Clone ID: LIB148-027-Q1-E1-G5
aggagtcgcagggcgtgcccaccaagcaggcggaggcgatcacctccgccatcacggaggtcctcaacgacagcctcgagagcatctccgagtccttcgtctccaaggccgagatgcagaagagtgagatgctgcaggagtccaatatctccaagttcaagtcccaagtgcagagctcgcaggaaaaccatttctctttactacagcgggagactgagaaacttcgcggagatattgataagatgaggagtgaactgaagtatgagatcgacaaggtcaccgcaggacagcgattggatctgaatcttgaaagagggcgcatacgtgatgagcttgccaagcagaatgaggaaaccactgagcttaccacaaagcttggcaagggaatccactcact

SEQ ID NO: 8645 - DNA, 411 bp, Zea mays
  Clone ID: LIB148-027-Q1-E1-G7
taccgctctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaagcgcagtccaagaggggtatcctgaccctcaagtaccccatcgagcacgggatcgtcagcaactgggacgacatggagaagatctggcatcacaccttctacaacgagctccgcgtggctccccaagagcacccgttctcctc

SEQ ID NO: 8646 - DNA, 293 bp, Zea mays
  Clone ID: LIB148-027-Q1-E1-H1
ctgaccacaaatcaacattaacattatggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgac

SEQ ID NO: 8647 - DNA, 345 bp, Zea mays
  unsure at all n locations
  Clone ID: LIB148-027-Q1-E1-H10
tataataagtcgtattacggcgagcagctgtacgtgagcgtcatctcgccggagcggtcgctcaaggacnagtacaacatgccggagaacagcctccgctgcggcaaggtcntcggcctgccgatgccaccgtcctaccgcgccgtctagagcgtcgatcgatcgcgcacngtgctgtacacaacttaaagagagcgagaggggaacttttcccccgtttccttctctagccagccttgtctgtccccccctcgtttaatctctctctcttttttttcgttcgcttcccaggaataatacccaaacaaaaaaaacaaagggggtcaaaaatttatcatgcatgca

SEQ ID NO: 8648 - DNA, 394 bp, Zea mays
  Clone ID: LIB148-027-Q1-E1-F4
cccctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctagggagtctggtccagctaccgcgccagccaacggctccacacccccttcttccacggacgaagagttgagcccttccccgccagcatccaacgccgcggcgtcccctgcggctgaaggaccggctgctgattactccgccggtgctgctg

SEQ ID NO: 8649 - DNA, 336 bp, Zea mays
  Clone ID: LIB148-027-Q1-E1-E1
acccacgcgtccgctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccg

SEQ ID NO: 8650 - DNA, 376 bp, Zea mays
  Clone ID: LIB148-027-Q1-E1-E10
acgatcactgtggtcctgtttagcactatggtgtttgggatgatgacgaagccattgatccggctgctgctccctgcctgcagcaacacggccacctccgagccgtcctcacccaagtccctgcactcgcctctcctgacgagcatgcagggctcggacatcgagacggggtcggcacagattgtgaggccgtccagcctccggatgctcctaagcaagccaacccacacggtgcactactactggcgcaagttcgacgacgcgctcatgcggcccatgtttggcggccgcgggttcgtgcccttctcccctggatcgcccactgagcagagcgtccacgacggacggtgaacaaagccgcgtctgacaccaagag

SEQ ID NO: 8651 - DNA, 402 bp, Zea mays
  Clone ID: LIB148-027-Q1-E1-E11
aagcctctagaatgaatgtgatgagtccacacacgcatgcatgcatgcatgcatgcattgcgtttgcgtctcaagagttcacttgtaaatttgtaatcgaggaagaaaagcacctctcgatcgattaacatgtctagctgctacgatcctgtgattcgacgatgttaattaatcggcagctttcattatgatgtgtagcagtatactgtatgattaattgtggatcttttcgaaaacaaaaactgtaatattcgtgaaattgtagagccttcacctattattaatctatcaagtaatcgagaaaatgtaattaatcccaaacgtgaatacatggtgcaaaaacatgaatgatggtaggaaaatgaaaacaacatttgaaaaaaaaagaaaaaaaaggggggg

SEQ ID NO: 8652 - DNA, 418 bp, Zea mays
  Clone ID: LIB148-027-Q1-E1-E2
cgggccgatccacgagtctgcccaggcgtcctgggagcacttggttttcatttacgagttcattgcaattacgagttatgttgagcgccgtagcgaacgtagccaaggccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaagcccgacgccgcggcactggtggtgacggtgaccgacct

SEQ ID NO: 8653 - DNA, 423 bp, Zea mays
  unsure at all n locations
  Clone ID: LIB148-027-Q1-E1-E3
tcgcgggccgatacaagcctctagactacgtcgtcatattcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccggcggccgcngcctcatccggtccctctagcgcaccagcgccatcgtcgtcgtctgagtcctccgccgcaccaggcccatcttctgatggcacctccaacggcccaacaacatcgtccggcgacgattccg

SEQ ID NO: 8654 - DNA, 437 bp, Zea mays
  Clone ID: LIB148-027-Q1-E1-E4
ctcgcgggccgacccacgcgtccacgatgattcaatcaacgccaccaccggtgccggtgaggtcacctccatcgtcagtgaaatcaccacctccttcaccactgttaagttcgccgccgccaccagcgccggtgaggtcacctccaccgctaacgaaatcatcacctcctccaccaccgataaggtcgccacccccaccacaagcaaactcacctcctccatcagctctaataagctcacctcctcctccgatgcaatcccctccaccgcctgctccagtcagctcaccaccaccacctataaaatcaccaccaccggctccagtaagctcaccacctcctctggcgcaatcccctccaccacctgctccagtcagctcactaccaccacctgtaaaatcatctcctccaacgggtccaattaactcaacaacggct

SEQ ID NO: 8655 - DNA, 402 bp, Zea mays
  unsure at all n locations
  Clone ID: LIB148-027-Q1-E1-E5
gcgggccgacacaagcctctagcgggcatcgctccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaaccgcgcctcagccagaactgcaagaggtcctngcaccctcctc

SEQ ID NO: 8656 - DNA, 385 bp, Zea mays
  Clone ID: LIB148-027-Q1-E1-E7
tccaagcctctagtctgagtcatattaccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacga

SEQ ID NO: 8657 - DNA, 395 bp, Zea mays
  Clone ID: LIB148-027-Q1-E1-E8
tacaccggatcatcagagcctgatctttgctggcaagcagctggaggatggccgtaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgctggcaagcagctggaggatggccgcaccctagcagactacaacatccagaaggagagcactctccacctggtgctccgcctccgcggtggtcagtaagccatgggtcatttaagctgctgctgtacctgggtatctg

SEQ ID NO: 8658 - DNA, 384 bp, Zea mays
  Clone ID: LIB148-027-Q1-E1-E9
gtcgatgacaagcctctagtgtgattcatcttaaagctcctgttaagatatttggagatttacacggacaatttggagatctgatgaggttatttgatgaatatggtgctccttcgactgcaggtgacattgcttacattgattatctattcttgggggattatgtagatcgcggccagcatagtttagaaactatcactcttcttcttgcattgaaggttgaatatcctcaaaatgtacatttgattcgaggaaatcacgaagctgcagatatcaatgctttgtttggtttccgaatagagtgtatagaacgaatgggcgaaagagatggtatctggacatggcatcgaatgaataggctatttaattggcttcctttggctg

SEQ ID NO: 8659 - DNA, 363 bp, Zea mays
  Clone ID: LIB148-027-Q1-E1-F10
gcgtccaattttatcaacgcttctcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaa

SEQ ID NO: 8660 - DNA, 362 bp, Zea mays
  Clone ID: LIB148-027-Q1-E1-F11
tctagagggagtcgtaataggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggatgaggggcccaaggttgacgaaccactcaaaatcaaag

SEQ ID NO: 8661 - DNA, 360 bp, Zea mays
  Clone ID: LIB148-027-Q1-E1-F12
gggccgagccacgcgtccatatcaatggcgttcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctc

SEQ ID NO: 8662 - DNA, 386 bp, Zea mays
  Clone ID: LIB148-027-Q1-E1-F2
accaaaacatagagtgtcgacttttctattggtgtgattgggggcactaaatacctaccacattgcactcagactacatatactgtgtttgtgtgttgtatgccgtatgcgtgtgtgagcttgcgcaaattggacatctaggccgtgcgtaccctgcgatgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtgaagtccatcaagtccttctgccagcccgtggactacagggagacgtgcgagaaggcgctggacgctgcagccgggaacgccaccagccccacggagctg

SEQ ID NO: 8663 - DNA, 410 bp, Zea mays
  Clone ID: LIB148-027-Q1-E1-F3
acggtggtggggcagcaaagagcaactacatatcgcccgcaccaacacgcatcgctgtcgaccgcaacggcagtgtgaagaatgcttccgtcgctagggccaacttgacatctcctcggccatcagagatcatctctgccagggacagcaattccacgacccagcaggaagtgaaggcgctcctctctcagatgtcatctgtgcggggcctcgatggttcttccagtgaaggatctcctagccccggtaccagcgctccgaacgaagagagcaaccctgcggcagcgagcaagaggccgtatctcgagaggaactactccgtgctggaaccttcagaagggagccagctcgccgacgacgtggaaggggaaagctctctcgagaacgtgaagaaacagctcgagctcaac

SEQ ID NO: 8664 - DNA, 402 bp, Zea mays
  Clone ID: LIB148-052-Q1-E1-D8
ggggacacacacacgtacaaaccgagagcacacaccgtcccccgcccgcccgccgccgcgacacgcgcgccatggccatgctggctcgctccgccgcgcacctcttcttcttccttctcctcgtctccaccgcgcccgccgtgcggaccatccccgacgaagcccgcggccccggaaacaacatccacgaggcgtgcagcaagacgctgttccccaaggtgtgcctgcacgcgctcaaggacaaccccgagtgccaggcgggggcggtcacgccgcgccggctggccgagctgctcgtgtacgtgtcggccgaggtgggcatgaccgtggccgcgttcgcgcaccacgagctcaactccatcaaggacgacgtcctgtacaagtgcctcgacacctgctccg

SEQ ID NO: 8665 - DNA, 416 bp, Zea mays
  unsure at all n locations
  Clone ID: LIB148-052-Q1-E1-D9
cgaccatccctgcaaattaccgcgatggctcccaagatcctagtcatccttgtgttcctcgccgtggcctcaccggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcancgacaagaaactcggcgtcctcaactacaccagggccgacgacgggcagatgta

SEQ ID NO: 8666 - DNA, 431 bp, Zea mays
  unsure at all n locations
  Clone ID: LIB148-052-Q1-E1-E1
aaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcncgctcaaccgcaacgacggcatcaagcagagcggcgtccgctacgccaaccccatc

SEQ ID NO: 8667 - DNA, 420 bp, Zea mays
  Clone ID: LIB148-052-Q1-E1-E10
cgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccgggatcacgctgctcaactccaagttcttccacatgaacatgtaccagtgcaagaacatgctgatcaaggacgtgaccgtgacggcgcccggggacagccccaacacggatggcatccacatgggcgactcatccgggatcaccatcaccaacaccgtcattggcgtcggcgacgactgcatctccatcggccctgggacctccaaagtgaacatcactggcgtgacctgcggccccggccacggcatcagcatcggcag

SEQ ID NO: 8668 - DNA, 425 bp, Zea mays
  Clone ID: LIB148-052-Q1-E1-E11
cccacgcgtccggcgagcgcggcgcggcccaacccgcaggggtcgtaccactacggccagatcaacatcacccgcaccatcaagctcgccatgggccgcggcaaggtggacggcaaggagcggttcggcttcaacggcgtgtcgcacgtcgaccccgagacccccgtcaagctcgccgagtacttcaacaccaccgacggggtgttccagtacgacatcatcggcgacgtgccgccctccaagtccgcgcccaccaagatggcccccaacgtcatccgcgccgagtttcgcaccttcatcgaggtggtcttcgagaaccccgagaagagcatcgacaccatccacatcgacggctacgccttcttcgccgtcggcatgggcccgggcaaatggacgccagcgtcccggagcacgtacaacctcct

SEQ ID NO: 8669 - DNA, 414 bp, Zea mays
  Clone ID: LIB148-052-Q1-E1-E12
cccacgcgtccggtggatgccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaacggactgtgcccgcccaacga

SEQ ID NO: 8670 - DNA, 413 bp, Zea mays
  Clone ID: LIB148-052-Q1-E1-E2
gcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaaacccgccgt

SEQ ID NO: 8671 - DNA, 414 bp, Zea mays
  unsure at all n locations
  Clone ID: LIB148-052-Q1-E1-E4
agcaacgatcacaacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggtgacttccttgtcggacaactcaacttcacaggcccttgcaagggcgacgtgaccatccaagtggatggcaatctgctggcgaacacggacctaagccagtacanaggacatggtaattggatcgagattctacgtgtggataacctggtcatc

SEQ ID NO: 8672 - DNA, 399 bp, Zea mays
  Clone ID: LIB148-052-Q1-E1-E5
acccacgcgtccgatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtccctcggaggtgttcgcgctggaggtccggtcggcggggcagagcatcgccgtgtgcgtcaacatgctgctcaccttcatcatcggccaggccttcctcagcatgctgtgctcgctcaagttcgggctc

SEQ ID NO: 8673 - DNA, 383 bp, Zea mays
  Clone ID: LIB148-052-Q1-E1-E6
gcgatgtacggcattgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccgtactggttctctgccatgaccatgaagagtgttggaagcgctgccctgaagatggt

SEQ ID NO: 8674 - DNA, 422 bp, Zea mays
  unsure at all n locations
  Clone ID: LIB148-052-Q1-E1-E7
agcttctcgtatcttgcagctggccttggtcttgggacttctcctaagcatacttcttggtgttggtctgcgcatagggtccagattatttacatccgatcagggtgtactgcatcatatctacataggaataccgtttgtctgccttactcaaccaatcaacgctctggcttttgtttttgatggtatcaattacggagcatcagatttcggatatgctgcctactcaatggtccttgttgccgttgtcagtatcatttgcatcctcactcttgaaagttatggcgggtttattggaatctggatagctctggtgatctacatgagcctccggatgtttgctggattttggaggatanggacggcacaagggccctgngcttatcttcgcggctgaacatagaggcagagctagtaacctg

SEQ ID NO: 8675 - DNA, 429 bp, Zea mays
  Clone ID: LIB148-052-Q1-E1-E8
acccacgcgtccgcggacgcgtgggcgatcaccaatgtgggcggcgccggcgacatcgcggcggtgtcggtgaaggggagcaagcgtgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctcatgcattccgatatggtgccggagttaaaaaaatgtaaatcaatgtgcaaactcaaatgacatct

SEQ ID NO: 8676 - DNA, 290 bp, Zea mays
  unsure at all n locations
  Clone ID: LIB148-052-Q1-E1-E9
cccacgcgtccgcccacgcgtccgaacccggagtcgctcgccaagttcgccgagaccgccgagaagtgcctcgccgagttcggcagcgaccgcatctccatgggcgacgtgctgtggaacctcgagtacgcgctgcagctgcaggacgccaacccgcccgagggcgcgcggcagggcggcgacggggacgaccaggacggcgccgcggcggccggcggcggcggcgcngtcgtanncgcgggcggtgccgtgcccgacgcgtccgacgccggcgccggggagctcttccc

SEQ ID NO: 8677 - DNA, 337 bp, Zea mays
  Clone ID: LIB148-052-Q1-E1-F1
acgcccgcctgctggctcgccggcgatcgaatttgaccgccggtcggcgagcggagcatacgtgcatacatggtttgcctgacgccggcggcggcggcgctgctgctcgtcgtcgtcctagcggcggccgtgtccgcgctcccggcgatcaacgtgacgacgatggcgttcgaggacgggtacgcgccgctgttcgggcacggcaacatcctccgctccgccgaccaccgcaccgtcagcctcctcctcgaccgttccaccgggtccggtttcatctcgtcgtccatgtaccagcacggcttcttcagcgcgtccatcaagctcccctccgactaca

SEQ ID NO: 8678 - DNA, 427 bp, Zea mays
  unsure at all n locations
  Clone ID: LIB148-052-Q1-E1-F11
caccaatctgccatcctctccatcacgaagatggcgttcatcagcaatgtcgcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccanaggaactggatccagatcgagaacgtcgagaacc

SEQ ID NO: 8679 - DNA, 424 bp, Zea mays
  Clone ID: LIB148-052-Q1-E1-C3
ctaccctcgtcgtcgtcgcactcaacccgccttcacgcctccctcaccaaataatgtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgacgaggacatctgccacgtggtcttggtggacagcccg

SEQ ID NO: 8680 - DNA, 322 bp, Zea mays
  unsure at all n locations
  Clone ID: LIB148-052-Q1-E1-C4
ggcgagggccacggcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgaggaggangctcgggtacgccggccgcgccgacgaggtccgggcccacccgttcttcgccggcgtcgcgtgggacatgcccacggaggtgtccaggcccccctacaacccgccgc

SEQ ID NO: 8681 - DNA, 425 bp, Zea mays
  Clone ID: LIB148-052-Q1-E1-C5
ctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggcggcgggatggaaggcagcggcgggctgaagaaggggccgtggacgcaggcggaggacaagctgctgagggaccacgtgcggcggcacggcgagggcaactggaacgccgtgcgccgggagacgaggctgcagcgctgcggcaagagctgccgtctccggtgggccaaccacctccgccccaacctc

SEQ ID NO: 8682 - DNA, 420 bp, Zea mays
  Clone ID: LIB148-052-Q1-E1-C6
cccacgcgtccgggagaaccagcagcctccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtg

SEQ ID NO: 8683 - DNA, 388 bp, Zea mays
  Clone ID: LIB148-052-Q1-E1-C7
aaagaagtcgcctaattctttcgatcgaattaggcgccttcttcgtcccacgctccgtctttatttgtaatgtgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggc

SEQ ID NO: 8684 - DNA, 348 bp, Zea mays
  Clone ID: LIB148-052-Q1-E1-C8
aggaaaacttgaaatcagcaaaaaaaaaaaaaaaaaaaaaaaaaaaaaaaaaaaaaaaaaaaaaaaaaataaaaaataaaagaaaaaagaaaaatataaatataaaaaaaaaaagaaaaaaaatcatttaaaatagttaaaagaggtgaaggagatggatttttaagtaaagggatcgaattggaagtctgataaaaaagtcttcagcgttggctacattggtgtgttagcggatggggtgtgcttggattttctgggggggggggcttcgtaggtttcatgtttttttgcgggtgtggggttattgtgggggttgccgtggggggttttgcggtcaagccgtggggg

SEQ ID NO: 8685 - DNA, 421 bp, Zea mays
  Clone ID: LIB148-052-Q1-E1-C9
atcgtgagcagcgacaagaccatcgacgggcgcggagcgcaggtgcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggcgacggcgtctccgtgatggggtccagcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaagacagggagatgcaggtcaccgtcgccttcaaccacttcggcaaggggctggtgc

SEQ ID NO: 8686 - DNA, 421 bp, Zea mays
  Clone ID: LIB148-052-Q1-E1-D1
tgcagctgctggccgccggcgtggccgtgctactgctagtggcaccgccggccttggctgacgacgacattgtagaagtcggcgtcaactggggttcgcagctctcgcacccgcttctccccggctccgtggtgaagatgctcaaggcgaaccgcatcgccagggtcaagatgttcgacgccgactcctggcccgtcggcgcgctcgtcgactccggcattgaggtcatgctcggcatccccaacgacatgctggagaccatgagcagcagctacggcaacgcccaggattgggtcaaggagaacgtcaccgcctacggtgacaagcttaagctcaagtatgtggcagtggggaacgagccatttctcaaagcatacaacgggtcattcatgaaagacaaccttcccggcgctcaagaaca

SEQ ID NO: 8687 - DNA, 428 bp, Zea mays
  unsure at all n locations
  Clone ID: LIB148-052-Q1-E1-D10
atcaaagcgtacgaggacgccgcctccgtgctcaccgtctccaagatccactacgagaatatcaagatggaggactcagccaaccccatcttcatcgacatgaagtactgccccaacaagttgtgtaccgccaacggcgcctccaaggtcaccgtcaaggacgtcaccttcaagaacatcactggcacctcctccaccccggaggccattagcctgctctgcactgccaaggtcncatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacncatctctctagttataatttttctctcgtccttgcattgcatattag

SEQ ID NO: 8688 - DNA, 414 bp, Zea mays
  unsure at all n locations
  Clone ID: LIB148-052-Q1-E1-D11
atcgacgggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtntttgattcgacacaccttt

SEQ ID NO: 8689 - DNA, 202 bp, Zea mays
  unsure at all n locations
  Clone ID: LIB148-052-Q1-E1-D12
agttcctctcncccctggttgtatggaagattaccaatatgcagcgattttctcgcaaagaaggagctcaatgcacatgcttgtttgttcacattcctttttctgctctgagtttctgctgatgcatgtgtacgacagtgtaatttgatgtttgtccacgctttcgagctaaggctttaatctaaaatatcttctattgttt

SEQ ID NO: 8690 - DNA, 383 bp, Zea mays
  Clone ID: LIB148-052-Q1-E1-D2
acccacgcgtccggcggcggatcgaggaggtggtcgtggcgcagtccgcggtgcaccggtgcgcggcgtccgtggacttcggcgccggtgggagcccgctgctgcccccgaccgtgaacgccgcctcgctgcacgcgcacttcgaggccgtcgccgccgacacggtcggcgcgggcgccgtccgtggcgccatggagccctgcatgggcagcgaggacttcgcgtccttctcggcggccgtccccgcctcgcacttctacttcgtcggcatagggaacgaggcgatcggggccgtgcacgccgcgcactcgccgcactttcttgtcgacgatggtgcgctcccgtacggcgccgcgatgcacgccaacctcgccatcgagtac

SEQ ID NO: 8691 - DNA, 424 bp, Zea mays
  Clone ID: LIB148-052-Q1-E1-D3
gccaagccggagcacaaagcttgtgtgtctggctgtctccggccggccgggcttgtcgtacgtcctccaatctgttgacggtcaggccctctagcttttgctcggcgttctggagacagagcgagagcgagagagagagagagagagagaggtagacggagatggagtgcctgctggggctgctcaaggtgcgggtggtgcgaggagtgcacctggccatctgcgacccgctcacccacagcagcgacccctacgtcgtcctccgccacggaaagcagaaagtgaaatcaagtataaaataccgcacgattcaaccagaatggaacgaggagctcaacctgtccatcacgaacatgatgaacccggtcaagattggactcctcgaccacgacacgttcaccaaggacgacagcatgggcaacgc

SEQ ID NO: 8692 - DNA, 349 bp, Zea mays
  Clone ID: LIB148-052-Q1-E1-D4
gcgtccagccaaaccggagcacagagcttgtgtgtctggctgtctccggccggccgggcttgtcgtacgtcctccaatctgttgacggtcaggccctctagcttttgctcggcgttctggagacagagcgagagcgagagagagagagagagagagaggtacacggagatggagtgcctgctggggctgctcaaggtgcgggtggtgcgaggagtgcacctggccatctgcgacccgctcacccacagcagcgacccctacgtcgtcctccgccacggaaagcagaaagtgggatcaagtatcaaatagcgcacgatcaacccagaatggaacgaggagctcaccctgt

SEQ ID NO: 8693 - DNA, 420 bp, Zea mays
  Clone ID: LIB148-052-Q1-E1-D5
cccacgcgtccgggcaagggacgtaagaagtcgtctaattcttggatcgaattagacgacttcttcgtccctctcttcattagcacgctaacttgtaatctgcaggatctaagcaaagacttgatttagttatggacggattggtaggcctcgtgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggtgagtgagcagcaggcagaacgatcctgtttgtgattcattattctagactgtttgctacaggaggtgttcgacaaggaca

SEQ ID NO: 8694 - DNA, 400 bp, Zea mays
  Clone ID: LIB148-052-Q1-E1-D6
ccacgcgtccgttctctaggaactatccaaaatccttccaggagctccttcgtaagcagaatggtgatagagcattgtgggaatatccctttgctgtagctggtgtaaatattacattcatgctgattcagatgcttgaccttcaagcagctaagccaacgtcgttggttggagcggttttcctaaatctactcttagaaaatgatcgagcgttcgacattctttactgcataaccttcaaactgatggatcagaaatggcttgaaatgcacgccagttacatggatttcaatacggttattaaatcaacacggcgccagctcgagagggagctgttgctagaagatatccagagaatcgaggacatgccatcgtacaggtttctcgcctgctagcaatt

SEQ ID NO: 8695 - DNA, 427 bp, Zea mays
  Clone ID: LIB148-052-Q1-E1-C2
cggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccggttgcacgagttcgcgcggcagcagatggactacctgctgggcgccaacccgcggcacagctcctacgtcgtgggcttcggcgccaacccgcccacgcagccgcaccaccgcggcgcatccacccccgtgctgccccccggcacggacgtcaactgcggcctcagcttcggggactggatggcgcccgacaagcccaaccccaacgagctcaccggcgccatcgtcggcgggcccgacaagaa

SEQ ID NO: 8696 - DNA, 400 bp, Zea mays
  Clone ID: LIB148-052-Q1-E1-B1
accgacactaaaggcgcctccccaggagtcaacgctgcacgtcaggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccg

SEQ ID NO: 8697 - DNA, 424 bp, Zea mays
  Clone ID: LIB148-052-Q1-E1-B10
atggtgctgccgctggaggcagaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaacctcttcttcaccatgccggtgatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctca

SEQ ID NO: 8698 - DNA, 383 bp, Zea mays
  unsure at all n locations
  Clone ID: LIB148-052-Q1-E1-B11
acnaataatagcaaagtggtgattcatcccgtntgaatcaatccttgccaaataaaccctggccttgcccttccgttcctcgtccccaattcccaacaacccccccttcggctccggaaaacaaaaccaattcccaatggaaataaaaaaggtcccctgccccgtcctcgcggcggcggcctcggccaccgtggtcccccgccgccgaggcccggcgcccgccccaacagcgcctcctcggccgcgttccggccgtcgcccgtgctggccctccgtgctctccttcttcgcctactacctgcagtaaaattaaaggaaggtcngacggagatgctgctggctgccattgcctgtattcggttggattccgtttatatatatat

SEQ ID NO: 8699 - DNA, 429 bp, Zea mays
  unsure at all n locations
  Clone ID: LIB148-052-Q1-E1-B12
ctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaaaggcaagtgcaccgagcagaagggcatcacngcgccggccatgaaggtctgccangangagtgcgacaaggcgtacgtggtgaaggcggccgaggtcacaaagcctgcaacgtcacc

SEQ ID NO: 8700 - DNA, 416 bp, Zea mays
  Clone ID: LIB148-052-Q1-E1-B2
ctctcactccatctctcaacgcctgaagctcaccgcacctcccctcctcgccgcggatcccccactactccggtagaaaatggctgacgctgaggatatccagcccctcgtctgcgacaacggaactggcatggtcaaggctgggttcgccggcgacgacgctccgagggccgtcttccccagcatcgttgggcgcccgcgccacaccggtgtgatggtggggatggggcagaaggatgcctacgtcggcgacgaggcgcagtccaagaggggtatcctgaccctcaagtaccccatcgagcacggaatcgtcagcaactgggacgacatggagaagatctggcatcacaccttctacaacgagctccgtgtggctcccgaggaacaccccgtcctcctcactgaggcgcccctga

SEQ ID NO: 8701 - DNA, 426 bp, Zea mays
  unsure at all n locations
  Clone ID: LIB148-052-Q1-E1-B3
ggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgggagcgacggcggggacgacgaggagttctcgaggaggatccaggagctcgcggtgggtcagcacccgggcgccggcggctgcnggtggccggcgagcgtggagcggagcgcgagcagcgtcgggctgccgctgtcnctgcggatgctcaaacggaggaagcagcagcagctggagcatgggcggtgggacgagcggctggtcgacagcgccggcgagtctgcgcgcgccgcggtggggcgcgccttctcctc

SEQ ID NO: 8702 - DNA, 427 bp, Zea mays
  Clone ID: LIB148-052-Q1-E1-B4
cgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagaggggttcga

SEQ ID NO: 8703 - DNA, 426 bp, Zea mays
  unsure at all n locations
  Clone ID: LIB148-052-Q1-E1-B6
gcgggaaatgccggcggcggcggccatgacgacgaggcgggtggtgctggaggtgctacggtcggcctcccgcgacgccttccaggtggccttctccttcgcggcgaggccgcccgtgtccaccatgctcaagccggccatcaccaagcccctctaccaccaccaccacgacaacgactaatctggcgcagatctacagcacggccgtcggcatgccttcacagcccggtgggtgtgacgactattgatgacgtactaccacatttcgtcgctcctattctagtaagcaacgcanaagaaaatgttgtaagattgagcctgagagcttgagtcaccaatgtaaattgtatacgactgactatatatagagcatgctctgtaaccatatatattgcccgggccccccttgccctcgcaatctatgct

SEQ ID NO: 8704 - DNA, 414 bp, Zea mays
  Clone ID: LIB148-052-Q1-E1-B7
cccacgcgtccggtcctctcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctctac

SEQ ID NO: 8705 - DNA, 364 bp, Zea mays
  Clone ID: LIB148-052-Q1-E1-B8
cccacgcgtccgcctgaaaccagcgtgctgtgccgcccgggacgatggcgccgcgccagccgctgctccccagtttcctctacgcggcgtcgtccggcgtcaacggcagcagggaggcgcctccggtggtggcgggcgccccgagcgagccgctcggcaagatcgagatgttctcgcccgcatactacgcagcgggcgccttgggaggcgccgcggcctgcgggttcacgcacgccgccgtcacgccgctcgacgtcatcaagtgcaatatccagatcgaccccgccaagtacaagaacacctcgtcggcgttcagcgtggtgatgagggaagcaggcctccggggcgtctacagggggtgggc

SEQ ID NO: 8706 - DNA, 426 bp, Zea mays
  unsure at all n locations
  Clone ID: LIB148-052-Q1-E1-B9
ggtcgacgacgcgtccggttcctgtccttcggccggagcgacgacagcatgaagaagacagacgacgacaccacgagccccaagaagagagccatcgcggctgctgatgacgattgcaagcctgccggtgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaggtgggcatgaccagccgctacgcgtccgctgaggatctgcaccagatggacagcgaccaggaagagggtgctganggtggcgatgacggtgacagcagtttgccacacgcatcgacatgc

SEQ ID NO: 8707 - DNA, 414 bp, Zea mays
  Clone ID: LIB148-052-Q1-E1-C1
cccacacgtccgatcaagccagacaacttccttataggcttaggtcggaaagctaatcaggtctatatcattgattatgggcttgctaagaaatacaaggaccttcagactcataaacacatcccatacagggagaacaaaaatctgactggaacagcacgttatgctagtgtgaatactcatcttggaatagaacaaagcaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagac

SEQ ID NO: 8708 - DNA, 412 bp, Zea mays
  unsure at all n locations
  Clone ID: LIB148-052-Q1-E1-C10
acccacgcgtccggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcancggcgacctcaacgcgtacaagaggaactggatcgagattcagaacgtcgacaacctgtccatcaacggccac

SEQ ID NO: 8709 - DNA, 61 bp, Zea mays
  unsure at all n locations
  Clone ID: LIB148-052-Q1-E1-C11
aaaataaatcatattaaaaatnaacaatcagaaaaaaaaaaaaaagggggggcgccccaaa

SEQ ID NO: 8710 - DNA, 424 bp, Zea mays
  unsure at all n locations
  Clone ID: LIB148-052-Q1-E1-C12
ggcccaacccgcaggggtcgtaccactacggccagatcaacatcacccgcaccatcaagctcgccatgggccgcggcaaggtggacggcaaggagcggttcggcttcaacggcgtgtcgcacgtcgaccccgagacccccgtcaagctcgccgagtacttcaacaccaccgacggggtgttccagtacgacatcatcggcgacgtgccgccctccaagtccgcgcccaccaagatggcccccaacgtcatccgcgccgagttccgcaccttcatcgaggtggtcttcgagaaacccgagaagagcatcgacnacatccacatcgacggctacgccttcttcgccgtcggcatgggcccgggcaaatggacgccagcgtcncggagcacgtacaacctcctggacacggtgagccggcacacgat

SEQ ID NO: 8711 - DNA, 365 bp, Zea mays
  Clone ID: LIB148-052-Q1-E1-A8
acgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaag

SEQ ID NO: 8712 - DNA, 373 bp, Zea mays
  Clone ID: LIB148-027-Q1-E1-C3
actagttctagatcgcgacggccgccctttttttttttttttgcaaaagtaactccattgcatttgtgtacagatgtacaaatttgcttgtttgagctgctatacacattacattacacacttgctgcttcacttcactataggactatgtctcgcctcttcttgatgttcattggctcggcaccagccgtccctttcctcatcatcgccacaaactctgaataatctatccttccatcattgtcagagtcggcatcggagatgatgtctttgattttatcggcgtcatacaacccttgctccttcaaggcgtgctcaagctcttctttagtaatgtacccgctgttgtccttgtcgaaatactggaatgctg

SEQ ID NO: 8713 - DNA, 324 bp, Zea mays
  Clone ID: LIB148-027-Q1-E1-C5
gacccacgcctctacagtcagtcctcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatc

SEQ ID NO: 8714 - DNA, 398 bp, Zea mays
  unsure at all n locations
  Clone ID: LIB148-027-Q1-E1-C6
acgaagtctgaaacccgttcgcgttgctctccagcataccgtcactgtcgcagacggcctcgcactcgcactcgccactgatcaaccagaactacccgcttctgaaccagatgcaggtgttccaccacctcggcggcagtcagcagccgtcgttccaccaggacggcagcgcggcggctttcggcgacatcgtctcctctcgcctgccgccactgccaaccgccagaacgcaggcggagctacattcgaaccaattcgacacctccagcagcggcgggctgctggatcagtcgatgctgatcggcgacgaacacctgctgcggcccaacccgagtatggtcaaggtctcctccatgcncgcgctctcctaccgtgaggcggatgggtccaggatgctg

SEQ ID NO: 8715 - DNA, 396 bp, Zea mays
  Clone ID: LIB148-027-Q1-E1-C7
gggccgacccacgcctctaggaatggtcatagtacagcacttcgtgcttgttcatggcgaagggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaatttgttgacaggatcggtcaagcatttttcgtggccgccacaatgctgccgtttggatttcaagccgatgaagataagaacgatgggttaccgac

SEQ ID NO: 8716 - DNA, 384 bp, Zea mays
  Clone ID: LIB148-027-Q1-E1-C8
actgatgtaccatcaaacacggtgttgacagcatcaaagaagatgctggaactaaaaatgagttcagcagttgtagcaatcgaaagcaaacctgggggaattctgacatctagagatatcctgatgcgtgttatcgcccaaaatcttcctcctgagtccactacagtcgagaaggtcatgactcagtgtcctgaatgtgcctcggtagacaccccaattcttgatgctcttcacacaatgcatgatggaaaatttttacatttgcctgttctggacagggatggaaatgttgtgactgttgttgatgttcttcacataacgcatgctgcaattgctacggttggaaacagcggggcagctggatctgagtcaacgtctgccatg

SEQ ID NO: 8717 - DNA, 312 bp, Zea mays
  Clone ID: LIB148-027-Q1-E1-D1
acaaatgtcattctaggacctaggaaggcgaaagtgctcagctgattcggcactaccaccaccagacaaactgaagccaattccgttcagcgtgaagtgaaacgttagcaattataggatagtcagtgtcttactgtctttaacctagttgtttctctatttccgcttctttttctagtttaccttatggtagagtggttttctagtttcccggtccatctagataggaaaaagcgcttggagggaagaatccatggccgacatctatttaaccttttcaccttggtactaagataatggagtattttcgag

SEQ ID NO: 8718 - DNA, 378 bp, Zea mays
  Clone ID: LIB148-027-Q1-E1-D10
gtcgatacaagcccctatactgactcgtaccaccgtttgcggtgcgacagctcctccaggaccggcccccgcgcgcgtgccgtacgtgccagggacgacgccgggcggccgatggagttcacgtcgtcctacttccacgccttcggcaaccccgacctcgcggcggtggtctccggcgacggcggcagcgcgcaggcccaccggccgcgccgctccaccgacggcgcgaaggcggaggacggcaggagccccaccaccacaacggcgaggcgcgcgccgtccatgttctgcgtccccgacacggaggcggaggagcccaacggcttcctggacgagtgcaccctctgccgcaaggcgctctgcggcgacatcttcatg

SEQ ID NO: 8719 - DNA, 323 bp, Zea mays
  Clone ID: LIB148-027-Q1-E1-D12
gacacaagcgtctagagagagtcctgttagatcgacttgtgtcattgcacgagcacatccaccggcgagcaccgggggcgctctccgtccgctaccgacggagcaacgcgccgagctaagatgtgctagcatacgtatgtagccgagcaactgatgtgcgaaatagacggtaagcaactcacttcggcggccatcttcggccacgacggcgccatgtgcgctcagagcagcgcagtcaccgagttcacgcccaaggacatggatggcatcatgaacgacttcgacgacccggtgcagctcgcgtggacctgcctgatattggg

SEQ ID NO: 8720 - DNA, 317 bp, Zea mays
  Clone ID: LIB148-027-Q1-E1-D2
aagacagtccttgctcagatcgcctcggtcaaccgaacacatcacggccaccggaaagaaaatgtcgcgcgctacatctgcggtcctcttctacatcctcgccgtcgactgatctcagcgcggcctacgtaccggaagagtcactatggcaggtagtcgtgcaaaggcaccggtcgagtgcaataatgcacgaagtcctgcagactcttggcacagcacacgactctgctgcaattaaaactgcacgcgctaacggacatcatgccggatctagaccagccgttgcagctgccccatcgtcgtcttcgtctaggaag

SEQ ID NO: 8721 - DNA, 418 bp, Zea mays
  Clone ID: LIB148-027-Q1-E1-D4
aacccagccgcgcgccctgcgctgcgtgctccaccagcttttcgtggtgccgcccggccgtgcctgtcggccagtggctggctggcgctcggccggtcgtcctcgcctgcctctgcagcgccagacaccgcaggacggccgcccctgttcccggaaccgatccgcagtgcgggcacggggcagatgccagtcggcaagagaaggagcgattgccgccgcggcgtggtgtgtggcgccaccagcgtgtttgccttttgcccgatcgggccggccgagcgcgggagtcgaatcgctgtcggatctagccccccccgcccgcgcgtggcccgctgcgctcgccgcgcgacatggcccgggcccccggccgacggacgggcccgcgcgcctttgaatgattgaatccggcccgccaagccca

SEQ ID NO: 8722 - DNA, 408 bp, Zea mays
  Clone ID: LIB148-027-Q1-E1-D5
ggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtg

SEQ ID NO: 8723 - DNA, 435 bp, Zea mays
  Clone ID: LIB148-027-Q1-E1-D6
gggccgacccacgcgtccaggcacgcaccctgtctgtcacattgttcattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagcatgaactaaattaaataccaattacgataccgaccagatatgcatggagcatgcaagaatgttgtcgaacgaatatatgctatgaatggttacatgt

SEQ ID NO: 8724 - DNA, 409 bp, Zea mays
  Clone ID: LIB148-027-Q1-E1-D7
acactcctgtcctacatgttcgctcccggctccccctccatctctttcgccacacgcgcgagaggggggagaggaaacagctagcagcgagcgaggaacgaagagggtgcttcgcacgtgcatgtgagatcgggcgatcccgatcgtcggccggcgcgaattgaactaacgacgacgtacgtgcgaccgggccgggcgttggattattccggcctgagcaatgggcaagatcgagtacggcgtggtggcgcgcggcgcggtggtgctggcggagcactacggcgcggcggcggcgggcggcaacgcgggcgccgtggcgccgcaggtcctggagcgtctccctggcggcggcgacgacgactgcaacgtgtcgtacacgcaggacctccacgtgttccacgtcaagcgc

SEQ ID NO: 8725 - DNA, 393 bp, Zea mays
  Clone ID: LIB148-027-Q1-E1-D8
caaccctctacggaaactcgggtcatggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaaacccgacccggcggcactggt

SEQ ID NO: 8726 - DNA, 351 bp, Zea mays
  Clone ID: LIB148-027-Q1-E1-C12
acgcgtccaacgaggtgcgagaggacgaagagggcgcatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataagcttctg

SEQ ID NO: 8727 - DNA, 355 bp, Zea mays
  Clone ID: LIB148-027-Q1-E1-A5
tacaaccctctatactgacgtcgtagtatgaccgtcgttttgtacccgttgagatcccaggattcagactggtgccattcgatttgatttggcgcggggtactttcctatggccgcctccatcgcggcctcgcccttctttccagggtcgccggcgccggccgctcctaagaacggccttggagagcgcccagagagcctggacgtccgcggcgttgcggcgaagccgggagcctcgtctaatgccgtgagggcgggcaagacgcgcgcccacgctgccgtccccaaggtgaacggtggcaagtctgcggtggcggatgtggaacacgagaccgtaactgtaccttcgtcggtgc

SEQ ID NO: 8728 - DNA, 413 bp, Zea mays
  Clone ID: LIB148-027-Q1-E1-A7
agacatttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctccggcaatccagtcacggtgtacatcactgacatgaactacgagcctatcgctccc

SEQ ID NO: 8729 - DNA, 415 bp, Zea mays
  Clone ID: LIB148-027-Q1-E1-A8
agcgagctcctcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacatctggtcctgcggcgtcatcctcttcgtgctcctcgccggctacctcccgttccacgacgccaacctggtggagatgtaccgcaagatcagcagagcccacgtcaagtacccgc

SEQ ID NO: 8730 - DNA, 360 bp, Zea mays
  Clone ID: LIB148-027-Q1-E1-A9
acatctgttcaaagcagatgcaccacaccggcaacgagctcttgcagcggacgcaataacctgccggaaattcgccgagcgggcttacaagtacagaccactcaaagttgttgagtttgatcggccctacccacagtgcatagcatacttggatctcaagcgcgacgagtgctctcgactctttcctgcagggcggatatactcgcaagcgttccaccttgcagggcagggtttcttcctctcggctcactgtaacatggagcagcaaagcgcgttctactgcttcgggctcttcctggggatgcaagagaagggctccacgagtgtgacagtggactacgagttcgctgcaaggacgag

SEQ ID NO: 8731 - DNA, 386 bp, Zea mays
  unsure at all n locations
  Clone ID: LIB148-027-Q1-E1-B12
acaacaccctagactgagtcgtaatacaaccgcggcctcgcatccggtgcggaggtctgcaattggggggaggctcctctccgccgttggaaccgctgcggcgtcgcagcctgtgcgactttcctgctggttcctcatccctcagggacagattttgcattctttggcattactgtttgatggcagacagtagtgctccttctctgtggaggcattggggcaaaaggcagttgaactgaacgggcacatcaatagtctctggcctccaagggaaattgggaaattcagattgaacgtggctgcatcatttttcctttcattggtcttttcagcaacagcgatccattctcgtangggggagagagagagagagagagagggagaga

SEQ ID NO: 8732 - DNA, 383 bp, Zea mays
  Clone ID: LIB148-027-Q1-E1-B3
tcgcgggccgatacaagactctacagtgagtcctattatccccgctctctgtctcgccgcccggggagaaggagggctcctccgctcgcggggaagagcacgccattgcctccgccgcgctgactggggaagatggttgtccaggagttcagagttgatctcaacaagcaccttgttttccagggtggccatcttgaagaacggtagcatcaatgggttcaacaaccgatcgttagcaacgagggtccacgcgtttgcgggaatgatgtcttggagttcttgactcacacgaggtggtgggctgtgccaactatatggctgactgttgtcagctgcctgctcgtgaaatctattctgatgggtcatatcgttcatgacgtagc

SEQ ID NO: 8733 - DNA, 383 bp, Zea mays
  Clone ID: LIB148-027-Q1-E1-B4
aacacgaatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctc

SEQ ID NO: 8734 - DNA, 401 bp, Zea mays
  Clone ID: LIB148-027-Q1-E1-B5
cacgcgtctacccagacgtctggaagacaagtggccagagtattatgacaccaggacaggaatgttcattgggaagcaatcacggctatatcaaacttggagcattgctggatatcttagctctaagatgttattggactgtccggagatggcatccatactagtatgcgatgaagacttcgagctgctggaaggttgtgcttgcagcttgaataagaatgctcgcaccaaatgctcacgtcgtgcggccaagtcgcaggttcttgtgtagttccatgcctgttcttgacccaaaagctgcaacgctccttcaacttgttgtaattgttcgtcacagaagctggcactagttactagttacttaagcagaatgattcacaaacaactatgccgattttttt

SEQ ID NO: 8735 - DNA, 322 bp, Zea mays
  Clone ID: LIB148-027-Q1-E1-B7
caagcctctaaataaactcttattagtgggatgaacatatattctggattggatccaacaaatgtttgtgaggatcatacgggtatgatgatgcttgtgagttgtgtgtaagggggaaagtgcatgtaacatttcaaggctgtggtattattggttggacgtctatgctcattgggtttacacttttatttcactttctttgagttacacaaaagctcacgagtttgtgtatgcatattccgcgtaggtagtcttcatctacagaggaggttgttttaattttctatgcactctacagtgcaaaaatatattttacacagcc

SEQ ID NO: 8736 - DNA, 373 bp, Zea mays
  unsure at all n locations
  Clone ID: LIB148-027-Q1-E1-B8
aagccacatcacatacaggaaagcaagcaagaatcatcggaataatggcccgtgcatgcgtgttcctcgtcgtgctcctcctggccgccatcgcggtggcaccgttcgcgggcgccgcacgcgtggacgttgtggagggtaggtccatggcatccgccgatgcaccggaggcggcggccgatgctcccgctcctagccccgactccgcctcatcnccagactcgtcatcggaggcgccctctagcagcagttcctccgactagacgcanaaacctcttcattctctggaataactaacagtatatacgttgcaccctgatgatatagaaacatgtacgtgcatcagtgtatggaatgcgagtgggaaacacat

SEQ ID NO: 8737 - DNA, 344 bp, Zea mays
  Clone ID: LIB148-027-Q1-E1-C1
aagaccaatgtcaacgagtacatcgcaggcgccaaggtgaagctggagtgcaagcacttcggcaccggcaagctcgatcgctccatccacggggtgacccaccggaacggcacatacacgatccaactcatggacagccacgaggaggacatcggctaagtggtcttggtggagagcccgcacaaggactgcagaccaggtacatgccgacagggaccgcgccggcatcatgctcaccatgaacgtcggcattaacgagcttctgcgctcctggaaaagtctcgggtaactcaaggacttgccactgatcatctacgcatccctgctcaaacagttggactcag

SEQ ID NO: 8738 - DNA, 428 bp, Zea mays
  Clone ID: LIB148-027-Q1-E1-A4
ctcgcgggccgatacacgcctcaagtctaagtctcctcactcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaacccaacgtcgtgc

SEQ ID NO: 8739 - DNA, 366 bp, Zea mays
  Clone ID: LIB148-026-Q1-E1-G11
ctctacccacacttctggcaaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtg

SEQ ID NO: 8740 - DNA, 358 bp, Zea mays
  unsure at all n locations
  Clone ID: LIB148-026-Q1-E1-G2
acccacacgtccggcttaattgcgccactgctcgttatcctcctcttgcattgcattgcaggtcgtagttgagcagcagcaaccactgcacaggatgtcgtggcagacgtacgtcgatgagcacctcatgtgcgagatcganggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgaacccggcgctgtcatccccgggaaaaaagga

SEQ ID NO: 8741 - DNA, 269 bp, Zea mays
  Clone ID: LIB148-026-Q1-E1-G3
acaccctaaagtatgtcgtattataattgcgccactgctcgttatcctcctcttgcattgcattgcaggtcgtagttgagcagcagcaaccactgcacaggatgtcgtggcagacgtacgtcgatgagcacctcatgtggcgagatcgagggccaccacctgagctctgccgccatagtcgggcacgacggcgccgtttgggcccagagcaccgcattcccacagttcaagccagaggagatgaccaacatcattaaggacttcgacga

SEQ ID NO: 8742 - DNA, 311 bp, Zea mays
  Clone ID: LIB148-026-Q1-E1-G5
gccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacttcgacctcagcatgcccgcgttcctccagatcgcgcaggagaaggccggcatcgtgcccatctcctaccgcaaggtggcg

SEQ ID NO: 8743 - DNA, 217 bp, Zea mays
  Clone ID: LIB148-026-Q1-E1-G6
gacccacaagtccaaaggaagtcgcgttaatcacggtggtcatggacgccctccactacgcctaccgggtccatgtcgtcctcatcggacacgtgaaccacgtgcaagttgatccaacgggcctgtgcaaatacacgcatgcaacgttctagcggcgtgcagaactcgtctggcaacacggcggagacgcgctgagagtatcagcgacagcccacgc

SEQ ID NO: 8744 - DNA, 316 bp, Zea mays
  Clone ID: LIB148-026-Q1-E1-G7
tacattcactctttctagccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgg

SEQ ID NO: 8745 - DNA, 185 bp, Zea mays
  Clone ID: LIB148-026-Q1-E1-G8
actgcttcatactctcgtagagagatccccgcggcccaataaaaacccgactcgctagctgcactacacactcgcagatggccggcctcaggatgaagttcgtcgccgtcgccgccatggccgccgcgctcgtggcgtccgccgcagccgccgaggcccccgccccggcccccgcctccgacgcc

SEQ ID NO: 8746 - DNA, 375 bp, Zea mays
  Clone ID: LIB148-026-Q1-E1-G9
actctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccagcgcctctacacccccttcttccacggaccaagaattgagcccttccccgccagcatccaccgacgcggcgtcccctgcggctgagggaccggctgctgatgact

SEQ ID NO: 8747 - DNA, 342 bp, Zea mays
  Clone ID: LIB148-026-Q1-E1-H1
ggtcgagacaagcctctagtataattcgggctatggctccgcctcgcgcgcccgatccgggccgtcctccttttttcccctcttatatttgatcggtttctttgcgtcgttcacgcagggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaagccaagctggctgcctcctctatccacagcat

SEQ ID NO: 8748 - DNA, 335 bp, Zea mays
  Clone ID: LIB148-026-Q1-E1-H12
tctacccacacttctgggaagcgtggaaagaacgaggctgacgacgacaagccgcgagctcgtcttcaaggaagacgggcaggagtatgcgcaggtgaccggatgctcgcaacggcggtgccaggccacctgcgtggacggcacgcgtcgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttccccagacgctcaggctcaacgagggcg

SEQ ID NO: 8749 - DNA, 309 bp, Zea mays
  unsure at all n locations
  Clone ID: LIB148-026-Q1-E1-H3
agcctctacagtaactcgtgctaacgcgtgggcaagttgggcgcctccggcaatggcaagacagacagcacgaaggctgtgcangaggcatgggcatcggcgtgcggcggcactgggaagcagacaatcctcatacccaagggcgacttccttgtcggacaactcaactttacaggcccttgcaagggcgacgtgaccatccaggtggatggcaatctgctggcgaccacggacctaagccagtacaaggaccatggtaattggatcgagattctacgcgtggataacctggtcatcaccggcaagggg

SEQ ID NO: 8750 - DNA, 201 bp, Zea mays
  Clone ID: LIB148-026-Q1-E1-H4
actcgcatcatgacacgccggagtcggtgtggaagaactgggtgtggcactccgagaacgacctcttcatggaaggcgcctacttcaccgtcaccggcggccagatcaacaggcagttcaacaagaaggacctcatcaagcccaggaacggggtccctacgtcaacaagctcacgcgctacgccggctccctcgcctgcac

SEQ ID NO: 8751 - DNA, 284 bp, Zea mays
  Clone ID: LIB148-026-Q1-E1-H5
tagactcattagcgcgccggactcgcgcgtcatcttcgccgacacctacctctccaagaccatccagccggccggctggacaaccataggctacagcggcatcaccgacaaggtgacgctcgcggagttcaactgcactgggccgggcgctgacgtgacgaaccgcgtgccatggtcgcggaggttctctctcgacgacgcagccaagtacctcaccatcgacttcatcaactgcaaggactggctgccggcgtactactactgatccgacgatcgactgctgg

SEQ ID NO: 8752 - DNA, 296 bp, Zea mays
  Clone ID: LIB148-026-Q1-E1-H6
ttactacaccctgacgtgagtcgtattacggactcgcgcgtcatcttcgacgtcacgtaactctccaagaccatccagctggccggctggacagccatatgctaaatcgggatcacggacaaggtgacgctcgcggaattcaactgcactgggccgggcactgacgtgacgaaccgcgtgccatggtcgcggaggttctcatctcgaccacacagccaagtacctcacgatcgacttcatcaactgcaaggactggctgccggcgtactactactgatccgacaatcgactgctgg

SEQ ID NO: 8753 - DNA, 331 bp, Zea mays
  Clone ID: LIB148-026-Q1-E1-H7
accgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctc

SEQ ID NO: 8754 - DNA, 308 bp, Zea mays
  Clone ID: LIB148-026-Q1-E1-H8
gagtcatgttacaagaacaagtatctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagttacccctttgcatccgctttg

SEQ ID NO: 8755 - DNA, 367 bp, Zea mays
  Clone ID: LIB148-026-Q1-E1-H9
ctctacaatgacacgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccgacgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaaga

SEQ ID NO: 8756 - DNA, 218 bp, Zea mays
  Clone ID: LIB148-027-Q1-E1-A11
tgaggtggctgccgccgccgccgccagcggacggcgagatacccttcggacacgacgccgtcgccttgtccttcttcgtggcgtgtgtggccggcagcgtcgcgctcgcgtcgtcgatgtgctcgggattccgtcgcaagcgggacgcggccacccgtgcagacccggccgcttcgggcgagtcgagcgggacgggctcgggctccgtcgccggtggc

SEQ ID NO: 8757 - DNA, 94 bp, Zea mays
  Clone ID: LIB148-027-Q1-E1-A12
ctgacagcgacgatgatgccacaactgcgtcgcctcgtcgcgctgggcctcgtggccacgggcagtagcgcggcgcccgggcgttgggtttgtc

SEQ ID NO: 8758 - DNA, 328 bp, Zea mays
  Clone ID: LIB148-027-Q1-E1-A3
ctctagacatttccattggaacagttgagcgcgacgatgggatccctcgctaataacatcatggtcgtgggtgtcgtccttgcagcgctcgtcgccggcgggtcatgcgggcggccgaaggtgccgcccggtcccaacatcaccaccaactacaacggcaagtggctcaccgccagggccacctggtacggtcagcccaacgggtgccggcgctcctgacaacggcggtgcgtgcgggatcaagaacgtggacctgcgaccctacagcggaatgacggcgtgcgggaacgtccccatcttcaaggagggcaagggctgcggctcatgc

SEQ ID NO: 8759 - DNA, 229 bp, Zea mays
  Clone ID: LIB148-026-Q1-E1-G10
gacccacacgtccagagctagctagccagccagccagcagccagcttgctcgccgcgcccgtccttcttcctcgcctccgttccgttccgttccgtcccgcccgccgccgccgacgcattcagggatggacatgacgaggatcgccagcgccgtcctcgtcggccccgctgtggacatcgtggcgctcttacctgaaggtggagacgttggatttcatgtcttcggttg

SEQ ID NO: 8760 - DNA, 404 bp, Zea mays
  Clone ID: LIB148-026-Q1-E1-E2
ggtcgagacacgcgtccagtttaaatcgcgagcggccccctttttttttttttttttttttttttttttttttttttttttttttttttttttttttttttttttttaatcaaacatatcttgttggagttagatattatttatagagaagctacgccacagcgacaatagaactggtagtatggttggtcattggtgtttgtatatactatcgtcgcgccgccgcctcctcctccgtcatcgtccgaccccaccgtccaacggcatggcggccggccgcgacgacgtcaatgcatggtgtgcgatcgagccaggccagctgcgtgccccctggccagccagccagcagggagattaaaccgccgggcgccgccttggggctcaattcaagctgcgggggcaac

SEQ ID NO: 8761 - DNA, 207 bp, Zea mays
  Clone ID: LIB148-026-Q1-E1-E3
gggtcagcagctcaatcatcctcacacacacagctcacacacactccaatatgaaacgacatgatcacggcctctggacctcggctatcgcacccaagacgagaagaaaaacgcgaacgcagcgcgagcaaaaatcagacactctgctcacctgtgcagggcagaagggaccgacctggtcgtgtgcaaggagtcctgcgcgctctc

SEQ ID NO: 8762 - DNA, 324 bp, Zea mays
  unsure at all n locations
  Clone ID: LIB148-026-Q1-E1-E4
gggtcgagacacgcgtccacgcccacatcgaggacccgcagacgagggcgatggtggagaacttcgcccggaacgagccactgtggcagcagaagttttcccaggcgatgcagaaggtccggatgcttgacgtgctaatcggcgagggcaaaggccaggtaaggaagcagtgccgcctggtgaacgggcaggagaaggagcagaagcagcagcagccaccggaagagcaaggagagcaacagccaccggagctggaggaagangagcagcaacagccgcatcagccacagcttccatggttcctgcagaggcagcgcccgcccg

SEQ ID NO: 8763 - DNA, 281 bp, Zea mays
  Clone ID: LIB148-026-Q1-E1-E5
cccacgcgtccgtccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtccgtgtggaagaactgggtgtggcactccgagaacgacctcttcatggagggcgcctacttcaccgtcaccggcggccagatcaacagacagttcaacaagaaggacctcatcaagccc

SEQ ID NO: 8764 - DNA, 281 bp, Zea mays
  Clone ID: LIB148-026-Q1-E1-E6
gatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttg

SEQ ID NO: 8765 - DNA, 286 bp, Zea mays
  Clone ID: LIB148-026-Q1-E1-E7
cacgactctagcatgactcttatcatcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggaaccctggtgtggagcaagaacc

SEQ ID NO: 8766 - DNA, 379 bp, Zea mays
  Clone ID: LIB148-026-Q1-E1-E9
accacgcgtccgcggacgcgtgggcggacgcgtgggatttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaagggaaaa

SEQ ID NO: 8767 - DNA, 336 bp, Zea mays
  Clone ID: LIB148-026-Q1-E1-F1
cgggtcgatacacgcgtctacacagaggcctctataagctcgcacgcgccggcaaaatcaaagggttcaccggcatcgacgatccttacgaaccgccgtcggactgtgagatagtgatccagtgtaaagtcggcgactgcccttcgcctgaatcgatggctggtcacgttgtgtcgtaccttgagacgaatggtttcctccaggactagacatggaatgcgatcgatgcgtctgatgtgtatatatgtagcagcagccggagcggcattgccaaggctgtgtaatctcatggctgtctttctctttaagaccaaaacaaacaagagatggcagtgt

SEQ ID NO: 8768 - DNA, 381 bp, Zea mays
  Clone ID: LIB148-026-Q1-E1-F11
acgcgtctaacacggtctaatgaagcgcaacgatttctgaccatcccctgacggtttgcggtggccgtccaaatccaatcccaggcgaccatgatctgcgtggacaactccgagtggatgaggaatggggactatcccccatcgcggttcgcggcgcaagcccacgccttcgccgtcctctccggcgccaagacggaggcgaacctggagagcacggtggggctggtggccatggcgggcaaaggcgtcagcgtgctcgtcccgccaaacaacgacttctgcaaagtcctgtcatgcatgaacgggctggaaattggtggtgaagcaaacttgactgctgcgattcacgtcgctcaatttgcactcaagaatcggcaagac

SEQ ID NO: 8769 - DNA, 371 bp, Zea mays
  Clone ID: LIB148-026-Q1-E1-F2
gggtcgagcacgcgtccggttatacaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgaccttcgtggacactccaggagttttatcaggggagaagcagcggacgcagcgcagctacgatttcaccggagtcacgtcgtggtttgcggccaagtgcgacctcatccttctcctgtttgatccgcataagcttgacatcagcgatgag

SEQ ID NO: 8770 - DNA, 315 bp, Zea mays
  Clone ID: LIB148-026-Q1-E1-F3
gggtcgagacacgcgtccagcactacgtgctgcacaacgccaccgagctcagcagcaacgcgctggccatcaccaacagcctcggcgggatcctgaagaagatggacctcggcatgttcagcaaggactcgcgccgccgactgctgtcgtcggagcaagatgagaaaggctggcccgtgtggatgcggtcgccggagaggaagctgctggcgtcgggcaaccagcccaagccgaacgcgatcgtggccaaggacggtagcgggcagttcaagagcatccagcaggccgtggacgccgtgcccaagggccatcagg

SEQ ID NO: 8771 - DNA, 299 bp, Zea mays
  unsure at all n locations
  Clone ID: LIB148-026-Q1-E1-F4
ggtcgagnccgcgtccacccacacgtccgggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatcaaaaaaaaagaaagtaacaggcagttcaagaacatcaagcaaggcgtggaaacagataacc

SEQ ID NO: 8772 - DNA, 284 bp, Zea mays
  Clone ID: LIB148-026-Q1-E1-F5
aattttctggagcgttgccttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgcatctacgaaactaatgcacagtcagaagaatgaagccatttctgaaaaccttggcacgacactggtttgtttt

SEQ ID NO: 8773 - DNA, 365 bp, Zea mays
  Clone ID: LIB148-026-Q1-E1-F9
acggacgcgtggggccgtgacccgggcccgggcgctgtggatcaccttcgcgcgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggcgacggcgtctccgtgatggggtccagcgatatctggatcgaccacctgtccatgagcagctgcgcggacgggctggtggacgcggtggacg

SEQ ID NO: 8774 - DNA, 298 bp, Zea mays
  Clone ID: LIB148-026-Q1-E1-G1
acaatactctaatgtgagtcatattatagacctgcgttgtcacccacccatcgaggttggggccgccagcaggttcagccgttcctgttcttgataaaacgagagaaggatggcagtgtttcagggagctgtcctattcttgtttctcctcctcgtcgcagcagatgtgggaaccatcgatgccaaaatgggagtagccatgcccatgcatgccttgataatggagaaagcgaaacagcaggagacggagaagaaggaggagaaaagcacggagaaggaagagagtcaatgcttatcg

SEQ ID NO: 8775 - DNA, 85 bp, Zea mays
  unsure at all n locations
  Clone ID: LIB148-026-Q1-E1-C3
cgcgtctaaagtaagtcctattacncactatccaccaccgcgccgctccggtttaatttctcctcgaccggccagcgcaattctg

SEQ ID NO: 8776 - DNA, 322 bp, Zea mays
  Clone ID: LIB148-026-Q1-E1-C4
agccgggttcgagacaaacgtgtcccacgccatccaaggcgcgacggtggagatggagtgccgccacttcgagtcgcagcaggtccacgacaaggcggaggcgacgacgggccccggcggctggtacaggattgagatcagcggcgaccaccaggacgagatctgcgacgtgcgcctgctcaagagccccgaggcggactgcgccgagatcgaccactcccgcgaccgctgccgcgtcccgctcaaccgcaacgacggcatcaagcagagcggcgtccgctacgccaaccccatcgccttcctccgcaaggagccgctcccc

SEQ ID NO: 8777 - DNA, 301 bp, Zea mays
  Clone ID: LIB148-026-Q1-E1-C5
agtttatcacctctaagttgtgatttttcatgggagactcactgaagcagatgcacacagatactttcagtagcttatcgacggtgttgatttttgtcacaagaaaaggagtctaccattgagacttaaaggatgcttagtgggtcaactgtagggatctttccttctacatacgacctatgggactcgctttttggtaggtgcccgtgcgatgccacggaacataaattgcgaacctccaatggacttcatttgagacaagtgatgcccaagaaaatgggggtaaactgacacagctatc

SEQ ID NO: 8778 - DNA, 331 bp, Zea mays
  Clone ID: LIB148-026-Q1-E1-C6
cggacgcgtgggttgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcgtccttggccccaacaagtacatggtcatccaaggcgaacccggggctg

SEQ ID NO: 8779 - DNA, 256 bp, Zea mays
  Clone ID: LIB148-026-Q1-E1-C7
acgggctggcacgcctggtgccgccgtcggtggcggacaatgtgacgcattaccggctgacggtgaccgcgggcaccttctgctacatctatcctgagtaccatcagacgggcaagctgggcgtcaagtcatacatctactccctctgcgtgctcctgctgcaggtggtcaccacgcggccatccatggggctcacgcatcatgtccagaatgccatccacgcgggcacctttgaaccaatgctcgacatcaccgt

SEQ ID NO: 8780 - DNA, 195 bp, Zea mays
  Clone ID: LIB148-026-Q1-E1-C8
acgggctcgcacgcttggtgcctccttccgtgcctgataacgtattgcagtagcggatgacagtgacgatcggcaccttctgcaaaatctatcctgagtaccatgggtcgagcagcctgggagtcgagtccatcatcgacaccctccgcgtgctcctgctacaggtggtcaccacgccgccattcttggggatca

SEQ ID NO: 8781 - DNA, 351 bp, Zea mays
  Clone ID: LIB148-026-Q1-E1-C9
cccacgcgtccgcccacgcgtccgagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatcttcgcccgcg

SEQ ID NO: 8782 - DNA, 269 bp, Zea mays
  Clone ID: LIB148-026-Q1-E1-D1
tggtgctcctcctcggtgcgtgccccgagtacggctgcctcgtgtacgagtacatggagcacggcagcctcgaggaccggctgttccgtcggggcggcacgccgccgatcccgtgggcgcagcggttccggatcgcggcggagatcgcgacggcgctgctgttcctgcaccagacaaagccggagccgctggtgcaccgggacctgaagccggccaacatcctgctggaccgcaactacgtgagcaagatcagcgacgtcgggctggcg

SEQ ID NO: 8783 - DNA, 222 bp, Zea mays
  Clone ID: LIB148-026-Q1-E1-D11
cgcccaggccgatacaacactctagaggcagtcgtatcacacagccagcgggcagccatgagggagatcctccacatccagggcgggcagtgcgggaaccagatcggggccaagttctgggaggtgatctgcgacgagcacgggatcgacgccacgggccgctacgcgggggactcagacctccagctcgagcgcgtcaacgtctactacaacgaggccagc

SEQ ID NO: 8784 - DNA, 335 bp, Zea mays
  Clone ID: LIB148-026-Q1-E1-D2
acgcgtccaaacacacgtccgcccacgcgtccggcatcttccctgtcgtggatccacatgaacaaggttggccctacccctgctctttttaaggctgaaatgccctggtcagcccgaagaggaaatctctcggagaaacaaagagtcttcaaaacggtgaaaggaggttcctttatagcttacttgatgcaatgcagtctctaacatcgcaagctgttgttattggtgtgagttgccgcttggtgtcactcttgattgatgtttcaaacaaaaaagatgtcattcctggttatgtagtaatgatcatgcaacaccatataaagcacatgtgtttc

SEQ ID NO: 8785 - DNA, 309 bp, Zea mays
  Clone ID: LIB148-026-Q1-E1-D3
cttgtgccgattctgctgatccctcgccgacaacggccggcgaatcgacaccatggccgctgcgcgccggggcccgtggcgacagcaccaacggcgtcgtccgtccccgcccccgcgaccgcggcgtcggcggccggagcatggcggggcgcgtgggcgtcctcgccttctgtgtcgcagggatctggtccgcctacatctaccaaggcgtcctccaggagactctatcgacgaagcggttcgggccggatgcgcggcggttcgagcacctcgcgttcctcaacttcgcgcagaacgtcatccgcttcg

SEQ ID NO: 8786 - DNA, 247 bp, Zea mays
  Clone ID: LIB148-026-Q1-E1-D4
atgcgcaccggacccggagcaggatttcagcaccgggtacgacggcagggatgtcgtgctccagaacctggtccagatctgcgtgttcagggtcgccaatgggactcgcaggccgtggatgtggtgggactacgtgcacgacttcgctgtgaggtgcccgatgaaggagaagaagtacacgcgtgagtgtgcgaacggtgttatcaattcacttggactggacattgagaaaatcaacaagtgtgtt

SEQ ID NO: 8787 - DNA, 293 bp, Zea mays
  Clone ID: LIB148-026-Q1-E1-D5
acgaatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactac

SEQ ID NO: 8788 - DNA, 374 bp, Zea mays
  Clone ID: LIB148-026-Q1-E1-D6
aggatcactatctcgctcgcgagggcactctctctctcgctcactcacaccgtgctgttcctcgtttgctgtcgcctcgaagagcctcctccgttccctctccctcgaccgatcggccggtctcacggggcatttcgcggcgctggtcgatctctccgcgctcattctgtcaacggattggtcggttgccgattccgtgcggccggataactcggatttattcagtttttcgggttcgctacatgcgtgtgcgatgccgggcagctccctcacggcgtcccacgacgccaccggcgacattggcgccgcgctcgagctcgatctcgatgatttcaccgccagcggcggcaccgactgcatcgtggcgctcgcct

SEQ ID NO: 8789 - DNA, 315 bp, Zea mays
  unsure at all n locations
  Clone ID: LIB148-026-Q1-E1-D7
agtgagatattggaatatcatccacaactgctcaaagactatatcaatggcacggagaggacaacctttctgtacccaagtgctgtcgaccaatttaggaagcaatttgctcatcttgaagaaaatagtggaaacggacctgtgattccaatggaaagaaaacatacttctcttcctaggtctactattgttcactcatctccaattcctgtcaaggaacaaccccgtatcggcccatgtanggaaaggccttcatctgatgagtcctaaaggaatcctcgggagacaggacaatattccgggaatctccccaaa

SEQ ID NO: 8790 - DNA, 226 bp, Zea mays
  Clone ID: LIB148-026-Q1-E1-D9
gacccaagcgtaagggaagttccatgtggaacatgtccccgggttcctatgtgtgggaaaacaggggtgtactttttttaaatgggcaaccccattggtagggaaatccaagggggtatatcctttccacgaaaaggattggatagatgtatggctatctttatgttgtgttctccgaccacgggaaagaatggtaattgaaaaacactgtggtgctatactgagc

SEQ ID NO: 8791 - DNA, 340 bp, Zea mays
  Clone ID: LIB148-026-Q1-E1-C2
agcgggtggtcggcgtctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatg

SEQ ID NO: 8792 - DNA, 331 bp, Zea mays
  Clone ID: LIB148-026-Q1-E1-E1
gggtcgagacacgcgtctaggccgatgcggggcactgcctcgctgacatcggtgacatgatgacccgcgagttcacggctcagcaggatgtgctgagcacactcgaggcgctatgcaagcaagcgcgcgactccgtcctcctcctcccacgcctgccctccttccgacacccctcgaccgacggcgacggcgtcgacgagggtacagccgtctccggcgggcggaagcacgtgtcgttcggcgacctgagcttcgcggagtgggcgtcgttcctggagaggttcgagcagctgctgccggcggcgctagaagccaagaagcgcgctgggct

SEQ ID NO: 8793 - DNA, 390 bp, Zea mays
  Clone ID: LIB148-026-Q1-E1-E11
acaagcattcagacacacaagcgtcaaacttgtcaagcagctagcaaccaacccaagaaagacaccatacccatggctcgcgctagcgtcgtcttcgtcgttgctgctctcctcttcgtcgccatggttgtggcaccgatggccgaggcaaagtccgctgatgccccctccgccgatgcccccgcccccgctgctgacgcacctgccgatggacctagcggaccggcaggtgcacctggtccccagggcgtcgagggactatcgggcaatgaggacgacgacgatgactccaccaactaaggccaagcacgtcggtccgattgcatttggaacaagatatgaaagaaaagtgagagcaatgttgtttaaaaccaaaaatccataataatg

SEQ ID NO: 8794 - DNA, 350 bp, Zea mays
  unsure at all n locations
  Clone ID: LIB148-026-Q1-E1-E12
acccacgcgtccgccaggtccaagtgatcttgccaagttacgagcagcaagcagagatcagatcatccatcggcaatgtcgaacatcgggcagtccttccaggccggcaaggcgganggcccagggcgagtacaggcggagcacgccgcgcagtgcgtcaaagacaccgccggagccgcggccgacagcgcgcacctgcagcagcaccgcgccaccggcaccgttgaccaggtggcgcaaacgggccagggcgtggcggcaggcgtcaaggacacggtggcgggcccggcggttggcgtcaccaacacggtggcggccttggcggcgggcgtcacgaacacggtgacccg

SEQ ID NO: 8795 - DNA, 78 bp, Zea mays
  Clone ID: LIB148-026-Q1-E1-A3
aaatctcaagaactacccgaaactttggcgacagataactctgcattaactgataagttcaaccaacaggcacatgta

SEQ ID NO: 8796 - DNA, 253 bp, Zea mays
  Clone ID: LIB148-026-Q1-E1-A5
gaggaaatcgtcgcaatgctgggcggcggccacagcatcggcgtctgcaggtgcttcttcatcgagaccgacgcggcgcccatcgaccccaagtacaagaagacgatcagcgacgcgtgcgacggcaaggactcgggctccgtccccatggactccacctcgcccaacgacctggacgggagctacttcggcctggtgctggagaagaagatgccgctcaccatcgaccgcctgatggggatgggcaagaaga

SEQ ID NO: 8797 - DNA, 310 bp, Zea mays
  Clone ID: LIB148-026-Q1-E1-A6
actccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagattagacctctttg

SEQ ID NO: 8798 - DNA, 247 bp, Zea mays
  Clone ID: LIB148-026-Q1-E1-A7
ccgaaatccacaaaagggacttccggttccgtgctagcgtctagcgatcgcgtcggcctccactccaccttcccgaaaaagcttaccctttgtgtttgtgtgtctgtctggcaatcgatcgatctccatgacgacgtccccgccgcgcgcacgcctgctcgccatggcgctggcgctcgcctgcgtgctgctcgtcaagtccgcggacgccgccacgcccggcggctccgcgtacgggtgcaacccg

SEQ ID NO: 8799 - DNA, 382 bp, Zea mays
  Clone ID: LIB148-026-Q1-E1-B10
atacacgactctagaatgactcgtgggagccccgtccactctcgtgtcggtcccgcgatgggcatgttcgcatcggccgcaaagagatacagcaacggcaagaattttctccgcagcgcgggcgtgtgctgttgttcgccgtccgcctccgcccagcttggtggtgtgcgcggcaaggaagagacatcgacgtcggcgccagctttcgcgccggatagcaacaagaaaaggtggaggaagaagaggttctggagaaagaagatgaaggccaggaaggagatcggcgggctggtggacctcgtcaacgatatttcggccaagtcagaggagagcctaagggttagcaaccaaaacatgcccagcagggcgctgacgttcagtc

SEQ ID NO: 8800 - DNA, 362 bp, Zea mays
  Clone ID: LIB148-026-Q1-E1-B12
gccgatacaacactctagaatgcgtcgtcttagtcgcccacagcgcccgacgtcgagctgccgcacgccaacttcaccgtggaccgcctcatccagatgttcggcgccaaggggttcacggtgcaggagctggtggcgctgtccggcgcccacacgctgggcttctcccactgcaaggagttcgccgaccgcctctacaacttccgcagccagggcgggaagccggagccgttcgaccccagcatgaacccgtcctacgccagggggctgcaggacgtgtgcaaggactacctcaaggaccccaccatcgccgcgttcaacgacatcatgactcccggcaagttcgacaacatgtacttcgt

SEQ ID NO: 8801 - DNA, 309 bp, Zea mays
  Clone ID: LIB148-026-Q1-E1-B2
gggtcgatacaagcctctacactgcgtcctccgagcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggag

SEQ ID NO: 8802 - DNA, 298 bp, Zea mays
  Clone ID: LIB148-026-Q1-E1-B3
ggcacgcgtctacgctacatcatgtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcaaagccttgtgacatgggctacac

SEQ ID NO: 8803 - DNA, 328 bp, Zea mays
  unsure at all n locations
  Clone ID: LIB148-026-Q1-E1-B4
gccgccggcactacgagtacgtctccctgggctgcgacgcgatgcncgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaaggcggctgctgaggccgtgggcaagccggagtggggcaacgcgggtccgggcgactc

SEQ ID NO: 8804 - DNA, 279 bp, Zea mays
  Clone ID: LIB148-026-Q1-E1-B5
acaagccactcatcgaagacggccgacgaccagaagcagaccatgcattcgccggctcgccatgtaagaaacaggggagttgaaagtgcgacacaccagagaacgtgtctgtgtatactgtgtaaaggtcctaaaggaaagagaagatgcacatattcaaagcctcggaactaattgctctgttgtccactatgttatccaagtatatatttgttcttcacttgtgttgagcaaaaataaaaaaaacataaaaaaggggcggccgctccaaaaggttca

SEQ ID NO: 8805 - DNA, 311 bp, Zea mays
  Clone ID: LIB148-026-Q1-E1-B6
gttccttcgggtggccggacggaacgaggaaggaggcaggatggcctccgatggccacccgccggagccggggaagaaggaggatgtcgccaccacggccgccgggcctggagcaaacgatctggacgacccgcaattcatgtgctgcgtatgtctggatcttctgtacaaaccagttgttatatcatgtggtcatatgtcatgtttctggtgtgtccacaaagctatgcatattttccgggaatcgcattgtgctgtgtgtacgcagccctatatacacttcccgagtatttggcaactcctgcatcaat

SEQ ID NO: 8806 - DNA, 294 bp, Zea mays
  Clone ID: LIB148-026-Q1-E1-B7
acccacgcctcctcgaaggcaggcagtcctgccagagcaccggtcgactcaccgaacgcacgcagtcctgcagctcctgccaaggcactcgaatctgctgccacgagaactgcccccgctaatgcacctcaagccgccttcatctccgccgttgctgctgctccatcgtcgtcgtcatctatgaaatcaggtccacctgccgcacctatcagcgccgcctctacaccgtcttcttccatcgacgaagagtttagcccttccccgtcggcatccaatcgcccaagttgcctcccc

SEQ ID NO: 8807 - DNA, 369 bp, Zea mays
  Clone ID: LIB148-026-Q1-E1-A12
cccacgcgtccgcccacgcgtccggaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagcccgaggcggactgcgccgaga

SEQ ID NO: 8808 - DNA, 308 bp, Zea mays
  Clone ID: LIB148-026-Q1-E1-B9
cccacgcgtccgcggacgcgtgggcaagcagaagctcgtcttcggcgggcgcgagctggcgcgcgacgacgggcgcatcctggactacggcgtggcggacggcaacgtggtgcacctggtcatccgcgtcccggacgtgcgcctcatcaccgtggagaccgtgcaaggcggcaagttcaagttccgcctggagcccgggcgcaacgtccggtacgttaagcaacagattgccaagggccaacccgccggcgcgcccccccgcgaacaacgggtccttctccaaggcgaaggacttcaagaacggcaac

SEQ ID NO: 8809 - DNA, 290 bp, Zea mays
  Clone ID: LIB148-026-Q1-E1-C1
cggtcgagcacgcgtctagcactatgcaatgaactttacacagtagtccgtgaagttttggatgccattcctccttttgagactacacggtcaggatgcagtcctgggctcctggcattgagttccttgaggatatctgttgagaaagccaagaatttactccagtattgctcagagagtagcaagctttacttggctgttacagcagaaagcgttctaacaaaatttgagaattcaagacaaggacttctggaaagccttcaccaagtagaagaaacaattccggaagc

SEQ ID NO: 8810 - DNA, 350 bp, Zea mays
  Clone ID: LIB148-026-Q1-E1-C10
tacggacgcgtggcggacgcgtggcggacgcgtgggcgaggtgatgcgcggggaagggaagggcgccgcggtcagggccaaggtggccgagctgcagaaggccgccgccgaggggctccgcgacgggggcgccgccgccgccgcgctggccgaggtggtacaggggtggacgacgacgacaggtggaggagagaaggactaagtggtggtgactggtgatgccgacgcgattggcgcctgccacctgccgcctgccgcctggtgccacaacgattgtcctcatccagaccaactccaacttgggccgggccaaacgattcgtttgttccttggccttgggtaaaactttg

SEQ ID NO: 8811 - DNA, 417 bp, Zea mays
  Clone ID: LIB148-026-Q1-E1-C11
ctcgcgggtcgatacacgcctctacaatgcgtctcctgatggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctg

SEQ ID NO: 8812 - DNA, 378 bp, Zea mays
  Clone ID: LIB148-026-Q1-E1-C12
tacaagactctacaataattcgtgcgagcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagc

SEQ ID NO: 8813 - DNA, 404 bp, Zea mays
  Clone ID: LIB148-002-Q1-E1-C11
ctggaaccacagaccacaaaggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcatcacgagctcaacgccatcaaggacgacgacgtcctgtacaagtgcatcgacacctgctccg

SEQ ID NO: 8814 - DNA, 408 bp, Zea mays
  unsure at all n locations
  Clone ID: LIB148-002-Q1-E1-C12
cccacacgtcagctcgatgaggacgttgccgcgcatgtcaacggcgacttccgaaagcttttaatgcctcttgttagtgcgtaacgctatgatggaccacacgtgaacacatctttggctcattctgaagccaaaatacttcatgagaagatccataagaaggcttacagtgatgaggagatcattacaattctcaccacacggagcaaagctcagctacttgcaacattcaatagctacaaggatcagttcactcatgcaatcaacaaggatctgaaagctgaccccaaggatgagtttctttcaacactgcgggcgatcatccggtgcttcacctgccctgacagatacttcgagaaagtcattcgactggctcttggaggcatgggcactgatgangatgacctc

SEQ ID NO: 8815 - DNA, 409 bp, Zea mays
  unsure at all n locations
  Clone ID: LIB148-002-Q1-E1-C3
cccacgcgtccgtgccgatcgagcagagttgtgcggcacggactattcttaattgttttgttgtaaaatatgtactacgtatcttctttttttccccgatgtgtgggaataccaaggcactgtatgaactagcaagctcaacaacaaggatttcaaaataatcgaaaagagagatgggggtaggaagaacgggggctatgtagctagaaacaaaacgtgttgtggtttgagaggaacccacgaaacggcactagtttgagacagtgttcgagaaatagcaattgttttcaaacaattcaaagaacaacagtagttttatcaaatgaatttagaaaacaacactccatatatatttttcgtccttttatttcaggcctcacangcanatagaccagattgcccctatctt

SEQ ID NO: 8816 - DNA, 405 bp, Zea mays
  unsure at all n locations
  Clone ID: LIB148-002-Q1-E1-C4
gaccgtctcggatccaggtccagggacgccgccctgcacccgcgccatgccgacgctcggcatcgcgcggctgctggacgcctccttccggcgccgcttcgccgcggcgggcctcgtcgaggcctccgtcccgctggacggcggcgcgaccacggtgcactgctggcgcttcccgccgagcgccgacgacggcggcggcgaggacgcccgccccgtcctggtgctcctgcacggctttgggcccccggcgacgtggcagtggcggcgccaggtgggcccgctctcgcgccggttccggctcatcgtcncggacctgctcttcttcggcggctcgtccacgtcgtcggcgcccggcgtctccgaggcccagcaagcggaagcngtggcgaaggtcgtggcggctgt

SEQ ID NO: 8817 - DNA, 371 bp, Zea mays
  Clone ID: LIB148-002-Q1-E1-C5
gctgacgacaccaccgtgtggtcgacaaaatataaaggagagagagagagatggctctgtcgtctcgccgtatggccgccgcaccattcttcgtcgtcgtccttctcgtcctcgtggcggcagagaggacgatgggcagggtggtggtggaagagacgctctgcttgtcgcagagccatgccttcaaaggcgtgtgcctcagcaacaccaactgcgacaacgtatgcaagacggagaagttcacaggcggcgagtgcaagatggacggcgtcatgcgcaagtgctactgcaagaaggtctgctagggcatgaccggcagcaagccccagccgtacggctggttgatccggttgcacaccgtttgggcacgc

SEQ ID NO: 8818 - DNA, 404 bp, Zea mays
  Clone ID: LIB148-002-Q1-E1-C6
cgttgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaatgagagctttcccggtggcgagtgcaagcgggacgtggccatgcgcaagtgcttctgcaagaagcttgctagttcatc

SEQ ID NO: 8819 - DNA, 370 bp, Zea mays
  Clone ID: LIB148-002-Q1-E1-C7
accggccggcgttccccgtcgactgtgttcgatcgctagacggggtggcacgctgcgacgactacctgtatggcgagtccctatacttactcatacataagctgcgccgccgtgtcgtcggtgcgtgcaccgcgcagtagtgtgcgtacagcggaagctgcgactgcgagcgaggtagggtgtggggtgggtgactgggtaccaggagtggggtacggtacgtaggtgccacgttggaggctttggcgtttgctcagagcctggcaggagatgggtttgatgttctgctgctgtgttactgtatcctacacctacagaatgtgctatgatttgtactgctataatttttaacgaagatacaaacttctac

SEQ ID NO: 8820 - DNA, 407 bp, Zea mays
  Clone ID: LIB148-002-Q1-E1-C8
ggctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaagtgcggtgcgtggacagccctagcgggtgcaagcccgacgcggcagcgctggtggtgacggtgaccgacctgtgcccgccca

SEQ ID NO: 8821 - DNA, 393 bp, Zea mays
  Clone ID: LIB148-002-Q1-E1-C9
gagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcagcgtgcggcggcactgggaatcagacaatcctcatacccaagggcgacttccttgtcggacaactcaacttcacaggcccttgcaagggcgacgtgaccatccacgtggatggcaatctgctggcgaccacggacctaagccagtacaaggaacatggtaattggatcgagattctacgcgtggataacctggtcatcaccggcaatggaaaccttga

SEQ ID NO: 8822 - DNA, 406 bp, Zea mays
  Clone ID: LIB148-002-Q1-E1-D1
gagaaaggcaagggacgtaagaagtcgtctaattcttggatcgaattagacgacttcatcgtccctctcttcattagcacgctaacttgtaatctgcaggatctaagcagagacttgatttacttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgat

SEQ ID NO: 8823 - DNA, 411 bp, Zea mays
  Clone ID: LIB148-002-Q1-E1-D10
gccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagacatttttcgagtccaggaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaa

SEQ ID NO: 8824 - DNA, 151 bp, Zea mays
  Clone ID: LIB148-002-Q1-E1-D11
cgctggtttgtattttctttcttctttggatcatcacaaaaccaaccgatgtaattattattagaccgacgcctcacaatcttggaacttattcattatgctagtgtatatctgtaatcccattccataatgttaatgttgatttgtggtc

SEQ ID NO: 8825 - DNA, 408 bp, Zea mays
  Clone ID: LIB148-002-Q1-E1-D12
cccacgcgtccgcccacgcgtccggccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcaaggcgatgttcctgtccttcggccggagcgacgacagcatgaagaagacaga

SEQ ID NO: 8826 - DNA, 370 bp, Zea mays
  Clone ID: LIB148-002-Q1-E1-D2
ggatccttcacaactcgctggggatggacttcgtgaataatcgggatgtgtctcgggtcacgctgcgtaactccaagttcttccagattaacatgtaccggttcaaggatatgctgatcaaggaagtaactgtgacagcgcccggcgataaccccaacactgatggcatccacatgggcgattcatccgggatcaccagcattaacaacgtcattgtcgtcagcgacgactgtatctccatcagacccgggatctccaacgtgaacatcaccggcgtgacctgcaggcctgaccattgtatcagcatcggaagcctacggaggtacaatgacgaggaacgacatcacggacatcaacatcaacgattgca

SEQ ID NO: 8827 - DNA, 399 bp, Zea mays
  Clone ID: LIB148-002-Q1-E1-D3
cccacgcgtccgccaacctctgcggcacgcccagcccaggtagccctggtgcgcactctagtaacgccttggagtcatggaagatttgcaacccaggagataaccctctgcttgtgaagacaaggctcaggcactgggctcaagtagtggcttgttcagtgaagcactcgagctgatcctcgtcagtgttttattcacgctcttcttccatacataatacccgtacaagtggttgcgatggcgatgaattagtcgtgtccgagtgaaactagatcaattgaccttgttgctcgatctaatgtcgtcccaggtcacattgttgtggacagatttaattagcgtcgggttggcaaattaaaaaatgtatatgcaaagtactgttaaaggttggcatggtgt

SEQ ID NO: 8828 - DNA, 414 bp, Zea mays
  Clone ID: LIB148-002-Q1-E1-D4
ctccccgtcccgtctcccctctcgccctaggggccggggggctagggtttgcttcaccgccggcctccccctccgacgcggcaccggcccccgcgcaccgggcccggatgctatgctgctgagctgcaggaccctctccacctgggtgcgccgcctcgtcgcttgcatgggagcagaggttgctttggatgctgtgctaagccaactccaataatagcagtagacgagccttccaagcggttgaggatccaggggcgatcagtaaggaaggctagcctctcggaggacttttggagcacgagtgcgcatgagatggagaacagcgggatccaatcgcagaggagcatgtcttcgatcagcacgttggctcagtccagcgatcagcatgcgtcaggaagttgcagcaacccgaat

SEQ ID NO: 8829 - DNA, 282 bp, Zea mays
  Clone ID: LIB148-002-Q1-E1-D5
tattaataataattaagctacatacacacgtactacctaagtatggccggccatgcccatgccccctcatctcgtcggtccgccggcgagcatcgatcgatctttttctttgcatgctgtcggtcgtccccatcattgtgcggatgtgtttaaagcgccgtggacttgcgtgtaacctgcaactcgtcttttgttctgtggtctgacgtataatctgtgtcggcatcccattctgataactccaagaccgcaacgagagggcgaccttggcaattctgaccg

SEQ ID NO: 8830 - DNA, 293 bp, Zea mays
  Clone ID: LIB148-002-Q1-E1-C1
gcaaccaatatatatcacacacacacacacacactcacacattctcacactcaagtctgcgtttgccatttttcttttctttttctctacgacttcgttattccctcctttcatctatctctccgtgaactcggtttgtcgtccagctggctgtaagtgtaccagatgccttcgttacgtctgatgaggctcatgacaatggcgattttggcatggagttgtgttagcctcgcggaaaaactgtaactgtgtaagcagaactgctatatattgttcctaacaatgttgtcctt

SEQ ID NO: 8831 - DNA, 407 bp, Zea mays
  Clone ID: LIB148-002-Q1-E1-A3
gatcgatcgattacagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcga

SEQ ID NO: 8832 - DNA, 408 bp, Zea mays
  Clone ID: LIB148-002-Q1-E1-A4
gtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgttcgcgacccaacgt

SEQ ID NO: 8833 - DNA, 402 bp, Zea mays
  Clone ID: LIB148-002-Q1-E1-A5
atcgtccttcatcttctcaccagcctcctccgacacgtaaattgcaccgatcgagacacagggaacaaaggcaacagccatggcgggaacccgtgccctgtacctcctcgtcgcggctgtcgcggcgctcttagccacgcctgcggccgtggacgcggccacgctggcggagatctgcaggggaaccgcgttccccgacatctgcaccagcacggtggggagcgaggcgcagagcgccggggtgttggacgccatggcggtgttgcggatgcaggtggacgcgttcaacaagcgcaccgaggcggcgagggcgcacgtcaaggaggccgccgtgacggcgtcccccaaggcgccgacggtgctggacctgtgcaacaacctgtacctggacgtggaggacaa

SEQ ID NO: 8834 - DNA, 356 bp, Zea mays
  Clone ID: LIB148-002-Q1-E1-A6
cacagagctagctagccagccagccagcagccagcttgctcgccgcgcccgtccttcttcctcgcctccgttccattccgtcgcgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggcctccgtcgcctcattcttcgcctacgacattcagtgagccgggccgggcgctccgaggccgaagaataaaccaaggggatagacagtgacatggctgcgcgca

SEQ ID NO: 8835 - DNA, 396 bp, Zea mays
  Clone ID: LIB148-002-Q1-E1-A7
cccacgcgtccggccagctgacggggttcctcgcagatccagatggtgttcttgatgtggtcccggcggacatggtggtgaacgcgacgctggcgtcgatggcgaagcacggcggcggcgcggcggggcccgggatgcacgtgtaccacgtgtcgtcgtcgacggtgaaccctctggtgttcggcgacctgagccggttcctgttccagcacttcacgcggtgcccctacagcgacgcggcagggcagcccatcctggtgccgcccatgcgcctcttcgacaccatggagcagttcgccagctacgtggagacggacgcgctgctgcgcagcgcccggtcgacctcgtcctcgtcgtcgctggcgcagcgggcgcgcgacctgtgcgccaggtccg

SEQ ID NO: 8836 - DNA, 402 bp, Zea mays
  Clone ID: LIB148-002-Q1-E1-A8
ctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgttacagaccgaccccg

SEQ ID NO: 8837 - DNA, 291 bp, Zea mays
  Clone ID: LIB148-002-Q1-E1-A9
ccgggcagcatggcggagatcagccgtctcctgccacctgtgcgtgtttgttatcggtgcattgatctctacgacggcatcggtgacggcgaccacagttcagtcacggaaggcggggctcattacctcgcggctcagacgcactggattccgggcctagctgatggatgtgctatagccggacaatacatcgggagaaacttgggcggcaccggcgtccataggcaaccgcatgttctcatgatgcgacttctgtcctcgttgactcatccagatgcagttacaccgacc

SEQ ID NO: 8838 - DNA, 393 bp, Zea mays
  Clone ID: LIB148-002-Q1-E1-B1
gccgaaggcctcgtgccttctcttcctccctgacatggacgaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggtcgcaagcaacgaggacgacgcgttgttcagtgtcggcgaatccaccagtgactatggccatcgcttgacgatggaatgcaccactcccgtctcctccagtagcccttccactcgcaagaatcgcatggcgttcagcctcttcatggcgatgttcctgtccatcggccggagcgacgacagcatgaaggaagacagactacgaca

SEQ ID NO: 8839 - DNA, 406 bp, Zea mays
  Clone ID: LIB148-002-Q1-E1-B10
cccacgcgtccgggcggagctgcggagcatggccgccgtctgccgctccatgcgcgagcgctgccgcggcgaccacctctgggagcggcacatgacaaacaggtggggccgtgtcctgagccgcgccgccagggacgaatggaggacgcacctggcgtccgccagcgagtcccgcgccgcgggcggcggcggcggcggcaagcgccggaggtggctcgccgcgctgtcctgcgtttgcccggtggtgtcctggatgcggcccatggccgacggtggcaagtcgtccgcccccgtgctggacgattccatcatgtcgtggtacctgtccgtggacagcggcaagttctggttcacggctcaggtctacaaccgcgagcatgggcatgttgggttcatgatgtcatgc

SEQ ID NO: 8840 - DNA, 416 bp, Zea mays
  Clone ID: LIB148-002-Q1-E1-B2
cacacgcgtccggaaccacagaccacacacgaggggacacacacacacacacaccgtctccgctcgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcagcaggacgctgttccccaatgtgtgcatgcacgcgctcaaggacaacccagagtgccatgcggagacggcggtcacgccgcgccggctggccgagctgctcgtgtacgtgtcggccgaggtgggcatgaccgtggccgcgttcgcgcatcacgagctcaacgccatcaaggacgacgacgtcctgtacaagtgcatcgacacctgctccgagg

SEQ ID NO: 8841 - DNA, 371 bp, Zea mays
  Clone ID: LIB148-002-Q1-E1-B3
ccaacgcgtccgcgacgacggcaccaaggtggcggtgaagcgcgggagcgcggagtcggagcagggcatcaacgagttcaacacggagatccagatgctgtcgaagctgcggcaccggcacctggtgtcgctgatcggctactgcgacgagaaccaggagatgatcctggtgtacgagtacatgcacaacggcgtgttccgggaccacatctacggcagcgaggggaaggcgccgctgccgtggaagcagcggctggagatctgcatcggcgcggcgcgggggctgcactacttgcacacgggcacggcgcatgggatcatccaccgcgacgtgaagaccaccaacatcctgctggacgacaacttcgtgg

SEQ ID NO: 8842 - DNA, 194 bp, Zea mays
  Clone ID: LIB148-002-Q1-E1-B5
cggaagtccggatcgaccacacgtccgaaaaaattatcgaggcaaaagtgagatataagaaataaagtttacagcatgaaatggattgaaaaaaagtggaagtaaatgactgaaataaaaaggtggaagctctataggatgacgttactgtgttgtaagcgtagatcacaaaagtcttatctatggggacttgt

SEQ ID NO: 8843 - DNA, 406 bp, Zea mays
  Clone ID: LIB148-002-Q1-E1-B6
accgcctccccgtgtcccctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttc

SEQ ID NO: 8844 - DNA, 401 bp, Zea mays
  Clone ID: LIB148-002-Q1-E1-B7
ccacgcgtccggcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctcccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacg

SEQ ID NO: 8845 - DNA, 388 bp, Zea mays
  Clone ID: LIB148-002-Q1-E1-B8
ctcaagtagagaagacttctccaccaccagcaccactcagctcaccaccattggcgcccaagtcatcacctccacatgttgttgtgagctcaccacctccagtggtgaagtcctctccaccacctgcaccggttagctcgccaccattgacgcctaagccggcaagcccacctgcgcacgtgagctcaccacctgaagtggtgaagccatccacaccaccgacaccaacaacagtcatctcacctccatcagagcccaagtcatcaccgccacctactcctgtgagcttgccagctccaatagttaagtcctctccagcagcgtgcattggttagctcagcaccgatgacgcctaagtcgtcacctccaccggttgttgtgagctcac

SEQ ID NO: 8846 - DNA, 401 bp, Zea mays
  Clone ID: LIB148-002-Q1-E1-A2
catgagcatgacattggtcaccacacatctggcgatcaccagaagcttttacttgcctatgtggggattccacgctacgaaggtcctgaggttgatcctaccattgtgacacatgatgcaaaggatttgtacaaagctggtgagaaaaggctgggtacggatgagaagacctttatccgcgttttcactgaacgcagttgggcacacttggcatctgtttcgtctgcctaccatcatatgtatgaccggaaattagagaaggttatcaagagcgaaacatctggaaactttgaattcgcacttttagctatcctcagatgcgcggaaaacccagcagagtattttgcaaagctcttacgaaaggccatgaaaggtctaggcactgatgacaagacacttat

SEQ ID NO: 8847 - DNA, 421 bp, Zea mays
  Clone ID: LIB148-001-Q1-E1-H1
gaccgattaacccaccaccgcctcgcctcgtctccgctctcttcctcggacaaagccggggccgttcggcgggaggcaggggacgcacgggcaggcagccatgaacggcatcaaccccaacggcgggttcctgtcgtacgggaacatggagagctatgcgatgtgggtggcgaccggcgtggcgtcggccttcttcgcgtccctcgagcgctgctcctgcatccacctccacaccgcggaggacgacggcgacgaggaggaggaggacctcgaggaggcccgccgctccttctcccgcccgatccctgagtactactacgaccggtccggctcctccgcctccgtcgccaagatgtgacctgaccgaaccgcgcctctctccgcccaagaaatgcgtggtgataccaatcgtttcctgatc

SEQ ID NO: 8848 - DNA, 396 bp, Zea mays
  Clone ID: LIB148-001-Q1-E1-H10
gcagggcaagagaatccgtacgtcgaggtgcacgtcgtaagtacgatggacgcggaccagcaaggcgtggttgcggcggcggtgaagccggcgctggccaatgggacgccgtcggcgtcgttccggctccgcaacgggagcctgaacgcggtgcgcctccgccgcgtgttcgacctgttcgaccgcaacggggacggcgagatcaccgtggacgatctggcgcaggcgctggatgcgctgggcctggacgccgaccgcgccgggctgtccgccaccgtcggcgcctacgtgcccgacggcgccgcgggcctccgcttcgaggacttcgacaagctccaccgcgcgctcggggacgccttcttcggcgcactgtgatgccaggacgacgccaccgcc

SEQ ID NO: 8849 - DNA, 402 bp, Zea mays
  Clone ID: LIB148-001-Q1-E1-H11
cccacgcgtccgcacgaatctgccatcctctccaacacgagtatggcgttcatcagcaatgtcgcagtgaatgcggcggccgtggccgcgctgctgctggtcgcaacggtgtcgcctgccgcgcgcgcggcggcggtggccgtggcgggaggggcgccgtcggtgccggcgggtccgctggacatcgcgcagctgggcgccatcggcgacggcaagtcggacagcaccccgatgatcctcaacgcgtggaacaacgcgtgcgaggcgacgggggtacatcagatcgtcatcgcgccgggcaactacctgacgggcgggctggaactgaacggcccctgcaagtcctccatcagcatccgtctcgacggcaacctgctcggaaccggagacctcagcgcgtac

SEQ ID NO: 8850 - DNA, 415 bp, Zea mays
  Clone ID: LIB148-001-Q1-E1-H12
gtcagatcttccaaagataaaccagccaacgctgatcatttggggggagcaggatcaggtcttcccaatggagctggcgcataggttggagaggcatcttggggagagttctagattagtagtcgtaaaaaacgctgggcacgcggccaatctagagaagtccaaggaggtgtgcaagagcatcattgactattttcaggaaccgggttcaagtgattgagttggggggaaaggatgtgaagccacaatgtgacggttggaaattctgagctaggacatcgtcctgtgattggcccgcagttttgccgtttccttggcaacttgtaattgtaacaaaagaacctttgtaatcacacggaccatacaagtctcctgtaaattgtctgaaggctttctgcgctcaaagaaacacact

SEQ ID NO: 8851 - DNA, 405 bp, Zea mays
  Clone ID: LIB148-001-Q1-E1-H2
aacacgcgtccgcccacgcgtccggttggagcagttcttgccaaaaacaatcctgacaaggtggccactctaatactggaaaatacatttacatccatactggatatggctggtattatgcttcccttcttaagatggttcataggcgggagctcttctaaaggtccaaaacttttaaactgtgttgttcgctctccatggaatacacttgatattgttggagaggtcaaacaacccattctcttcctttctggattgcaagatgaactagtcccccctccacacatgaagatgttatatgacaaagcttctgatcataacagaaattgcagatttgttgattttcctagtggtatgcatatggatacctggatgtctggaggggaccgctactggaggacaatc

SEQ ID NO: 8852 - DNA, 420 bp, Zea mays
  Clone ID: LIB148-001-Q1-E1-H3
ggacggcgcagaaggtgatcctcatcaacgacatgttcccgggccctaccatcaactgctcatccaacaacaacatcctcgtcaacgtgttcaacatgctcgaccagccgctcctcttcacatggcacgggatccagcagaggaagaactcgtggcaggacggcatgccgggcaccatgtgcccgatccagcccaacaccaacttcacgtaccactggcagcccaaggaccagatcggcagcttcttctactaccccagcaccggcatgcagcgggcggcgggcgcctacgggctgatcagcgtccacagccgtgacctgatcccggtgcccttcgacacgccggccgacgacttcccggtgctcatcggcgactggtacaccaaggaccacgccgtgctggccaagaacctggacgccg

SEQ ID NO: 8853 - DNA, 411 bp, Zea mays
  Clone ID: LIB148-001-Q1-E1-H4
ccgggtagatccaaatgtctgcacaacttcacctgtgtataaagggacgtttctcatggttgctacaagattaaggcgtggtccccatactgagtacattatatctcttgatgcagaggacttatcacaagggagcaattcatacatgggaaaactgagatctgatttctgggggacaaacttcaaaatatatgatagcaagccaccatatgacggcgctaaagcatcaagtagtcgatctagtcgtcgtttcggaagcagaaggattagtccccaagtatcgtctggtaactatgaaattggacaggtttcatacaaatacaacttgctcaaatccagacgccccaggagaatgaattgcactcttgaatgcccttcagcgcaagagacctgggaaaactcactcaagac

SEQ ID NO: 8854 - DNA, 422 bp, Zea mays
  Clone ID: LIB148-001-Q1-E1-H5
cccggcgactactacatggtggcctccacgcggttcatccacgacgccaagtccgcgtccgccgtcatccgctacgccggctccagcgccccgccggcgccgaacatgaccgagccaccggccggctgggcctggtccatcaaccaggccaggtcgttccgctggaacctgacggccagcgccgcgcggcccaacccgcagggctcctaccactacggccagatcaacatcacccgcaccatcaaggtcatggtctcccgcggccacatcgacggcaagctccgctacggcttcaacggcatctcccacagggaccccgagacccccgtgaagctcgctgaatacttcaacgtcaccgacggggtgttcagctacaaccagatgggcgacgtgccccccgccgtgaacgggtccctccatgt

SEQ ID NO: 8855 - DNA, 402 bp, Zea mays
  Clone ID: LIB148-001-Q1-E1-H6
cccacgcgtccgatcagccaagagctatccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggaacacgacgcggagatcaaccactcgctcccggggacgccttcgacgccgtggtgcgcg

SEQ ID NO: 8856 - DNA, 421 bp, Zea mays
  Clone ID: LIB148-001-Q1-E1-H7
gccaagcaggtccagagatctcgatcggtcctcttgcagaaacgaggaaagaaaacatgtcttctcgctgggttagggcggaggtgtacccgctgttcgcgacgacaggggtggcggtggggatctgcgtgatgcagctggtgcgcaacatcaccaccaacccggaggtgcgggtgaccaaggagaagcgggcggccggggtgctggacaaccacgacgaggggcggcgctactcgcagcacggcgtgcgcaggttctggctctccaagcgccgcgactacatgcaggccatggacaaggtgcccacggaccctaataagtagacgacgacgatataccccaatgcatggcaagaagatatatatatcagcacaacgcaactgcatgcgatgctgcttgttgctgcaattaatccactata

SEQ ID NO: 8857 - DNA, 363 bp, Zea mays
  Clone ID: LIB148-001-Q1-E1-H8
cgcttcgacccgtcgcgcgtccgcgaccgcatctcgcgctcggtgcgccaggagctggaccagccgctcaactacgcgcgcgtctacctcgccgacacgctgccgcgcgacgtgcgccgcgtcacgtacctcgactccgacgtggtcgtggtggacgacgtccggacgctggcgtccgtggacctcgcgggccacgtggtggcggcgcccgagtactgccacgccaacttcagcaactacttcacggacgccttctggtcgcacccggcgctcaacggcaccttccacgggcgccgcccatgctacttcaacacgggcgtcatggtcatggacgtcgacaagtggcgcgccggcgggtacacg

SEQ ID NO: 8858 - DNA, 179 bp, Zea mays
  Clone ID: LIB148-001-Q1-E1-H9
aacgaatagaaaagattaagcttctatataatcattttctacacaattgatatagtagattaacatcaaactctacgtagatgtgaagataaataatgtggtaaaagtttgatgttaatctactatatcaattgtgtagaaaatgattatatagaaacgaatagaaaagattaagcttc

SEQ ID NO: 8859 - DNA, 314 bp, Zea mays
  Clone ID: LIB148-002-Q1-E1-A1
cccacgcgtccgggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaatcattgtaatgggagttatatatataactttatctcacc

SEQ ID NO: 8860 - DNA, 411 bp, Zea mays
  Clone ID: LIB148-002-Q1-E1-A10
cccgcggccacatcgacggcaagctccgctacggcttcaacggcatctcccacagggacaccgagacccccctcaagctcgccgagtacttcaacgtcaccgacggggtgttcagctacaaccagatgggcgacgtgccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggca

SEQ ID NO: 8861 - DNA, 397 bp, Zea mays
  Clone ID: LIB148-002-Q1-E1-A11
cccacgcgtccggcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaagtccgaacgggcgaacg

SEQ ID NO: 8862 - DNA, 412 bp, Zea mays
  unsure at all n locations
  Clone ID: LIB148-002-Q1-E1-A12
ctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaatgtcaaggccaagatccaggacaatgagggcatcncaccggaccagcagcgtttgatcttcgctggcaagcagctggaggatggccgcacccttgcggattacaacatccagaaggagagcaccctccacc

SEQ ID NO: 8863 - DNA, 413 bp, Zea mays
  Clone ID: LIB148-001-Q1-E1-G9
gaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctccttaccttcctttgccacgcactaattgtgtttctcaccatctggttcatctggtccaatgctgcgtcatttgtcaacaggtcacctccaaagttcccagaggtcat

SEQ ID NO: 8864 - DNA, 266 bp, Zea mays
  Clone ID: LIB148-025-Q1-E1-G6
agtgacgtccgtattaaaagctgcaagtaacatagtgataaggagtttctaaatccaaactgcgaggactgcgccattttggcaagtggcataaagacaaggataaggaagatgataaaaatggggctgaggacggtgaacatggtccggttccgatttcagtcttcatggttgcaagtgtcctcaaggagaagagagaaaaccagtgagaagaatcgagacgactgcatcatcgtatcaggatattgaacgatgtaaatgggaac

SEQ ID NO: 8865 - DNA, 394 bp, Zea mays
  Clone ID: LIB148-025-Q1-E1-G8
acaagcctctatattttttcttttattttttttggaccacagttccaccgtccagtgactactctcttatgtactctgatgaatgtctgactaatgatagatggtgcaatgctgcatagggcacaaatccaagaacacctcgtatacaacaacctaataacgaatcagccaaaaaaaaaattaaccagaagaccttattagtcaatcttgaggtcgttgcacgatcaaagattgggcgactctctttgattcttaactctttcttgttagtcaatctttaggttgcaccatccaatgaatgctgacgatgtttatgtacgtggcgtcgtggcggttaatggatgcccttgggcggttgggccgtcttcgcatgcatgggggcgaagagataact

SEQ ID NO: 8866 - DNA, 431 bp, Zea mays
  Clone ID: LIB148-025-Q1-E1-H1
cgggtcggccacgcgtctaatcgacatcatctcactccctgtgatgctcagaaccatcggcctcgcgggtgtatttggctcctacgccttcgtctgctgcttgtcgctcgtcttcgtgtacctcagggtgcccgagaccaaggggttcccgctcgaggtcataatcgagttcttcaacgtgggtgccaaagctcagaagccggagcagcatgaagaggaggagaaccacgactaacccgtatatatttggattcattaataataactgttttttctttctttctttctttctttctttctttctggattatgagttgaatgaatgatgtcgatcagagagcttgatgaccatcatgttagcgatcccatgaaatatgtttgaggacgcatttggatgtttctaaaaaaaaaaaaaaagggccggcggctct

SEQ ID NO: 8867 - DNA, 317 bp, Zea mays
  Clone ID: LIB148-025-Q1-E1-H10
actcactctccaatctcgccagtctttttttaggcctctggcaatctgcgaactttcttattcattctactagtgtggatctataattccattcaaaatatatacatgatctaaatttcatgccaaaaaaaaaaaaaaaaaaaaaaaaaaaaaaaaaaaaaaaaaaaaaaaaaaaaaaaaaaatgaaagaaaaaaaaggaggtcgctcaaaaggttcgatgcttacttaagcttgcatgcaacgtaatagctctccaataatgtcacccagattcatttcattggccgtcgtttaaaaacaacttcattgggaaaaa

SEQ ID NO: 8868 - DNA, 401 bp, Zea mays
  unsure at all n locations
  Clone ID: LIB148-025-Q1-E1-H11
gtttgacctgagcatgtcagcaagtaaggacgtgcttgcccttgcttcactcgaggtggacctctccagcattgagccagggaccacggtgactgtgaagtggcgtggaaagccagtcttcatcagacgccggacggacgacgacatcaagcttgccaacagtgtggatgtggcatccctgcgccacccagagcaggatgcagagcgtgtgaagaatcccgagtggctggtggtcattggcgtgtgcactcacctcggctgcatcccactaccgaacgccggagactttggcggctggttctgcccatgccatggttcccactacgacatatccgggaggatccgcaagggccctgcgccgttcaacctcgaggtcncgacctacagtttcttggaggaga

SEQ ID NO: 8869 - DNA, 413 bp, Zea mays
  Clone ID: LIB148-025-Q1-E1-H12
acaaaactctattcttagtaggatcacaccctgaaggggccacagccagtaccagcatatcgtcttttgaaactgattcatgtgaggtcagtgttgagcagaagaggaaaaatattccatcagtctctacagcactactacttggtggggtgcttggcctacttgaaaccctactgcttgttctctctgcaaaacctatcttaggctacatgggtgtaaaaccggactctgcgatgatgaagcccgcattgcagtacttagttctcagatctcttggtgctcctgctgttctgttatctctggcaatacaaggagtctttcgcggatttaaggatacaaagacgcctctatacgcaactgtggctggagatgcgatcaatatagttttggatccaataattatgtttgggttc

SEQ ID NO: 8870 - DNA, 442 bp, Zea mays
  Clone ID: LIB148-025-Q1-E1-H2
ccaagcctctacaaagaggcgcagtacgtggacagccctaccgggtgcaagcccgacgcggcggcactggtggtgacggtgaccgacctgtgcccgcccaacgaccagtggtgcaagccaccgcgggagcacttcgacctcagcatgcccgcgttcctccagatcgcgcaagagaaggccggcatcgtgccgatctcctaccgcagggtggcgtgcgtgaagcagggcggcatccggtacaccatcaccgggaacaagtacttcaacatggtgacgatcaccaatgtgggcggcgctggcgacatcgcggcggtgtcggtgaaggggagcaagcgcgtcaagtggacggagatgaagcgcaactgggggcaagtgtggcagaacggggaaggaactcacctgcaattcgctgacgttccgggtgatgaccagcgaccaccgc

SEQ ID NO: 8871 - DNA, 376 bp, Zea mays
  Clone ID: LIB148-025-Q1-E1-H3
cgtattataaataaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcctgtgcgtgc

SEQ ID NO: 8872 - DNA, 138 bp, Zea mays
  Clone ID: LIB148-025-Q1-E1-H4
atcgtaagcgccgcccttttttttttttttttttttttttttttttttttttttttttttttttttttttttttttttttttttttcacgccaaaattgggggggtattatttggagtatcagtataatcttgggcgt

SEQ ID NO: 8873 - DNA, 219 bp, Zea mays
  Clone ID: LIB148-025-Q1-E1-H5
ataaaaatggagacaacaacaaaactcccgtggagcccgcccggctccttcctcctcgtctccgcggcgttcctggcgtccgccgccgcgtctggcgtcaacatcggccagttcgacgaccacttgcagaagcggaaggagctcgccgaggcgtctgccagggaggcgtacaggcccgacccgtacaacgtcaccaacagcttcaacgccgccgtccac

SEQ ID NO: 8874 - DNA, 367 bp, Zea mays
  Clone ID: LIB148-025-Q1-E1-H6
actagatcgcgagcgccgcccttttttttttttttttttttttttttttttttttttttttttttttttttttttttttttttttttttttcacgcgaaagttgcgacgagattattatgagtatcattaaaaacttggacgtacagaaacaatagcagagtgagagatttggatggatcccccgcacgcgcccgcagacgtcgacctaatataatgaacaatgcgggggcggccggaatcaatgaatcatcagtaacggggtagaaatcatgtcatgtcagggaaaaaacgaagcaccgggacacacacgcatgggcatggggacaaatgactgcgtggcgaggagctgcaatccacggacgggga

SEQ ID NO: 8875 - DNA, 426 bp, Zea mays
  Clone ID: LIB148-025-Q1-E1-H7
acccacgcgtccgcgagaaccccgagaagagcatcgacaccatccacatcgacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcgggcatgtggagcgtccgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgaccgatcgcgcacggtgctgtacacaactaaaggagagc

SEQ ID NO: 8876 - DNA, 375 bp, Zea mays
  Clone ID: LIB148-025-Q1-E1-H8
cacgcgtctaaaatcggtctgataatgggatgcaccaagtacatggacatccacagcgaacctgcagctgtcatccgtggcacgaatggatccgggggcatcactgtgaagaatacagggcaatcagtcatcattgggatcgacgacgagcccatgactcccgggcagtgtaacctggtggtgagaaggctgcgcgactacctgctcgaacaggggatgtgatgacaaccccttctcctggaatgcatgttgatgatgttgctggttccaacttcgtattcagtaataacaacacagctaagagcctcctacctaccctaattgcttgagcggctcttgtccgcgccataagataccaactgttgcactgggaaa

SEQ ID NO: 8877 - DNA, 405 bp, Zea mays
  unsure at all n locations
  Clone ID: LIB148-025-Q1-E1-H9
agaagacatgttcgacttgtgaagggacgcgtgggaagctcgatcgggaggctaccgttgccgctgacacgggttaaccagtgttgagatccgcactgcagcagagcttttggtgaccctacttgctacttccacttgcactcgccggattgatgaagctcctgcatgcattgcatgcggagtcttcaaggggatttcagctggcactcatgcattcaagtaaaggctccaattcgagataccggtgcgtttcaataagcaggttcaacagtatctttcgttaaaaaaaacagctctgcttttcgggcggctgctatgtcgcactgcacagtgtggcgtancgcagcgatggcaagctaatgcctaagaaaaaaacatacgtgcatatagaaacactgatattag

SEQ ID NO: 8878 - DNA, 229 bp, Zea mays
  Clone ID: LIB148-026-Q1-E1-A1
agaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcggggg

SEQ ID NO: 8879 - DNA, 380 bp, Zea mays
  Clone ID: LIB148-026-Q1-E1-A10
tcgtgggtcgatacaagactctaatctatgtcgtcataatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccag

SEQ ID NO: 8880 - DNA, 380 bp, Zea mays
  Clone ID: LIB148-026-Q1-E1-A11
gtgaggtggctgccgccgccgccgccagcggacggcgagatacccttcggacacgacgccgtcgccttgtccttcttcgtggcgtgtgtggccgccaccgtcgcgctcgcgtcgtccatgtgctcggcatgcggtcgcaagccgaaggcggccacccgtgcagacccggccgcttcggaccagtccaccgggacgggctcgggctccgtctccggtggcggcggaagccaggaggctagcgccgcggaggcggaggaggaagtggtgagactgtcaccggagctggcgatgcacggcgccatcgacccggtgacgctgccgtcgtcgacgtcgaagcggcgcctgtccatcagcgtgagcaagaagctgagcatgaacat

SEQ ID NO: 8881 - DNA, 407 bp, Zea mays
  Clone ID: LIB148-025-Q1-E1-G4
ctgcaaggacccttgaaagggcaaggaggaggatgttccccgttccccgggccacaacaagggaattacggtccggattggccccacaaccgccctttcggaattcaaacaacaacgcccgccggttccccgccgcccgccgcatgaatcgattaattattatatatatatatatgcatgctatctactatgatcgatcgcttctcgaccttcttgcatcgatctgcatgcatattataatttatattatattgatgccacgccgcatgcaggtctttccaaggcgtacgtactatatcaaattattttaatttccttacatgtatatgtatgtgctgctgttggatacgtacgtatatatatatgttccaaggtttcccggttccggccttgttacatgcatgaag

SEQ ID NO: 8882 - DNA, 412 bp, Zea mays
  unsure at all n locations
  Clone ID: LIB148-025-Q1-E1-F11
gctcacagttcatcaacttgttgaaaacgctgatgagtgtatggtcctcgacaacgaagctctctacgacatctgcttccgcactctgaagcttgctacacccacttttggtgacctgaaccatctcatctctgcaaccatgagtggtgttacctgctgcctgcggttcccaggccagctgaactcggaccttcggaagcttgcggtcaacctgatccccttcncccgcctccatttcttcatggtcggcttcgcgccgctgacgtcaagggggtcncagcagtaccgcgccctgaccgtcncggagctgacccagcagatgtgggacgcgaagaacatgatgtgcgcggccgacccgcggcacgggcgctacctgacggcgtcggccatgttccgcgggaagatgagcacc

SEQ ID NO: 8883 - DNA, 398 bp, Zea mays
  Clone ID: LIB148-025-Q1-E1-F12
gggtcgacgcccgcgtccaggccgacgcgctgcacgtgccgcaccgcccggaggaggtgcgccgcctagtccgcctcaccttcgcgcgcccgcccctcatcatgccctcctgcttcctatgggactacatcaaggtgatgggctctgatcatatccaggagaaagctgagctgctatacgctttgattaacgggaggcaactctgtactcttccaaaattgacccagccgacgcttataatctggggagagcaagatcgggtgttcccaatggagctggctcacagattgaatcggcatctagaggggaattctcgattagttgtcataaaaaatgctgggcacgcggtcaatatcgagaagcccagggaagtgtgccggagcatcattgagttcttc

SEQ ID NO: 8884 - DNA, 384 bp, Zea mays
  unsure at all n locations
  Clone ID: LIB148-025-Q1-E1-F2
tttattcttatcagcgctggtttcaaacaaccgaattttaaccttcattgaccggggggttaataacatgtcccaacagttaatatacagaatccaaccaataaaaaaatgtcaggaaaaaaaagaaaagaaaagtaattcaagggcaacagacatctccaggtacgagctgtgcctccagccctccacagnacatccgaaatgcaggtcaagatctacgctcgcgcatccaaaccaaatcccttctggtcttctggaggttctggtcgtgggctccccaccgacaatgaggctgcgccggaatcacggagcggagcggagatcgccgcgccggaatccggacgaatccatcagatggtccggccgattcgcgcgagctccttt

SEQ ID NO: 8885 - DNA, 419 bp, Zea mays
  Clone ID: LIB148-025-Q1-E1-F3
actcgtcggcccacgcgtccggccacatcacatacaggaaagcaagcaagaatcatcggaataatggcccgtgcatgcgtgttcctcgtcgtgctcctcctggccgccatcgcggtggcaccgttcgcgggcgccgcacgcgtggacgttgtggagggtaggtccatggcatccgccgatgcaccggaggcggcggccgatgctcccgctcctagccccgactccgcctcatccccagactcgtcatcggaggcgccctctagcagcagttcctccgactagacgcaaaaacctcttcattctctggaataactaacagtatatacgttgcaccctgatgatatagaaacatgtacgtgcatcagtgtatggaatgcgagtggcaaacacatggaatgtgcttgccctaatattggtta

SEQ ID NO: 8886 - DNA, 432 bp, Zea mays
  unsure at all n locations
  Clone ID: LIB148-025-Q1-E1-F4
acctgagcctccgtttgcggtgcgacagctcctccaggaccggcccccgcgcgcgtgccgtacgtgccagggacgacgccgggcggccgatggagttcacgtcgtcctacttccacgccttcggcaaccccgacctcgcggcggtggtctccggcgacggcggcagcgcgcaggcccaccggccgcgccgctccaccgacggcgcgaaggcggaggacggcaggagccccaccaccacaacggcgaggcgcgcgccgtccatgttctgcgtccccgacacggaggcggaggagcccaacggcttcctggacgagtgcaccctctgccgcaaggcgctctgcggcgacatcttcatgtacagaggggacacgccattctgcanccgacaatgcaggagggagcagatcgacatgggacgcataaggcaccggg

SEQ ID NO: 8887 - DNA, 392 bp, Zea mays
  unsure at all n locations
  Clone ID: LIB148-025-Q1-E1-F5
acttgatataaaccagcatgtcaataatgttaaatacattgcgtggattcttgagagtgcaccgattactatttttgagaatcatgagctggccagcattgtgctggattacaaaagggagtgtgtccgcgatagtgtgctgcagtcacacacctctgtccatgaggattgcaacattgagtctggagaaacaaccttgcactgtgagcatgtgctgagccttgaatcaggtccgaccatagtgaaggcccggaccatgtggaggcctaagggaaccaaggcccaaganacaccggttccatcttcattctgatttttgtcagatgttcgagatggtgactttggcagcaaactatctggcagaagatcagaatggttactagcatcctcta

SEQ ID NO: 8888 - DNA, 367 bp, Zea mays
  Clone ID: LIB148-025-Q1-E1-F6
caagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaa

SEQ ID NO: 8889 - DNA, 395 bp, Zea mays
  Clone ID: LIB148-025-Q1-E1-F7
actccctctatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctg

SEQ ID NO: 8890 - DNA, 359 bp, Zea mays
  Clone ID: LIB148-025-Q1-E1-F8
agcatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagcca

SEQ ID NO: 8891 - DNA, 415 bp, Zea mays
  Clone ID: LIB148-025-Q1-E1-F9
aaaatcagtcatgcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtgacgtggcgt

SEQ ID NO: 8892 - DNA, 401 bp, Zea mays
  Clone ID: LIB148-025-Q1-E1-G1
tacacctgcctccatgcctacataggtgccaccgggatttctcttgcggttgcttggcccagatctgcggcgcattcggcgtttctgatctcgcgtgcacctcgtttccctcggcggtggatcagtggcggcttggtcgagatgggcgatgcggttgatgacatcatctgtgcaacggatgcggcggtcgccgtcgaggatgcggccagtgggaagcccgcaatgctctctagcttaggggggcagggtgaggaagagcatgaggagaaggacaatgaggacaagtcaggcgagagcgaggtgatcaacccgccagaagacgctggcggggaaggcacctcacccctggaagggttgaagcctcgcctttccaaggggaatcaaagccatgggcctaatgc

SEQ ID NO: 8893 - DNA, 331 bp, Zea mays
  Clone ID: LIB148-025-Q1-E1-G10
ggtcgagcacgcgtctaccgccacaccatgtcgcgcgcccgcgtcaggacggtcaaggacctcgccgaggaacgggcctcagtgctcgccgccagcagcaaggtctctgatgaggcggcggcggcggctaccgcggtgccgcctgcaggtgccaagacctccagcagcaacgatgcccgcgacggcgccatgggcaacgtgcaggacgagccgcggcagcagcgccacgatgactatcaccaccccgagatcgtccccgagaagatcatacacgaggacgcgttgccggtcgttgctgcggagaaggagactgccgccgccgccgcaacct

SEQ ID NO: 8894 - DNA, 415 bp, Zea mays
  unsure at all n locations
  Clone ID: LIB148-025-Q1-E1-G11
gtcgacacacgcctctacatctattcgtggcagccctcactctttagacngtgaggaggagcacaattctgatcagcatctggcagcaagtgtcactgagangttaatanacctgttggctcagcagcaagaagagcttcgtgcgctgcaaaggaaacacaaggcggacatagaggagatgctgaaaatcgtacctgcggaggatcgggaagagaccttaactctatgccgcttgaaggcggaacagaaaaacagagccgccgaaccttagataaactgtctcatgtgcatgttcctctgtgtgctgttagatttatacatactcacaccaaggagttgttgtttacactttacagccgttgttgtgcaaaagttggacatctgttgtgcagaagataagtctgaagcctttttc

SEQ ID NO: 8895 - DNA, 341 bp, Zea mays
  unsure at all n locations
  Clone ID: LIB148-025-Q1-E1-G12
cgcccacgcgtcggtctcaccctccctccctcacacagataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcangcacttcggcaccggcaag

SEQ ID NO: 8896 - DNA, 436 bp, Zea mays
  unsure at all n locations
  Clone ID: LIB148-025-Q1-E1-G2
gccgaccaacccgtccattcacaacatgcgaagaacaaggtccattacataaaattaaagttccaaaaccaaaactgaaaggactgcccaattttgcaaattggaataaggacaaggataaggaaaatgataaaaatggggctgaggacngtgaagatggtccggttccgatttcagtcttcatggttgcaagtgtcctcaaggagaagagagaaaagctgttacaagaagccagaggactggatgatcttatcaggatattgaacgatgtaaatgggaacttagatgctaagaaagcttgcgctggagcattgaaacttcacaaaaaatacctgaaaaaggtacaagcaaagaaaccttaaacgtgccatggaacacacgttcccaatggggctaaccttacaatttcacatacacgacaatttccacacacaac

SEQ ID NO: 8897 - DNA, 412 bp, Zea mays
  unsure at all n locations
  Clone ID: LIB148-025-Q1-E1-G3
acgctactatgttcctcggcaacaccaacgggaaaggcttaaccctctcccggtacttcagggtgtccaaatcctacaacaaggaggttcccaaaaattccaaggagtccataatgaagttttccaaggacaaaaccaaaaaggtaaaagggttcacgtcagaatccactgtgagctacagagatcggctgaagatcatggccggcctggtcaaaccggacgacctcaagctgggctctaccgaaaagaagctcgtccaggcgtacaacgagaaaccagtcctctcgcggccccagcacagcttctacgaaggagaggactaccttgangtggaccttgacatccaccggttcagctacattgctaagaangggctggactcgttcaaggcacgcctcaagaacggcatcct

SEQ ID NO: 8898 - DNA, 369 bp, Zea mays
  Clone ID: LIB148-025-Q1-E1-F10
ggtcgaggccagcctctacagtcactcgggtcacggagatgcacgcgcgccggcccgtcctgcagggccgcaccgaggtcgagcagatccacaggatcttcaagctctgtggctcgccgcgcgaagacttctggcgccgcttggggctctcccacggcgccgtcttccgcccgcagcaaccttacccgaaccgcctccgggacaccttcgccgcgtccatgcccgaccacacgttccgcctcgtcgccacgctcctcgccctcgacgctgccggccgtggcaccgccgccgccgccctcgacgccgagtacttcacgacggcgccatacgcgtgcgatccggagagcctgcccaagtacgcgcccaaca

SEQ ID NO: 8899 - DNA, 433 bp, Zea mays
  unsure at all n locations
  Clone ID: LIB148-025-Q1-E1-D4
ctctacagtcactcgtgcaagcacacaagaacaaatacctcgccaccaacaatggcctccaggtcctccatcctacttgcaacggcgatgctggttgcgctgtttgcggttggtttgtgcaccaccccgctcaccttcaangttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcnacacctacaagaacacactcagcatctaatcagcctctgatgatgaat

SEQ ID NO: 8900 - DNA, 433 bp, Zea mays
  Clone ID: LIB148-025-Q1-E1-D7
actcgtcggtcgacgcacgcgaccagcaccaatgaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctccaaggtgatcagaggaag

SEQ ID NO: 8901 - DNA, 417 bp, Zea mays
  Clone ID: LIB148-025-Q1-E1-E1
agtcaccgtcaaagacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattacatgctatccattggtaacgcacaacagtaaaatgacagacatccgacagctatattaggttcgacggtgtaacaccctgaatttgagggtataaaattttttctctaaatacaaccaaaatcaggtgtaacctct

SEQ ID NO: 8902 - DNA, 392 bp, Zea mays
  Clone ID: LIB148-025-Q1-E1-E10
cacggagcgcttctccgacgagctcaagatcggcgagggcggctacggccccgtctaccgcgcctccctggaccacacccccgtcgccatcaaggtgctccggcccgacgcgcaccaggggaggaagcagttccagcaggaggtggaggtgctcagctgcatccgccaccccaacatggtgctcctcctcggcgcgtgccccgagtacggctgcctcgtgtacgagtacatggagcacggcagcctcgaggaccggctgttccgtcggggcggcacgccgccgatcccgtgggcgcagcggttccggatcgcggcggagatcgcgacggcgctgctgttcctgcaccagacaaagccggagccgctggtgcaccgggacctgaagccgggca

SEQ ID NO: 8903 - DNA, 422 bp, Zea mays
  Clone ID: LIB148-025-Q1-E1-E11
aatactctatactgacgtcgtattaaactggtgctttcagatatttcaggctcttgcttacatgcatcagaggggctactttcatcgtgacctcaaacctgagaatctgttagttagcaaagatgtcataaagctagcagactttggtcttgcaagggaagtttcatcattgccgccatatacagaatatgtctcaactcgctggtatcgggcaccagaagtattgctccagtcatctgcttatgattctgcagttgatatgtgggcaatgggtgccataatggctgagttgttgacactccatcctctctttcctgtaaccagtgaagctgatgagattcacaagatatgcaatgtcatcggtagtccagatgagcaatcttggcctcaaggattgtcacttgcagaagcaatgaagtatc

SEQ ID NO: 8904 - DNA, 415 bp, Zea mays
  unsure at all n locations
  Clone ID: LIB148-025-Q1-E1-E12
ggtcgatgccagcctctacaggcactcgcactatggacggccaggggaccgccgtttatagcaagagcaagaccgacaacgtgaaggcgatgcccaacacactggtgctgtttcacgtgatcaacgccactgtcgccggaatcaaactactcaactccaagttcttccacatcaacatcgacaactcagagagcatcaccgtgaaggacgtgaacgtcaccgcgcccgccgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcggccccgggcaaggcatcagcgtcngctgcctaagccgctacaagga

SEQ ID NO: 8905 - DNA, 425 bp, Zea mays
  Clone ID: LIB148-025-Q1-E1-E2
ctctagagaaagtcgtcagattcgcggtggtgttcccggagcaaaggtacgagatcgtgaaccggcggaaggaccggaacacatctgcggcattaccgggacggcgtgaacgacgcgcccgcgctgaaaaaggcggacatcggcatcgcggtggacgacgcgacggacgcggcccggagcgcgtcggacatcgtgctgacggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaaccaacggaacatcatgaccatctccaaggaccgcgtgaa

SEQ ID NO: 8906 - DNA, 371 bp, Zea mays
  unsure at all n locations
  Clone ID: LIB148-025-Q1-E1-E3
agccgtcgccgaggtcgccgcgcaccgcctcatcttcctggactcgcgccactccttgtaccagggcctgtacgcccgcagcgtggcggacgcccgcatccgccccgcgctccgcctgctgaagcagaacctgtcgttcctggtgtccgtgctcgcggaccgcgcgcagcccgtggcggtgcgggaggtgatgcgcgcctccttcgaggcgttcctgatggtgctcctggcgggcggcaacgagcggagcttcgtgcgcgccgaccacgccacggtggaggaggacttccggagcctgaggcgcgccttctccacgtgcggngaagggctggtccccgaggacgtggtggcgcgggaggcagagacggccg

SEQ ID NO: 8907 - DNA, 384 bp, Zea mays
  Clone ID: LIB148-025-Q1-E1-E4
aagcctctagatcgagtcttgctacgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcgggggcgctggtgg

SEQ ID NO: 8908 - DNA, 362 bp, Zea mays
  Clone ID: LIB148-025-Q1-E1-E5
accgtccatcatcctgcttctcctgctcattgtgaccaccgatgtggcgcaggctgtcatggaatgcaacatggacaccgagcgattccttggggcattcatggtctccgccaactgccccaacgtgtgcctcggtgaaggcttctcctgcggcatgtgcatcaccttccacagcagctgcatctgcactaagccgtgctacattaactgactcccggcagttcgatggtggacgtttattctagttactggcatacgtgattttttccccactaacagtcacacgacgcacgtgctggcatgtacgttgtgtagtacatgcatgtcttgctggcttcagttgctgactagtgatgagttgt

SEQ ID NO: 8909 - DNA, 370 bp, Zea mays
  Clone ID: LIB148-025-Q1-E1-E6
ccacgacgccgcggcgcacggcggcggcgcgatccgggactcgcagcaccactggggcgtgcgcggggagagcgacggcgacggcgtctccgtgatggggtccagcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcac

SEQ ID NO: 8910 - DNA, 417 bp, Zea mays
  Clone ID: LIB148-025-Q1-E1-E7
cggacgcgtgggctaatccaagacaaaacatggctgtgaatgtgagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatg

SEQ ID NO: 8911 - DNA, 429 bp, Zea mays
  Clone ID: LIB148-025-Q1-E1-E8
ctcgcgggtcgatacaagcctctacacagacgtcgtgtgaagagagaggcagaggcaggcggccggtgcatgcatgccccgccctccctccgtgcgcccccgaagacctcctccgcccccggcgcggtgagctcgtgaccgcccggacggcacccgcctctgcggtttgaagctcgctgcaagcactccaattaaacaaaagaagccaccatggcgttcaattctccggaggagatatggggggacatctaactgtgtaaaatatcggtggaggaggtgttcacgacactgaaatgcgaccgcaaggggctgtctagcacagagggcgagaaccggctcatgacgttcgggcccaacaagctggaggagaagaaggagaacaacctcctcaagttcctgggcttcatgtggaacccgctctcgtgggtc

SEQ ID NO: 8912 - DNA, 427 bp, Zea mays
  unsure at all n locations
  Clone ID: LIB148-025-Q1-E1-E9
acaatactctatactgacgtcgtagtaagcgggtggtcggcgtctcactatccaccaccgcgccgctccggtttaatttctcctcgaccggccagcgcaattctgtgcctcgatcgatcggtcgtaaggcaagtgagcaagctatatatatatatatatatatatatatataggagattcttcgagcgagctagtagcgagatgggttccgccgtcctcttttactgcatctgcatcgccgccgtcgtcgcattgtcgtcgtccatggtcgccgtcgggtccgccgccccgggggaaaaccccaagttcatctcggcgagcgcccttgagtgctccgctaacgtaacggaaatagcaaaggcgcgcaagctgatcgatgtcaatggccacgggctgtgcccngtgcggttcgaccacacgcgcggga

SEQ ID NO: 8913 - DNA, 349 bp, Zea mays
  unsure at all n locations
  Clone ID: LIB148-025-Q1-E1-F1
agttcgagatcgcgaacggccaccctttttttttttttttttttaatttcaaacaacaaacttattcatgatttgtcatagttctgggtagtacgcacacacaacacaaccggtccattattaaaccaacactgacacgaacagcagatacttcgacaacctccatatggagagggcaccagacgacgcaggcacatcggcagcttaaacgacccatgacttactgaccaccnacggagacggagcacaaagtggagggtgctctccttttgggattttgtagcctgccagggtgcggccatcctccaactgtttgccggcgaggatcagacgctgctggtccgggggg

SEQ ID NO: 8914 - DNA, 402 bp, Zea mays
  unsure at all n locations
  Clone ID: LIB148-025-Q1-E1-D3
aaacacgcgtccgaaatccctgcgattcctctcccctcgcctcctcgtctccccctaagggatcctccggaaagaattcacaaaaagggccgcctaatccaatttaaggaaccaatgaacaaaaagaagcttggttccaagccccccaaggaaccaacctccgcatcaataactgtggcttcttcggcagcgcggcgaccatgaacatgtgctccaagtgccacaaggagatgataacgaagcaggatcangccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggac

SEQ ID NO: 8915 - DNA, 379 bp, Zea mays
  unsure at all n locations
  Clone ID: LIB148-001-Q1-E1-F4
cctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcgtccctgcggcacctgcaccgacgcctcccgacgagccagcagcggcagctgaggaagaagccgacgcagctgcagatgccccttcagcanatggagcctcaagctccacaaactcaaagaatgcagcgagcttactgcgtctcatctgcgcattgctg

SEQ ID NO: 8916 - DNA, 405 bp, Zea mays
  Clone ID: LIB148-001-Q1-E1-F5
gtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattca

SEQ ID NO: 8917 - DNA, 408 bp, Zea mays
  Clone ID: LIB148-001-Q1-E1-F6
cccacgcgtccgcggagcggatcatcgcggaggtgatgcatacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctcgccggggacgccttcgacgccgtggtgcgcgccaagctggccctggagctggagtgccccggggtggtgtcctgcgccgacatcctcgcgctggcgtcgggggtgctggtcagcatgaccggcgggccccggtagccgattccgctggggcgcaaggactcgctgtcgtcgtcgcccacagcgcccgacgtcgagctgccgcacgccaacttcaccg

SEQ ID NO: 8918 - DNA, 395 bp, Zea mays
  Clone ID: LIB148-001-Q1-E1-F7
cagagacgttccgctgagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccgagttccacgaagtcggagcacgacccggagatcaaccactcgctccccggggacgccttcgacgccgtggtgcgcgccaagctggccctggagctggagtgccccggggtggtgtcctgcgccgacatcctcgcgctggcgtcgggggtgctggtcaccatgagcggcgggccgcggtacccgattccgctggggcgcaaggactcgctgtcgtcgtcgcccacagcgcccgacttcgagctgccg

SEQ ID NO: 8919 - DNA, 410 bp, Zea mays
  Clone ID: LIB148-001-Q1-E1-F8
gtaggccctaaaaagcggggcacttcgtagccgcaagcattcttccttccttctccattccatcggtgaccatggattgaagacattgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgc

SEQ ID NO: 8920 - DNA, 373 bp, Zea mays
  Clone ID: LIB148-001-Q1-E1-F9
cggacgcgtgggcggagcttgggaaataaaggggttacatcagtgagacattgtttacattcgtcttcctcaccttcgttttgtggacatttcatcctttcatccttcacactaaacgcttcgacactgttctgatatggcgcagggtacttgccttcttatgtgcttctcagtttcttcgaataataaccttctatgcatcacagcttccaggacctaattatcattgtcgcgagggctcgccgctggcgagattagtacctccccagaatgcagctgaggtctttctgattaagttcccagcaagagtgatttacggatgtggtgacttgatattttcatcccacatgattttcagcctagttttcgtcac

SEQ ID NO: 8921 - DNA, 339 bp, Zea mays
  Clone ID: LIB148-001-Q1-E1-G1
gttgatcctatctactgggtgatacattggtgttttgacacacggatatgtcagtcctattggttgagagagcatgctggatcttcggccatatgctgtaaatcgcttgttaatttttgttctactagtacacgaagaaatcaaggaaaaaaaaccttgactacgggaagaaaatcacggccacaggggtattttaacctccttcctaatgcgcatatatctatcgaagttgagtaaactttgatataatgtattcatgggtcacgtccaaccaaccctgtgattggttgcttgtaaatttttgtggccttaatcatggcttcaatgatgtccttcgtt

SEQ ID NO: 8922 - DNA, 400 bp, Zea mays
  Clone ID: LIB148-001-Q1-E1-G10
ggcgtgtatagacaatgcaatgagagccttgttccttttagcgctcttctgtgtcgtgcatggtgagaatgcaaagtcaaaggacaacgatgcaaaagcgtccgggcccggtgggtccttcgacatcaccaagttgggcgcctccggcaatggcaagacggatagcacgaacgctgtgcaggaagcgtgggcatcagcgtgcggcggcaccgggaagcacacgatcctcatccccaagggcgacttcctcgtcggaccactcaacttcacatgcccatgcaatggcgacgtgaccatccaggtgaatggcaatctgctggcgaccacggacctaagccagtacaaggatcatggtaattggatcgagattctacgcgtggacaaacttgtcatcaccggc

SEQ ID NO: 8923 - DNA, 410 bp, Zea mays
  Clone ID: LIB148-001-Q1-E1-G11
cccacgcgtccgctggatgctagcacagcagcccacgtggcaggtccctcaagtaacaggcgagctacagttgtgcctgaagaggtttcagatgaaggagtgttccgtcgctttgtcagactacttctggccttcattgtcaaagtctttgccttctttcacatagtacgtagtcagcaggaaacgagggtcaacaacctactacctcctgccgaaccagaactgatttctgacgatcatccggcagtagagactttcaatgtagaccacatcagtcctgtcatagagcgccttcagagacttgaagggaaggtcgatgagcttggcagcaagcctccagcgattcctgtggagaaagaacgatccctcttggagtcatgggataggataaaatgcatcgaatctgacct

SEQ ID NO: 8924 - DNA, 414 bp, Zea mays
  unsure at all n locations
  Clone ID: LIB148-001-Q1-E1-G12
gcagttctaccgcaactgcatcatctcaggcactgtggacttcatcttcggcgacgcggcggcggtgttccagaactgcatcctggtgctgcgccgcccgatggacaaccagcagaacatcgcgaccgcgcagggccgcgcggacgcgcgcgaggccacggggttcgtgctccagaagtgcgagttccaggccgaggccgcgctccgggactccgggcgcccgcccatccgcaactacctgggccggccgtggcgcgagtgctcgcgcaccatcgtcatggagtcggagctcccggacttcatcgacaaggcggggtacttgccctggaacggcgactttgggctcaagacgctgtggtacgccgagttcggcaacacanggcccggcgccaacacggccgggcgcgtcagctg

SEQ ID NO: 8925 - DNA, 412 bp, Zea mays
  Clone ID: LIB148-001-Q1-E1-G2
cccacgcgtccgcccacgcgtccgggttcagatgccctgaggtcctcttccagccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccgtatgagcaaggagatcactgcccttgcgccgagcagcatgaaaatcaaggtggtggcaccgcctgagaggaaatacagtgtctggataggaggatccatccttgcctccctgagcaacttccaacagatgtggatctcaaaagctgagtatgacgagtcaggacctgcgattgttcatcggaagtgcttctaagctctgggtcccccttcggc

SEQ ID NO: 8926 - DNA, 413 bp, Zea mays
  Clone ID: LIB148-001-Q1-E1-G3
caagcccttcatcttcgtgaggggcaacggcaaaggccggacctccatctcccacgagtccgcctcttccgacaacgccgagtccgccgcgttcaccgtgaactcggacaacgtcatcgtcttcggcgtcagcttcaggaacagcgcccgcgtcggcctggtgaacgacccggagatccgttccgtggcggcgatggtggccggcgacaaggtggccttctaccactgcgcgttctacagcccccaccagaccctgttcgacagcgccggccgccactactacgagagctgcgatatccagggcaacatcgacttcatcttcggcagcggtcagtctatcttccagtgccccgagattctcgtgatgcctgaccggcggacggagatcggcagctccatcatcgcgcatgtgc

SEQ ID NO: 8927 - DNA, 420 bp, Zea mays
  Clone ID: LIB148-001-Q1-E1-G5
cccacgcgtccgcccacgcgtccggatagcgagcacccggcgtcgggcgacggtggcgccatgggtggctgccactccgccatcgcggccaccaagctgaagattctgcgccgcggaggccggggtgccgctgccgtcctccccgtcaccaaccacgacggcccgtgctgctcctccgaccacggcagcaaggagaagaagaagaaaaagaagggcgccaggaagggcaggaaacgcgcctccatcctgggcgacgccggcaccttcgacccggacttctcgcggcggtaccggctcggcgcggagctcgggcgcggcgagttcggcgtcacgaggcggtgcgaggacgccgccacgggggaggccctggcgtgcaagacgatccggcggaagcggctgctcctgcgcctcgccgggcgc

SEQ ID NO: 8928 - DNA, 392 bp, Zea mays
  Clone ID: LIB148-001-Q1-E1-G6
gtccactctcgtgtcggtcccgcgatgggcatgttcgcatcggccgcaaagagatacagcaacggcaagaattttctccgcagcgcgggcgtgtgctgttgttcgccgtccgcctccgcccagcttggtggtgtgcgcggcaaggaagagacatcgacgtcggcgccagctttcgcgccggatagcaacaagaaaaggtggaggaagaggaggttctggagaaagaagatgaaggccaggaaggagatcggcgggctggtggacctcgtcaacgatatttcggccaagtcagaggagagcctaagggttagcaaccaaaacatgcccagcagggcgctgacgttcagtcagctgagcgccgcaacggacgggttcagttcgcagaacctgct

SEQ ID NO: 8929 - DNA, 345 bp, Zea mays
  Clone ID: LIB148-001-Q1-E1-G7
cccaagcctccggtcgtccccctttcgcccgcggccccacccgccatgtcactcgcgtacacgcgcataaagtatcgctccagaaacactatggcgcggcagtcacccgtccgcctcagcgcagcgtcgggctcatgccgcatggcgccacaagccgcgggtgtccaccactgctgtggccgcgctcgagtaccgacctcgcgacctgactgggagattcaggtcacgtgcgatgacgcgaagatacgcgatgcgctcgatgctgcatatcatcaccgcaatttgcgccacttcaaaggagaacctacgggttacgacgaagagcatgccgagcaggggcctgac

SEQ ID NO: 8930 - DNA, 81 bp, Zea mays
  Clone ID: LIB148-001-Q1-E1-G8
gtcaagcctccggtcggcccccttacgggcacggtcccatcggtaggtcacacgcgtacacgcgcataaagtttcgctcca

SEQ ID NO: 8931 - DNA, 421 bp, Zea mays
  Clone ID: LIB148-001-Q1-E1-F3
ctctctcgcgcgcgcattacttgcacgtacgagctcagaaggaacgcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcagcaccatcgagaactgccagaagagcacgatcatcttcatctcctgatcgcctgacactgcacgcaccaggagcaagatgctgtacgccagctccaaggacaggttcaggagggagctggactgcatccagtgcg

SEQ ID NO: 8932 - DNA, 414 bp, Zea mays
  Clone ID: LIB148-001-Q1-E1-D9
cccacgcgtccgggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgcactcttcttttggggcaagagatttcatgtctggttcaccaacctccacaactctatcagggatgaccgctatctgattgggcggaggctgcacaactttggcgaggactcacactcacctgagcggagtgaatctggagcaagtatagggtcagatgatcaggacagagatattgtactgcgagatcaggaagaggaagtggggttgaggatgaggcgcaataatatgcat

SEQ ID NO: 8933 - DNA, 416 bp, Zea mays
  Clone ID: LIB148-001-Q1-E1-E10
cccacgcgtccgatcgatgaactgccaataaatcccacccccatcttatggaggacgttgctttctgcttgtggaggccatggagatgtcgaacttggcaagcgtgtctttgagaggattcttgagctggacgattctcatggtggtgattatgtaatattctcgaatttgtgtgcaaacactggatactgggaagagatgaatagggtaaggaaactgatgagcgacaaaggtgtggtaaaggtgcctggctgcagctcaatcgagatagataacacggttcatgagttcttcgcaggagatggaaggcaccccaaatcacaagaagcacggaaaatggttgatgaagtgatcgattaactaaagcttgttggttatatccctgatacctcacatgtgtttcatgtcgaaatggg

SEQ ID NO: 8934 - DNA, 418 bp, Zea mays
  Clone ID: LIB148-001-Q1-E1-E11
gggcaccgtggtggtgacggccaccaacgaggccccgccgccggtgagcgggcagaagggcgagcactttgacctcaccataccggcgttcctcaagatcgccgaggagaaggccggcatcgtgcccatcacctaccgcaaggtggcgtgcgagaggaaaggcggcatccggtacacgatcacagggaaccagcactacagcgaggtgaaggtgaccaacgtgggcggcgccggggacgtggtggcgctgtgggtgaagggcaacaagcgcgtcaagtggacgccgatgaagcgcagctggggccagctctggaccacggaggtcgacctcaccggcgagtcgctgacgttccgcgtcatgaccgccgaccaccgcaaggctacctcctggcacgtcacgccccgcgactggcagttc

SEQ ID NO: 8935 - DNA, 416 bp, Zea mays
  Clone ID: LIB148-001-Q1-E1-E12
gccagaaaaaaggaagactagcgatggcatcatctagcaaggacgcatcacaagatatttgcaagggcaaccggttttcgttctctagttttttcttttgcatcatggacatggaggactccggccagttcatgcagtgggcgatggctacgctgcagcacgatgaggaccaggcagtggactaccccatcgacgacggccgcggcggggctaccttcccctcgctccgagcgctccgcgaggcctcgtcgcaagctgcagaaatgatccaggaacctctcgccgccgcaaacagccgctgcgccggcgacgggggcaccgcagccgcaggcaataatatctcaggaaccgcgccaagaagaagcagcagtggtagtgccgtaatccagcccttgaggtggaattttggcgccggc

SEQ ID NO: 8936 - DNA, 411 bp, Zea mays
  Clone ID: LIB148-001-Q1-E1-E2
accacgcgtccggcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggggcgctcaactggcgcgtcggcaggaagtgctagtgcgtgtgcaactctaggctgcagct

SEQ ID NO: 8937 - DNA, 385 bp, Zea mays
  Clone ID: LIB148-001-Q1-E1-E3
ctcttcgccgcggcggcggatggccctgccgctctacggctgcaggtcctgcgctgtgcatgatgccatcatcttctgccactgctgtgacgccaggctgtgcctgcactgcgacgccgccgtgcacggggctaccgaggcgggggcgctccacccgcgcgcccggctctgcgacgcgtgcggcgccgcgccggccgcgctgcgctgcgacggcaccgtgacgctgtgcgccgtgtgcgtcggccgctgtgctcccggtgtgacccgcacccgcgtggccacgttcaacggctgttccggccctgctgagatggtgggcctcatttccgttgacccaccgcatctggagcaggactttgaggcctggctcgcagacaagctcccg

SEQ ID NO: 8938 - DNA, 404 bp, Zea mays
  Clone ID: LIB148-001-Q1-E1-E4
caggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaatgtggtgaaagggatggacgtcgtgcgcaagatcgaagccgagggccagctcaccggcgtgcccaacgccaacgtcgtcatagccaacatcgggcagctgccagcgcccgcccgcgccggccatcgtgacctctgatcgatgacgacgagaacgactcacgattcatc

SEQ ID NO: 8939 - DNA, 415 bp, Zea mays
  Clone ID: LIB148-001-Q1-E1-E5
atggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttg

SEQ ID NO: 8940 - DNA, 404 bp, Zea mays
  Clone ID: LIB148-001-Q1-E1-E6
catgaattgactgtgctggagaaggtccgacaccctaacgtcgttcagttcgtcggagccgtcactcagagcatacctatgatgattgtgtctgaactccatgaagagaaagacttatcagtctgtatccagaagataggaaagttaaagcctcagaaggtgctaagatacggccttgatattgccaggggcatgacctacctccaccagtgcaagccggaccccatcatccactgcgacgtaaagctaaagtgccagacatatcttcctggatagcggaggccagctgaagatcgcggggttcggagtgacaaggatgtccaaagtcgggaccgacaacgtgaggttgattctacatggcgctctcgtcgacagcttcagctaccacaccgcgcctgagctgt

SEQ ID NO: 8941 - DNA, 416 bp, Zea mays
  Clone ID: LIB148-001-Q1-E1-E7
caagaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaa

SEQ ID NO: 8942 - DNA, 171 bp, Zea mays
  Clone ID: LIB148-001-Q1-E1-E9
cccacgcgtccgctcaggcatccggtcactcgtacccgggcgcgtccggatacgcttccgcgcgagatggcgatagagcgctgcgaggacctcaacataagcatccgacatcgacatcgagatggacctagcacatgagcacatcgtgagcacccagatcacgctgcacag

SEQ ID NO: 8943 - DNA, 444 bp, Zea mays
  Clone ID: LIB148-001-Q1-E1-F1
tccggtactcccgggtgcccccacacgtccggaaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgttcgccatgcatcgacaacctattcttaataacgttcattatctcgttcttatttatgacgaatgtcatgtatgttctggtgactgtcatgtatattctgatgactgtcatg

SEQ ID NO: 8944 - DNA, 406 bp, Zea mays
  Clone ID: LIB148-001-Q1-E1-F10
gaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctccttaccttcctttgccacgcactaattgtgtttctcaccatctggttcatctggtccaatgctgcgtcatttgtcaacaggtcacctccaaagttcccag

SEQ ID NO: 8945 - DNA, 414 bp, Zea mays
  Clone ID: LIB148-001-Q1-E1-F11
cgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcaccacctataagaccacactcagcatctaatcagcctctgatgatgaattatatttcaaaagagctcacctggcgctcacgttagcaagacaatattttttctatggttattttgtggcgccaaaccacccaagaaatatgtgatgctacatgtcccttatgatgccttgttgtgttgggttgatattattacataaactaaataaattattcatttaagattttaggagaaatatgttgatatggtctac

SEQ ID NO: 8946 - DNA, 412 bp, Zea mays
  Clone ID: LIB148-001-Q1-E1-F12
ggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcagggaatatatgtgggcgatgataaggtgatccatttcacaagaggaagaggacaggaggtctgaacaggaactgtcgtcgatattattcttgtgagttccaccccatcacgaagcaacacgccttgcccggtgtgcaccgacgaaaccagcgacagcagcacagagacgaacggcgtggtatcctcctgcctcagctgcttcctagctgggggtgctctctaccgtttcgagtacgcagtcaacccggcgctctt

SEQ ID NO: 8947 - DNA, 374 bp, Zea mays
  Clone ID: LIB148-001-Q1-E1-F2
aactgggcttctgagcatctgaaagacaagaactacggcaagctcgtggacgcgtcgctgaaggagcacaaggaaagcgagctggaggccgtctgcgaggtgatccaagagtgcatcgaccctgacccgacgcggcggccgtcgatgagagacgtcgtgggcaagctgcgagacgctctcggcatctcgcccgaggcggcggcgccgcggctgtcgccgctctggtgggcggagctggagctgctgtcggtgaagtcaacctagtgtggagaacgctgtgtatactgatactgtaccaacatgttccaacgctcctctagctgagctctaacaggattcgtataggggcttcaattcgtgctgctgatgctaca

SEQ ID NO: 8948 - DNA, 410 bp, Zea mays
  Clone ID: LIB148-001-Q1-E1-D8
ctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcac

SEQ ID NO: 8949 - DNA, 394 bp, Zea mays
  Clone ID: LIB148-001-Q1-E1-C4
caggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaag

SEQ ID NO: 8950 - DNA, 413 bp, Zea mays
  Clone ID: LIB148-001-Q1-E1-C5
ggtgggcgccggggacgatggcgcggcggccaaggaggcgaggaggaagaactggtaccggccggccaagtcgtcgtcgtggcgcaggatccggtgctcgcagaaggagtgcgcgctgctgccctacaacacgtgccagagccccagcaaggcggagtcgtgcagctactaccagcagatgcaggacggcacgttgacgatgggcatctacggcaaggagaaggcgacggtgacggtgtcggacgggcgtatggccaagctccctggcctcatccttggctgctccgtcctggaggccggcggcagcgtggacgcccacgacggcgtgctctcgctggggaacggcgagatgtccttcgccgtccacgccgccaagcgcttcggccagcgcttctccttctgcctcctcagcg

SEQ ID NO: 8951 - DNA, 411 bp, Zea mays
  Clone ID: LIB148-001-Q1-E1-C6
ccttcccccggctctccctcctccgcgccgcgcccgttgatggccggcgggaagaggacgacggcgcgccaccaacacaaccacccaccgccgccgccgcctaaccctagccctaaccgtggccgcggggtcgccgacccgccgccggcctcggacgactcgccgtcgtcgaagcgcatgctggccttccacttcctccgcgcgctggcacggatccacagcaccacgccggcgccgcgccgcccgcgcatcatccgccgcgcggtctactcgtccatggcgcgcgccgccagcacgcgccgggcctggacgcaggcgctgctgctccgccgggcgcgctcacgcggggtggccgtcgtcggctcgtccaggcgcgcggtcctgctgcggaagcgcgtctccgcctcggcg

SEQ ID NO: 8952 - DNA, 412 bp, Zea mays
  Clone ID: LIB148-001-Q1-E1-C7
gccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaat

SEQ ID NO: 8953 - DNA, 318 bp, Zea mays
  Clone ID: LIB148-001-Q1-E1-C8
aaaacaacaaccaaagataagaaataaaaaaaataaccggcggcatcagcgtcggctcctcggacacctgtggctctgtccgcggatcgcgccagatccatcacgaccagcggctccaccgcggtcgcagtcgcgatcgtccgtgctgccttggactccttcgtcgtttaccacattcactgacttgccggactatgagcctgagccagatggaatagacgcaagtagggggacagagttggctgcgcttagctgttctgcagctcgcgcgcattcccgaaccctcggcgtgctcccacatgacacgggggtggtagt

SEQ ID NO: 8954 - DNA, 417 bp, Zea mays
  Clone ID: LIB148-001-Q1-E1-C9
atggcatgcacatacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcatcggcaagggaaaccttgac

SEQ ID NO: 8955 - DNA, 402 bp, Zea mays
  Clone ID: LIB148-001-Q1-E1-D1
gacggccaacccaaccccaccaccaccagtccccgcggcccgcgtcgaggaagaagaagggataggagacggggacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgctgccggccggggccgtggccgcggccgtggcgtccgatgccgccacggcctccgcgccgggggccagcgggaggaaggggaaggcgtcgtcgtcgtcgtccgtggttctgcgggtggccggcgggtcccccatggtcgccgcgcggaagcaggcgtccgcgcgca

SEQ ID NO: 8956 - DNA, 416 bp, Zea mays
  Clone ID: LIB148-001-Q1-E1-D10
gctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatgactgtga

SEQ ID NO: 8957 - DNA, 412 bp, Zea mays
  unsure at all n locations
  Clone ID: LIB148-001-Q1-E1-D11
gcagaaacgagagggcaggagcagccgcagtcccggcgatcccgccgccggtcgccctcacacctcctcgtcactgccttcgtttctctttccaacaatcaagatgagccgtggcggtagcgcgggtggtggtcaaagttctctgggttacctctttggaagcggtgagccccccaaaccagcagtggcaccaccagctgtaagtgctccacctgctgctgcaggtgctccacctgctgagaaaccacctgctgcaaagcctgatggcaccagtcagattgctgctggggttaccagccaaaccaataactatcacagggctgacggtcagaacaccggcaacttccttacggaccgcccttcgaccaaggtccacgctgctcctggcggtggctcttccctgngatacctg

SEQ ID NO: 8958 - DNA, 371 bp, Zea mays
  Clone ID: LIB148-001-Q1-E1-D12
gggcgaaggtgccatggttctattatcgccgcgtcttgcttcagcgaaacagcaatggatgatcccaccccctcccccctagattttactggcggctgcagcgagtcgaggcattcgagagcgatatgtttgtttcatttccctccttcccgccttgtgattatctggtgtgtgtgactgacgaggtcgtggcaatttaggtaactcgcttagaaggtatttcccccgtgtttgagcccccccacccaagaaaagaaggtatcatgctatctctgttccataagtagacatgatgtaatcgtactaagtgtttattattattttttttacttatttcacttcaatcaatggaaaattatgcttcccaagtc

SEQ ID NO: 8959 - DNA, 416 bp, Zea mays
  Clone ID: LIB148-001-Q1-E1-D2
caccgttctctcttcctctgctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccg

SEQ ID NO: 8960 - DNA, 418 bp, Zea mays
  Clone ID: LIB148-001-Q1-E1-D3
cacgacctccgccggcggccaccggcagccatgtcgcccttctacctcgctcgcggtgcttccaagctagtgagaaggattacctcggagacatcggtcgagctcaagattctatctgataaatggcggcttctcctcgctggcctcattttccagtacatacatggtttggccgctcatggggttcattatctgcaccggccgggccctacccttcaagatcttggcttcatgattcttccggagcttgggaaagaaaggggttacatcagtgagacattgtttacattcgtcttcctcaccttcgttttgtggacatttcatcctttcatccttcagactaaacgcttctacactgttctgatatggcgcaaggtacttgccttcttatgtgcttctcagtttcttcgaataataa

SEQ ID NO: 8961 - DNA, 425 bp, Zea mays
  unsure at all n locations
  Clone ID: LIB148-001-Q1-E1-D4
gctccctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcancgctaaccaggagtactgggcggagcgcgcggaggcggcgcacgcgtacaaccgcgcggcgttacagaccgaccccgtggccgtcgtgcagcgct

SEQ ID NO: 8962 - DNA, 339 bp, Zea mays; identical to SEQ ID NO: 8921
  Clone ID: LIB148-001-Q1-E1-D5

SEQ ID NO: 8963 - DNA, 356 bp, Zea mays
  Clone ID: LIB148-001-Q1-E1-D6
ccaggatgcggcgaagggatgagatggatcggcgggcgatggccggggaggagctggggaggatgacggtgcgcgggagcaggatgccatcggctaatgtggtacggacgcggccggatttggaagagcgcagctagcacgccgccgtagcggtacgctagctcctctccgagtaccttgcaccaaccggggggtctggctcctcaactgatggcaacggggagttcccctccggaaatatctcaccgtctccgtccacgcgacgaatcaacttccctgcatggatgctatgaacgctttgctaggaatatttcttccttatctctgttcctcgctgcgataaatccccaacggga

SEQ ID NO: 8964 - DNA, 417 bp, Zea mays
  Clone ID: LIB148-001-Q1-E1-D7
cggacgcgtgggcggcgccgcccgccgcccgaggtgctgcgctagcgctacggcgtgcaagagcaagcaggcgtccaagccgtgctgcgcgacggtgaagccggtggcgacgacgaggcacaggcacgggcacgggcacgggcacgggcacgcaggcgcggggaagcccgggacgctaggaggcgacaagcagggtaaggactgccatggttgctgccagaaggagagcaagccgcccgaggacgccgtcgtgatcgccattccgggacgggccgtggagcaccggaaggaggccttccctcacgagaacgcgggagccggggggtgctgcgctgcagcgcacggtgccgaagacgaggtatgcattgtcatcagcgccaggtcgccctgctgcagcaccgcgaggagtcggtctgg

SEQ ID NO: 8965 - DNA, 335 bp, Zea mays
  Clone ID: LIB148-001-Q1-E1-C3
aactgagtcgcagcagctaccggccgggcgggcgaggacatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagatccgacctgcaggacgaggcaacagctaccgtaatagccaaagccgaagcacaagaggcttcagctgaaggtggcgatta

SEQ ID NO: 8966 - DNA, 396 bp, Zea mays
  unsure at all n locations
  Clone ID: LIB148-025-Q1-E1-C1
cacgcctccacagcaatccatcctgagtgctgtacggcaggatccagtgcacaggcaagtgcaccgagcagaagggcatcacggcgccggccatgaaggtctgccaggangagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaagcgctgagcgagtctatacgtacgtcgtcaccggctggccacgcatgcgataaccatctgatatggacggaactatata

SEQ ID NO: 8967 - DNA, 354 bp, Zea mays
  Clone ID: LIB148-025-Q1-E1-C10
cctagactgagtcgtatgagttctgttccgttcggaagatgttcttggagagcttccgggtggagagcccgcgggtgaagtacggcgacggcgagatccagtcggagtaccgctacgacaccaccgaagtcgtcccgccggggaatggcggcggcgcggggtgggtggtgcgcccaaagtccgtcacctacaacttcaagaccagcaccaacgtcccaaagctgggggtgatgctcgtcggatggggcggcaacaacgggacgacgctcacggccggggtgatcgccaacagggaagggatttcgtgggagacgaaagagaaggttcacaaggccaactacttcggctccctga

SEQ ID NO: 8968 - DNA, 268 bp, Zea mays
  Clone ID: LIB148-025-Q1-E1-C11
gcgtccacgcaaagcctccccgtgtcccctccttcccgcccggcaccgtcaacctcggcggtggaaacagaacagacccaccaaccatggcaaactcggcgtcgggaatggccttgaccgacaattgcaagctcaatttcaagaagctcaggtcaaagcgaagcttccggttcatcacgttcaagatcaacgagcagacgcagcaggtggtggtggacacgctggggcagccgggccacacctaagacgaattcaccggctccatgcc

SEQ ID NO: 8969 - DNA, 423 bp, Zea mays
  Clone ID: LIB148-025-Q1-E1-C12
cgggtcgacgcaagcctctacatggattcctgcgacacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacga

SEQ ID NO: 8970 - DNA, 447 bp, Zea mays
  Clone ID: LIB148-025-Q1-E1-C2
aggacgttacaacaccctacagtgacgtcgtagtatctcccacagggacaccgagacccccctcaagctcgccgagtacttcaacgtcaccgacggggtgttcagctacaaccagatgggcgacgtgccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagccgtcgggtcaacgtctgggagcggtactacctcgggga

SEQ ID NO: 8971 - DNA, 328 bp, Zea mays
  unsure at all n locations
  Clone ID: LIB148-025-Q1-E1-C3
gaggtcaaaaccttgggatttgtgcggcgggacctttaaaccggtcgcaagccgtttgaccacaaactgccccgtgggcagcagagccttgtgacatgggctacaccgaggcttaatgaagacaaggtgaggcaatgcgtcgattccaggctcggagacgaatacctccaaaggctgtagccaagatggctgctgtggccgccctctgcgtgcaatacgaggggtaattccgtcncaacatgagcatcgtcgtcaaggctctgaaccccttgctgcacagccggtctggcaaccgccctactgcctcgtcggcctcccacgctgccgc

SEQ ID NO: 8972 - DNA, 412 bp, Zea mays
  Clone ID: LIB148-025-Q1-E1-C4
ctcgcgggtcgacacacgcctctagggaaattcatgctctagaagctcagcagcaatggcggagcaggcgggcgccggaaggtactggtgccacatgtgcgccgcggccgttagccccgcggagggcgaagtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttc

SEQ ID NO: 8973 - DNA, 398 bp, Zea mays
  Clone ID: LIB148-025-Q1-E1-C5
gggccgacccacgcgtccagaccgactggccggacaacccaaccccaccaccaccagtccccgcggcccgcgtcgaggaagaagaagggataggagacggagacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgcggccggccggggccgtggccgccggcgtggcgtccgatgccgccacggcctccgcgccgggggccagcgggaggaacgtgaatgcgtcatcgtcgtcgtcggtggttctgcgggtgccggccgggtcccccat

SEQ ID NO: 8974 - DNA, 389 bp, Zea mays
  Clone ID: LIB148-025-Q1-E1-C6
acggacgcgcgggcgacgtggggagtcgccgcgaggtactgccgccattattcccgatcggtggtgtgcgcacggtcgtgggaccccgctggtgtcgccagatcgcgttggagtcggtgcgtggagagaagaacggtctcggtggccgtattcgctcgccgccgccgcgacttcgccccacgccgtggatcactccctagccgccatctctacctacgtgaggtcacgagaatctgaagaatcatcctggtacctggaatctcaagtctcaggtcaagaacaggtaccataggatgaggcgcatggaggatgctgcgatgtgttcgtaagaggtctaggccgtcgtctcccagtcaactttgggttgctggatcgtttcctcatatgat

SEQ ID NO: 8975 - DNA, 450 bp, Zea mays
  Clone ID: LIB148-025-Q1-E1-C8
ctcgtgggacgatacaagcctctacactgagtcgtatactggccgcacccgcaatggggtgcgcggcgtcggccgccaacggggccgggccccggcggcgggggtgggcgcgggcgcggatgcggcggtacagcgaggcgtccacctcgggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggccgacgccgacgccgccgacgccgatgactccgtcagggtcagagccacggtgcctcacctgaacaacaggtgcaaaatcacggcgaccaaggcacacgattcta

SEQ ID NO: 8976 - DNA, 360 bp, Zea mays
  unsure at all n locations
  Clone ID: LIB148-025-Q1-E1-D1
gtgagtcggaatgactactggatcgtccggaactcgtggggcccgaagtggggcgaggctggttacatccgtatggagaggaacgttaacgccagcactgggaagtgcgggatcgcgatgatggcgtcctacccgacgaagaagggcgcgaaccctcccaggccgtctccaaccccgccaacaccgccggctgcccctgacaatgtctgcgacgagaacttctcgtgctccgcgggcagcacctgctgctgcgcgtttggcttcaggaacgtctgcttggtctggggctgctgcnctgtcgagggcggcanctgctgcaaggatcacgcnagctgctgcccgccgggctaccctgtctgc

SEQ ID NO: 8977 - DNA, 415 bp, Zea mays
  Clone ID: LIB148-025-Q1-E1-D10
gggtcgagccagcgtctaatcccagtcgcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggtgactgtcatgtatattctgatgactgtcaagta

SEQ ID NO: 8978 - DNA, 309 bp, Zea mays
  Clone ID: LIB148-025-Q1-E1-D11
cacgagctcgcgccatcagctcggggctacggcccacgtgccagtggtcagtctggagctgacggggctgcccggcgcagcaacagtccgaatacccggacaaggcagtcctggaatacgtgctgcggaccgtgggaacattcccgcccatcgtcgtcgccagcgaggcgcgcaccctcgaggagcgcctcgcggaagccgcagtcgggtgggccatcatcgtctatcgatgcgactgcgccgaaagcttcaacgagttcaacgccaacaatatcacggagaccttccgcgtcctcctggaaatgtccg

SEQ ID NO: 8979 - DNA, 74 bp, Zea mays
  Clone ID: LIB148-025-Q1-E1-D12
agccacagtcggcctactcagcgactcctaccgctggggcaacccgaccgcgacgtctgcgcgccagctgtcct

SEQ ID NO: 8980 - DNA, 408 bp, Zea mays
  unsure at all n locations
  Clone ID: LIB148-025-Q1-E1-D2
ctcgtccctccctacccgcggccggccacccacgccgttgctgctgttctggcgcgccctccacctcttctctcgaatgtgccgtcgtcggagcttgcttttggggaggtcgtgcggcatgatctgctgaccgccccaaatcaacccggccgcgcatcgaccgtcgtcatccagtccgacgaggangangacgagagggagatggggagccacagaactaagatgtcttgctgcggtggcgccgaggaggacagctacggcccgccggccaaccaggcggttccaccacccaatgccaacgcccccggcaacagaggcgggccgagaggaccgggggcgccgatggtcggcggccccgccaagcccgtcagcattgacgtgcccgccaataccctttgacgagctcaa

SEQ ID NO: 8981 - DNA, 426 bp, Zea mays
  unsure at all n locations
  Clone ID: LIB148-025-Q1-E1-B9
cgtccgggagaaggggaagggcggcgagggaagggctccgcgtcgtgtcncttctcttcctcctcctcctcctcctctctccaacaccccatccatcagcgctgccctccgcattgctcttgatcccatccagtacatcgattctccccccaagatcaaaggccggaggaggaagaaaggttanggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctgggagagctgaaggaaattacanaaaacttcagcagtgatgccctca

SEQ ID NO: 8982 - DNA, 401 bp, Zea mays
  Clone ID: LIB148-025-Q1-E1-A12
agtgactcgtgctacgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaacgacctgtgcccgccca

SEQ ID NO: 8983 - DNA, 125 bp, Zea mays
  Clone ID: LIB148-025-Q1-E1-A2
ccgcccaagcctccgccccggaaccaaaaaaataaaatggcccccggtccccggtccccggcgccggttaacgccctccccgattcgaaggcctcgcctccgccggggggccgggccaacccgga

SEQ ID NO: 8984 - DNA, 317 bp, Zea mays
  Clone ID: LIB148-025-Q1-E1-A4
acgtcgtacgagaaaccttctccctcctccaaccttcctcctttccttgcaacggaaaaaaaccttcgccggcaaaagcatggcaatggcttaccgtgtcctggaggtcaccctggtgtcggaaaatgacctcaaaaaagtgtcgctcttctcccggactcgcatctacgccgtggcttccatctccggattcgacctccgcatcccttccaacagcacccaagcaggacacagcaacggctgcaacccctgctggaaacccgtggtacacttccccatcccggctgccgctgacacccgcgggctcgcactccacg

SEQ ID NO: 8985 - DNA, 396 bp, Zea mays
  Clone ID: LIB148-025-Q1-E1-A5
gggtcgatacacgcgtctagggttcgcactatcaaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcggga

SEQ ID NO: 8986 - DNA, 404 bp, Zea mays
  Clone ID: LIB148-025-Q1-E1-A6
gttgcaagactctagactgagtcgttgagatcgagttgtttcactgcacgagcacatcctccggcgaccaccggcctccctctccgtcctctagcgaccgaccaacgcgtcgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatccgggggcatcactgtgaag

SEQ ID NO: 8987 - DNA, 351 bp, Zea mays
  Clone ID: LIB148-025-Q1-E1-A7
caccggcgtagctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggagccccctgcgtggccaagctcgtcaaggtcgtcgcagcgcggccgtactctgtgtccatcatggagatcagcgagcccattttgccggccgcgttgccctcccccgtcgcggcgcccggccgccgcggcaagggtggtaagcgcaaga

SEQ ID NO: 8988 - DNA, 319 bp, Zea mays
  Clone ID: LIB148-025-Q1-E1-A8
tagactgactccactgagcgccgataaggtgcgggcggcagtagagaaccacgtggctctcagttacttcggccctatcaagccggacgacatgaagacacgcatcgccatcctccccacgcgtgctctcagtcatcgacaggggcatgcaggtcctcaactacaccagggccgacgacgggcagatgtacttcgtcgctcccggagcgccctgcgtggcgaacctcgtcaaggtcgtcgcaacgcggcgctagtctgtgtccatcatggaagatgagcgagcgcattttcccggcctgcgttgccctccaccgtcgcg

SEQ ID NO: 8989 - DNA, 397 bp, Zea mays
  unsure at all n locations
  Clone ID: LIB148-025-Q1-E1-A9
ttgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgangttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaagaggaagttgtggagaagaccgtcatcgagaangagaagccatcagcagtccatgcagaggaaaatatt

SEQ ID NO: 8990 - DNA, 305 bp, Zea mays
  Clone ID: LIB148-025-Q1-E1-B1
tattcacgggacaacacactagactgatgctcgtatagctcgccaaaataatgaagaggcccaccatggcatcatacgtcgctcccattggagctagccctcgcgctagtggcggccaccgccccacaagtagcggaggcaaagaagaagatacggcagagagcggcgaggcggccgatgcgaagaagatccaagacgacttctgctcgacgctgtgcgagggcaagaaggggacggacctggtcgtgtgcaaggagtcctgcgcgctctcccagcagtccaacctggtgctgtacggcaggatc

SEQ ID NO: 8991 - DNA, 425 bp, Zea mays
  unsure at all n locations
  Clone ID: LIB148-025-Q1-E1-B10
gggtcgacacacgcctctacagtcactcgtacaagcatgcatgcatgtgacaacctctccccctccctgtccctctgtatctgcaactgcaagcaaggaaattaattaaaagaaaatcggcgccatggcggcaacgacgacggggatgcagatgatgcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaagcgccgccgccggcgtgtccgcgctcaganggttca

SEQ ID NO: 8992 - DNA, 291 bp, Zea mays
  Clone ID: LIB148-025-Q1-E1-B2
ggcgctgctgctgcggctcctcgccggccgcgctcgtcgctgcgctggcctctgtcgcatccgccgacgacgccaacgccatgcccaccatcctgacccccgtggcgcataccccgctggggtccttcgacggcgacaagccggcctctgacgacgacgccgtcgacgacgacgaggacgccgcccctgtcggcgcgcccaacggggccaccatgactgagcccagggacgacgtccccgccccgcccggggccgaagcaaccgcgggcggcgccgccgccagcaacgcgc

SEQ ID NO: 8993 - DNA, 394 bp, Zea mays
  unsure at all n locations
  Clone ID: LIB148-025-Q1-E1-B3
cgcgcagacagctccgaacactcagtgctcttcgcccacacctggcccagacagatatgcagatcacgtccccttcacactcgcagggcctgtcacggatcaagtgccctgggcttcctcacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacnacaacgagtgggtaaagcccaagccaggaaacta

SEQ ID NO: 8994 - DNA, 443 bp, Zea mays
  Clone ID: LIB148-025-Q1-E1-B4
cgacacaaccctctagatcgcctcttagcaccggccgttgatgccaaacctcctcaaaccaaacccaaacaacaggattaacaattcaaaaacctggccaagcacccctggttcaaaaaggggtaaaggccggccgtcatgctggcacacccgcacggctcaagcaccctcaaggatgtccaggtcgccttcagcaacgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaagccggcgtcggcgatagtgtcaaagctggagcagatcgctgagacagagcccctcatggtgaaaaaacagga

SEQ ID NO: 8995 - DNA, 426 bp, Zea mays
  Clone ID: LIB148-025-Q1-E1-B6
cccacgcgtccgcccacgcgtccggcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccggctcggctacctcaaggacgtgccgctgcccatctgcgc

SEQ ID NO: 8996 - DNA, 256 bp, Zea mays
  Clone ID: LIB148-025-Q1-E1-A10
agaagatgcacggagagaaggatgatgaagggctttggcaatcgccgctgcaactgcaacccatgccatgccggcttagtgattgggtataatttggcttggcagcagccagcattattatgtgctgatctgttatcttttactagtttggtcgtccgatatctttctttctttttccccccttttcgactctgtactgaaactgctgagagattcgcagtattgttgtatcgtattcatatgctactgttactct

SEQ ID NO: 8997 - DNA, 127 bp, Zea mays
  Clone ID: LIB148-025-Q1-E1-B7
agttggtgtcaaaataaaaaaaaaaaaaaaaaaaaaaaaaaaaaaaaaaaaaaaaaaaaaataaaaaagaaaaaaaaacaaaaaagtaaaaagggaggccgcccaagaggtctaaatcttacttcgc

SEQ ID NO: 8998 - DNA, 215 bp, Zea mays
  Clone ID: LIB148-025-Q1-E1-B8
ctcgcgggtcgacacacgcctccacaatgaatcagtgtattatgctcaccaatgatagttctactaaaggatgaagcagatgccttttggtgctttgagaaattgatgcgtagattgcgaggaaatttcaaatgcacagatcaatctgtgggagtatccaaccaacttcaacatcttgcatctattattcaggttcttgacccaaagctacatga

SEQ ID NO: 8999 - DNA, 430 bp, Zea mays
  unsure at all n locations
  Clone ID: LIB148-024-Q1-E1-G6
acacccaatatagagtcgtattattcctgccgccgccgccgtcacacgccaccgcagagctagctaccgacgaagacaaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcncctcncggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgg

SEQ ID NO: 9000 - DNA, 406 bp, Zea mays
  unsure at all n locations
  Clone ID: LIB148-024-Q1-E1-G7
ggcaagggacctgatgaacctggctaggttgaccatcgatgagttctccgagatcccagcgagtgcgaaagacgaggtggttcaagatctcgtcgacggcctggagtcgatcttccaggagtacatcttctttgtggcgtcttgcggttcgaaacagaactacctccctccgctgccgccgctgacgaggtgcaaccaagactcgggcttcttccgactgtggaagaaggcggcgctgccgacgtgccaggcgccgccggatgccaccccgcgcggcggcggcggttcgcaccacgtcncgcggccgtccatcagccggggcacgcagcggctctacgtccgcctcaacacgctccactacgtgctgacccacctggaggccctcgacagctcgctgtcgtcctcg

SEQ ID NO: 9001 - DNA, 438 bp, Zea mays
  unsure at all n locations
  Clone ID: LIB148-024-Q1-E1-G8
tcgtgctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcnaagacagccacgaggaggacatctgcgaggtggtcttggtggagagcccgcgcaaggac

SEQ ID NO: 9002 - DNA, 398 bp, Zea mays
  Clone ID: LIB148-024-Q1-E1-G9
tagataacttctactaaccgccggaatggagccccaagaagggtgggctgaacaagttccatggccagcatgcgctcagggagcgagcgaggaagctcgaccagggcatcctgattataaggtttgagatgccttttaacatttggtgtggtggatgcaattccatgatagcgaagggagtaagatttaatgctgagaagaaacaagttggaaattattactctaccaagatatggagcttcaccatgaaatcgccctgttgcaagcatgaaattgtcatacagacagacccaaaaaatactgaatatgtcataatcagtggggcccagaagaagacagaagattttgatgttgaggatgcagagacattgctgctgccagcagatgaagatcgagac

SEQ ID NO: 9003 - DNA, 443 bp, Zea mays
  unsure at all n locations
  Clone ID: LIB148-024-Q1-E1-H1
tcgcgggccgatacacgcatctacccacgcgtctgcgtgtgccaggcctcgccttctcgcggcggtgctccctccctcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcnnacaccacagcagcagcaaccgcagccgcggaatgccggcatggac

SEQ ID NO: 9004 - DNA, 383 bp, Zea mays
  Clone ID: LIB148-024-Q1-E1-H10
acaagactctacactgagtcgtagtagaccgggcccgtgccctcggggtagagctggtttctttcgacgaggccatcgcaagagccgacttcatctccctccacatgccgctgataccgacgacgtccaagatcttcaacgacgagtccttcgcaaagatgaagaatggtgtccggatcatcaacgtggccaggggtggagtgatcgacgaagacgctctggtcagggcgcttgactccggcaaagttgctcaggcggctcttgatgtcttcaccgtggagcccccgcccaaggacagcaagctggtgttgcatgagaatgtcactgtaacaccccaccttggagctagtactgtcgaggctcaggaaggcgtcgctatcgag

SEQ ID NO: 9005 - DNA, 396 bp, Zea mays
  Clone ID: LIB148-024-Q1-E1-H11
tacaagcctctatacttactcatcatacatgcatgtgacgacctctcctcctcgctgtctctctgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgc

SEQ ID NO: 9006 - DNA, 450 bp, Zea mays
  Clone ID: LIB148-024-Q1-E1-H2
acgagtccacgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgctggccaagcccggcgccaatggcggccaggcggtggcggtgcggctgttcgggaccaagacgcagatctacaactgcaccatcgacggcggacaggacacgctgtacgaccacaagggcctgcactacttcaagggctgcctcatccggggcagcgtcgacttcatcttcggcttcggccgcagcttctacgaggactgccgcatcgagtcggtggtcaaggaggtggcggtgctgacggcgcagcagcgttccaagtcgatcgagggcgccatcgacaccggcttctcgttcaagaactg

SEQ ID NO: 9007 - DNA, 262 bp, Zea mays
  Clone ID: LIB148-024-Q1-E1-H3
gccgtcatcgtaccactctctctcgcttcttcttcttcaatcgtccctccccgcgccggaattggaggaaggagaggggacaagctttccggcgccgacgccgacgcggacccggcgccgacacgatacggtgcatcacgtgcatcacaccgttacggaggccccttggacatcactttgtgctgcaacttcgatataactcagttgcagcatggcctcagtgggcgtggcaagcacatccttgggatttcagagtggcaca

SEQ ID NO: 9008 - DNA, 409 bp, Zea mays
  Clone ID: LIB148-024-Q1-E1-H4
cacgactctacaccggctcatggcagcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatgaga

SEQ ID NO: 9009 - DNA, 414 bp, Zea mays
  Clone ID: LIB148-024-Q1-E1-H5
accaaaacattcaatggccccaacggcggcggaggaaatggaaaggatggtggaggcggattggaaggaggggatgaggaaaaggaaccggtacgggctggtggagtaccgggcgctgccggcttacctgcgggacaacgagtacatccaccgccactaccgctgcgagtggccgctcccgcaagttctgctctccgccttctccatccacaacgagaccctcaacgtctggactattacagaggaggcaaatatagatactccagtaaaggaaatgaggatgctgaagagaaaaagctagcttgggaggaacgggagatcgattcttgcctgactctgattgcaatgcgtcgaattggcaaaatatttacgcgtttatttcctgcttgtgcttaattcctgcgtgtgtttctg

SEQ ID NO: 9010 - DNA, 439 bp, Zea mays
  Clone ID: LIB148-024-Q1-E1-H6
cacgactctactccgggtcatcaggcctcctcgttctgctgcttctcatcaacacaggctttgtcctgcccgtcaattccaaggactgctgggccgacacccgcgtcatctgcaccaagacgcacaactgccgggacgacacttgcgcggggcgcggcatgccggacggccgctgccactgggagttccccaacctggtgcccttctgccagtgcttgcgccccaactgccactagtccgggcgcctcggattggcacacttcgccggcgatgatggatggtgcccaactgcgactgcccagtctgctccattcgttgttgtttaaggcataatatataaactgccaaattcacatgtattttgggatatttgttatcatactatgaaatgactgtgaatcgttgttctgatttggtcttcaccacatgttttccttgc

SEQ ID NO: 9011 - DNA, 199 bp, Zea mays
  Clone ID: LIB148-024-Q1-E1-H9
acgcctctacacatgacgttgtgctaacgcgtccgaaaaaaaaaaaaaaaaaaaaaaaaaaaaaaaaaaaaaaaaaaaaaaaaaaaaaaaaaaaaataaggaaagacaagggaggtggtcctggaggattgttagcttgcatgcccgtccatgggatgtcaaatcacttccatggtgtcacctaatttgacttccttgg

SEQ ID NO: 9012 - DNA, 263 bp, Zea mays
  Clone ID: LIB148-025-Q1-E1-A1
gccacatctattaggtgcaaccatgggtgcctgttcaacgaagcctaagacgcttgatgggaaagccccagctgaagccaccatctccacacccaaggttgcacctgagaccactaccatccacattgaggttgcggcaaaacatgcagtagttgacaacgtggacgacgacaaggacgaggcactaacagtggcggcgaaacaagagccagcagccaccattgagcctcagcagattgctagtgacgtgaccacttcggaag

SEQ ID NO: 9013 - DNA, 397 bp, Zea mays
  Clone ID: LIB148-024-Q1-E1-G4
tactgagtcgtatgagccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgccttt

SEQ ID NO: 9014 - DNA, 407 bp, Zea mays
  Clone ID: LIB148-001-Q1-E1-B10
ggcaagggcgcaaccaataatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtactttaatttg

SEQ ID NO: 9015 - DNA, 146 bp, Zea mays
  Clone ID: LIB148-001-Q1-E1-B11
cctgcgccgtcctcgccgccgccgcctccgctgccgtggtcctcgccgccggggccccggcgcccgtcctcaccagcgcctcctcggtcgcgttcccggccgtcggcgccgtgctgggcgcctccgtgctctccttcttcgcctac

SEQ ID NO: 9016 - DNA, 400 bp, Zea mays
  Clone ID: LIB148-001-Q1-E1-B12
gtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcattttatttgctttgccatttctcccctttctgttaatttcgatatgtaaagaggggagaatgggagacactattcgtttggacatgacaattgggaattaatcaatacccatttgtt

SEQ ID NO: 9017 - DNA, 413 bp, Zea mays
  unsure at all n locations
  Clone ID: LIB148-001-Q1-E1-B2
aaaacatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacangaacatgcacgggctggcggtgctggccaccaagatggccatcgnacacgccgccagcaccgagtccaagatcgac

SEQ ID NO: 9018 - DNA, 418 bp, Zea mays
  unsure at all n locations
  Clone ID: LIB148-001-Q1-E1-B3
agcgaggaggagaagctacgcaaggcgggcatcatcgacatgcagttccgaagggttaagtgcaagtacgactccaaggtcaccttccaccttgaaaaggggtgcggccccaactacctggcactgctggtcaagtacgtcgacggcgacggtgacattgtggcagtggacgtcaaggagaagggctccgacacatacgagcccctgaagcactcctggggcgccatctggaggaaggacagcgacaaaccgcttaagggacccctcaccgtccgcctcactaccganggaagcaccaagtccgtctacgacgatgtcatccctgccaactggaaaggcaacaacgcctacaacgccaaataattaactttagtgctgacaatactttaagccgacctatgctagctatactagattg

SEQ ID NO: 9019 - DNA, 376 bp, Zea mays
  unsure at all n locations
  Clone ID: LIB148-001-Q1-E1-B4
gcacgacgaggacgaagccgtgcccgaaggaaaaagacgtggcggttgtaagggaggatgtggaagcggatgcggagacagagacagagactgaaagcgaggctgaggcagaggtcgaggccgangtggacgtcgaggtggaagcggaagccggtgcatcgtctgcgaagaagaaccgtatccaggtgtccaccaacaagaagccgctctatttctacgtcaatctcgccaagaggtacatgcagaactacgacgaggttgagctctccgctctggggatggccattggtaacctggttaacgtcgctgagatcctcaaaaacaatggcctcgccactgaaaagaacatcctcacatcaaccatcggcaccaatga

SEQ ID NO: 9020 - DNA, 412 bp, Zea mays
  Clone ID: LIB148-001-Q1-E1-B5
atacgtttctctgggtgcttgtcgcggacggcgtttaggaacaaggactgcggcaagggccggcgatcgcgaggcacagtgggcggtagagcagagacactccacgggcctcaaccagctcgccaccacctcctcctccgaccttctaggcagcaaggactagcatgcagtccgagctcaccgaggaggcccgcaaaggtcgcaagatatacgtagctacagtcttctccggcgactagcccaccatctctagcgccgctgatgcggctgatctcgctggtctccggagaccgacggcgtccagcggtggccggaggagtcctgtgttcttcgtttccttaggtgtacttatgtgggttttggggtggcaagagagtttttttttgtgaactctggtgtatcggatcaagtg

SEQ ID NO: 9021 - DNA, 320 bp, Zea mays
  Clone ID: LIB148-001-Q1-E1-B6
gcgactacttcctcgggcccagcctcgacgccttggtacagcagctcgccgagaacgatgcggcgcggcacgggacgccgccggccaagaaggaggccgtggaggcaatgccgaccgtggcaatcgccggcggcaacgatggcgacgacgcggccagctgcccggtctgcctggaggactacgcggccggcgagcgcgcccgcgagatgccctgcacgcacatgttccacggcaattgcatcatgccgtggctcgagatgcacagctcctgccctgtctgccggttccagctgccggccatcgacgacaagagctcatgc

SEQ ID NO: 9022 - DNA, 390 bp, Zea mays
  Clone ID: LIB148-001-Q1-E1-B7
gaccatttagcgaggcgattgaatggcatcggcatcaaggtgtacgggatggactggactggtcatggtggaagtgatggtctccatggatatgtgcaatctcttgatcatgctgtcagtgatttgaaaatgtacctcaagaaagtgttagctgagaaccctggtcttccatgcttctgcttcggtcactcgactggtggaggtatcattctgaaggctgcacttgatccagaggtagaaactctccttagaggtattgtcttgacatcaccagctgtccgtgttcagcctacacacccaatcatagcggtcatggcaccgatttttgccctcatcgcgccgaggtatcagttcactgcgtcccacaggaacggcccgccggtgtcgcgc

SEQ ID NO: 9023 - DNA, 343 bp, Zea mays
  Clone ID: LIB148-001-Q1-E1-B8
aaaaaattaaaaaagaaaattaaaataaaaaaaaaaaaaaagagataaaaaataaaatggaaagaaaaatgaaaaaaataaaagaaaaaaaaaaataggtggaggctcttgatgatgatgttaatgatttgataatgtatctctcgaaagtcttagctgatatccctgatcttcaatgcatcggcttcggtcattcaacgtgcttgatgtgaataccttaaggctgcacttgattaacatgtagaaactctccttatatgtattgtcttgacataatcagatgtcggtgttcagcctagacattcaatcatattggtcatggcaaagatttatgggcacatcg

SEQ ID NO: 9024 - DNA, 397 bp, Zea mays
  unsure at all n locations
  Clone ID: LIB148-001-Q1-E1-B9
tgacaacggcggcggcgatggtagggcaagtattccaggcaatgcggagcccgccgaagccgaagagaacggcagccggttgccgccatccttgcagtggctcaacagcctgttctcgccatcggcgcagtcctccggtagcggcagcggcagttcgcatcattgggagaattgaacaataatgcaatataagaatggatgattgttgctgcttgagcccattggtgccaatgtacataggaagagcaggagcatgccggcatgaaaaatttggagcctttttttcagtgtgtcaatttggctcatgtaatgttctctctgatatagttgtcatggctataaaaagaacacaaattggcaagtaaaagaacngagccatcancaggtccgaacggcc

SEQ ID NO: 9025 - DNA, 403 bp, Zea mays
  Clone ID: LIB148-001-Q1-E1-C1
cccacgcgtccgcccacgcgtccgcccacgcgtccgcccacgcgtccgcccacgcgtccggttggagcgttggcaatatattacttgatctcacaggaggggtgctgaatttttgtcagatgggtgtgcagtctatagatcaacatactttggtgaatttctatggaaacattgggaaaacccttctttcattggagacggttttctttgatgtcctgttcattatccaacactacgtgttgtaccctgtcaagaaggacgagaatggtaaggcaatcatttctgaaagggtagccccccttatcaggccttcggacaagcctgaagaagataacgtatgatctagctgtagttatattgcgcacattgcattcacgcgctgtttgcacacaggccacacacg

SEQ ID NO: 9026 - DNA, 408 bp, Zea mays
  unsure at all n locations
  Clone ID: LIB148-001-Q1-E1-C10
aaaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgangggcatgct

SEQ ID NO: 9027 - DNA, 417 bp, Zea mays
  unsure at all n locations
  Clone ID: LIB148-001-Q1-E1-C11
cggacgcgtgggcttccttccgccgtgccacccaccctcctctcgcggtcgcgggggtagggccgggtgagcacgagcgctgcccgctcgctgaaccatggcgggctccgcggtggccgtcgtcctcctgtcggccgtcgcgctgctctgcctgtaccacctccttttcctctccctgtccgtcccggacccggcagcagcagcagccgtcccccgccgcgccggtggccaccatggcagcaacgttccgtccgggtcaggaaccgccaacgtcgtcctccgcttcggcctgtccgggcagccgctccgcctccacgaccccgcctccgccgccggcctcccggacatcgacaccttccgcggcaagctcgagcggctgcttcctcncgacgaccacgaacccggctggtcccgccg

SEQ ID NO: 9028 - DNA, 407 bp, Zea mays
  Clone ID: LIB148-001-Q1-E1-C12
ccacgcgtccgtccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtgg

SEQ ID NO: 9029 - DNA, 392 bp, Zea mays
  Clone ID: LIB148-001-Q1-E1-C2
aacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagatccgacctgcaggaggaggcaacagctaccgtaataaccaaagcggaagcacaagaggcttcagctgaaggtggcgattaacctacctaaccatattatttattcattcatatgcatgcatccttgttgctatgcca

SEQ ID NO: 9030 - DNA, 413 bp, Zea mays
  Clone ID: LIB148-001-Q1-E1-B1
ggcccgcgcgtgcgtgttcctcgtggtgctcctcctggccgccgtcgcggtggcgccgtttgcgggggctgcgcgcgtggatgtcgtggagggcaggtccatggcgtccgccgacgcgcctgaggcggcggctgacgcgcccgctcccggtcccgactccgcctcatccccggactcgtcgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatgaaatgcgtgcggcaaacgcatggaatgtgcttgcctagctaattgttgttgttaatgttgttgttggtttt

SEQ ID NO: 9031 - DNA, 344 bp, Zea mays
  Clone ID: LIB148-001-Q1-E1-A1
gtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgaccggaac

SEQ ID NO: 9032 - DNA, 413 bp, Zea mays
  Clone ID: LIB148-001-Q1-E1-A10
ccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcgtccctgcggcacctgcaccgacgcctcccgacgagccagcagcggcagctgaggaagaagccgacgcagctgcagatgccccttcagcaaatggagcctcaagctccacaaactcaaagaatgcagcgagcttactgcttctcatctgcgca

SEQ ID NO: 9033 - DNA, 411 bp, Zea mays
  Clone ID: LIB148-001-Q1-E1-A11
ggcagcatggcggcgaccagccgtctcctgcctcctgttcgtttttgttttggtgctattgatctctacgacggcaacggtgacggcgacgacagttcagtcgcggcaggcggggctcagtacctcccgccaaagaggctctggattccgggcgtggcggagggatgtgctgaggccggacaggacggccggcgaagcttgggcgccaccggcgcccaaggccaacggcaacgtcccaggagggcccttcggtcgtcgttgactcatccagatccagtcgcacccgcccaatcgccatcgtttcatgacacatcgaccagatagttagcaattcccatctcactggtgtgtgttatttttagcttctttcaacgatgaagaactactggtgattacttattgcatcgaaaa

SEQ ID NO: 9034 - DNA, 341 bp, Zea mays
  Clone ID: LIB148-001-Q1-E1-A12
gacaagccgtctactggctcatgttcgtctttgtcttgatgcgattgatctctacgacggtcaaggtgacggcgacaacagttcagtcgcggcaggcggcgctcagtacctcccgcaaaagatgctctggattccgagcatgacggagggatgtactgtggccggacaggacagctggtgaagcttgggcgccaacggagccaaatgtcaaaggcaacgtcgcatgagggcacttcggtcgtcgttgactcatccacattcagtcacacccgtccaatcgacatcgtttcatgacagatcgaccagctagttaacatttcccatctcactggcgtgtgtta

SEQ ID NO: 9035 - DNA, 420 bp, Zea mays
  Clone ID: LIB148-001-Q1-E1-A2
gacaaaccgcttaagggacccctcaccgtccgcctcactaccgagggaggcaccaagtccgtctacgacgatgtcatccctgccaactggaaggccaacaccgcctacaccgccaaataattaactttagtgctgacaatactttaagccggcctatgctagctatactagaattggttggatcccaagcaatgcattacacatgcatgcattggaccgtgatatctatttgctaccactaccctattacgacagtgatgctggcgccaacaatgatggtgtcatcctccttctccatcttcttcatctccatatatagctagagtgagacttctctgttgtttaaaagagaaaagttaagaaatggattgacaagttatataataagtgcctaatgaaatatttgataggccttcattt

SEQ ID NO: 9036 - DNA, 396 bp, Zea mays
  Clone ID: LIB148-001-Q1-E1-A3
cccggggccacccacacgtccgaaggcgctcacgttctgcgacaccatgtacatgaacacgcaggacaccatcggcgcggcgcagcgggccatcacgttcaaggacaccggcaccgccaagatcatgctgcagctcgccgtccaggacttcgactcgtgcgaccgccccttcacccaggccggcgtccccaaccccatggggaagtttgacaaggagctcaaccagatggccagcaactgcatggctcttgcaaacatgatatgaaccacgcatgcaaccccagcgtgaggtgccatcgcatgcaaggaatgcttgcattcaattttcaattaattaagaattcattgaaattatgagttatataaaaaaaaaaaaaaaaaaagggcgggcgctcc

SEQ ID NO: 9037 - DNA, 445 bp, Zea mays
  Clone ID: LIB148-001-Q1-E1-A4
ccgggtgcccccacacgtccgagcaaacctccgatccctgctgcgagcaagggatggcggcggcatgggcagtgctggcggcggtcctcgtcgcggcgcaggtggcgtctgcggcgccggtcacggcgccagcgttcctctgggcgcctaagaactacggattccgctctgatgatgctaaggaggtagtccattatcaaacaatctcaccaaagaacttagctaaatctgttcttgaggaaggtggctggtcaacctttatgtgttcaagggaggatactgagaagcatgttgatgttgccattgtttttattggctcaaagctacaatcatcagacatatcgaaagataagcaagttgatccagctttagcagatacattgaagctctccttcacagaatcagagttttctatggcattcccctacgtttccacatcagacga

SEQ ID NO: 9038 - DNA, 407 bp, Zea mays
  Clone ID: LIB148-001-Q1-E1-A5
ccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgcc

SEQ ID NO: 9039 - DNA, 415 bp, Zea mays
  Clone ID: LIB148-001-Q1-E1-A6
ccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcagggacagccacgacgaggacatctgccaggtggtg

SEQ ID NO: 9040 - DNA, 412 bp, Zea mays
  Clone ID: LIB148-001-Q1-E1-A7
ccgggccgaggccatggtcgatgcagggaggaggatgccgccgctgccgcggagattgatagtactagtataaagcaggcggagacagccggcccctctggcctcgctgctcccccttcctccccgtccccacccacatgccctgcctccgccccgccccgccctgcccaagctgagttcccccacccccaacaaacaattactagagtagctgcattggcggggaaattaaagcgctagaagctcagcagcaatggcggagcaggcgggcgtcggaaggtactggtgccacatgtgcgccgcggccgttagccccgcggagggcgaggtggagatgaagtgcccgttctgccacagcggcttcctcgaggagatggagaccgcccgccgggccgcgaccgacgacggtgac

SEQ ID NO: 9041 - DNA, 417 bp, Zea mays
  Clone ID: LIB148-001-Q1-E1-A8
ctcttggcgacctcagcaaaccgccctcgcgcagacctctcgtactgcatatacgcattgtcaaggagattgtccaagacaaagaactggatagttgcgctcaagacattgatagtggtgcataggcttctgagggaaggcgatcccatgttcaaggaagagttcctggcctactcatccagagggaacatcttgcacatagccaatttcaaggacgactcgagccagtcagcttgggattgctccgcatggattcgcgcctatggatgcttcctggaggaacggctcgagtgcctcagggttctcagatacgacatcgaaaccgaacgtctcgtcagatatccccagacttccagcaaggtacatagtaaaaccaggaccctgcctagcccggaactcttggagcagttgcctgca

SEQ ID NO: 9042 - DNA, 414 bp, Zea mays
  Clone ID: LIB148-001-Q1-E1-A9
gaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaagtt

SEQ ID NO: 9043 - DNA, 385 bp, Zea mays
  Clone ID: LIB148-024-Q1-E1-F10
aatcctctacactgacgtcgtattacctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacg

SEQ ID NO: 9044 - DNA, 419 bp, Zea mays
  Clone ID: LIB148-024-Q1-E1-F11
tacaacactctagactgagtcgtattacctccggcatgtcggcgctcctgcccctcgacctccgccgcggcgacgtcctcagtcccgaggtcatcgtctgcggcggctcccccaagaacgccttcacgctcggcgagtccaacacgttcccgcccgccctcaaggactgcgcgcgcatcaaccccttgaagcccgacgctcggtgggcgctggaccagatgcccgtggcccgcaccatgggcgacctgctgatcctgcccaccggcgacctgctcattctgaacggcgcggccaagggctgctccggctggggcttcgggcggcagcccgtgctgagcccgctcctgtactctccgcgccatgcgcggggctcgcggttccgggcgctggcgcccaacaccatcccgcgcatgtaccac

SEQ ID NO: 9045 - DNA, 447 bp, Zea mays
  Clone ID: LIB148-024-Q1-E1-F2
cacgagtcaaggatgactccacaccattgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttctgcaagaagccttgctagttcatcggtcttgct

SEQ ID NO: 9046 - DNA, 439 bp, Zea mays
  unsure at all n locations
  Clone ID: LIB148-024-Q1-E1-F3
tacaagcattcatacacacaagcgtcaaacttgtcaagcagctagcaaccaacccaagaaagacaccatacccatggctcgcgctagcgtcgtcttcgtcgttgctgctctcctcttcgtcgccatggttgtggcaccgatggccgaggcaaagtccgctgatgccccctccgccgatgcccccgcccccgctgctgacgcacctgccgatggacctagcggaccggcaggtgcacctggtccccagggcgtcgagggactatcgggcaatgaggacgacgacgatgactccaccaactaaggccaagcacgtcggtccgattgcatttggaacaagatatgaaagaaaagtgagagcaatgttgtttaaaaccaaaaatccataataatgtgtggtcatccgtgatatgttcttgctctncctctttttctttctgtt

SEQ ID NO: 9047 - DNA, 81 bp, Zea mays
  Clone ID: LIB148-024-Q1-E1-F4
tctacagtgtgtctgattcaaaaaaaaaaaaaaaaaaaaaaaaaaaaaaaaaaaaaaaaaaaaaaaggaggacaaacagga

SEQ ID NO: 9048 - DNA, 447 bp, Zea mays
  unsure at all n locations
  Clone ID: LIB148-024-Q1-E1-F5
cacgcctctacactaacgtcatcagaactaggaaggcaaagccaaaggcccggcccggcccggcacggttcaaccaatggcggtggcccctcctacggcggcggccctggagcagctaagcagcagcaagatgtttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgcccacggcatcgccctcgtggcacctgacacctccccacgtgggttaaatattgaaggagagtcagacagctatgattttggtgtgggtgccgggttttatttgaatgccacanatgaaaagtggaaaaact

SEQ ID NO: 9049 - DNA, 395 bp, Zea mays
  Clone ID: LIB148-024-Q1-E1-F6
tctcaacatcaaggttagcggccccgtgcacaagggcatgccgcacaggttctacaacggccgcaccggaaccgtctggaacgtcacaaagcgcgccatcggcgtcgagatcaacaagcaggttaacggccgcatcatcaggaagcggatcgatgtccgcgtggagcatgtgcagccctcccgttgcacggaggagttccgcttgaggaaagccaagaatgaccagctcaacgcggatgccaaggcccgcggtgaggtgatcagcaccaagacgcagcctgtgcgaaccacacctggcttcatggttgagggtgctacacccgagacagtcactcctattctttatgatgtggtcaacgatctcaagggcggttactagatagaatttttgtacc

SEQ ID NO: 9050 - DNA, 424 bp, Zea mays
  Clone ID: LIB148-024-Q1-E1-F7
attatttaatccaaaccttaataattaaaaaattagattattacacaataccaccatacacaacctttgccccaatcaaaaccatgcatgaatcaaaggcgtcgtcaaatcaaaagaaaggaagaaacaaaatgatttgtggggtgggggtttggtgcatggccgtcgctgttaaaattcgacacacgacagttgcgtaaatagacctagcgtaatcagctgcacaaacgaatgagagagcgagcgaaggaagcaaaatctgggtgaggagatgaatagatgatgacgggagcgcggcgcggcctggcagactgggcctaagcacctgctccgatccatctgctctgctgggcctaagcaccgccgcggagtttggccatgttcctcttcttcctctcctccagggccgccgccccctcctgct

SEQ ID NO: 9051 - DNA, 426 bp, Zea mays
  unsure at all n locations
  Clone ID: LIB148-024-Q1-E1-F9
ctctagccaccctcgtctcaccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagcctcaagacagccacgangaggacatctgc

SEQ ID NO: 9052 - DNA, 346 bp, Zea mays
  unsure at all n locations
  Clone ID: LIB148-024-Q1-E1-G11
acaagcctctagagtgcgtcgtcttagctgccaccgagatcctgtcggcacccgcctccgcgcgctcccgctgccgcacgggaccaacctgttcgcctgttcatccactcagcgacattcacgcccgcatctcgccgtgggcagcaccgcactcaccaccgccgtcgcagtgaggtcacgagtcagctgaagagcaagttggtacctggaatctcaagtcncaggtcaagaacaggtaccgcaggatgaggcgcatggaggatgctgtggcgagttcgtgagaggtctaggccatcgtctcccagtcaactttgggttgctggaccgttgtccccttataatgaaa

SEQ ID NO: 9053 - DNA, 398 bp, Zea mays
  Clone ID: LIB148-024-Q1-E1-G12
tactctagagtgagtcgtaatagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccactgggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaagggttgacgttccacaggatcacccg

SEQ ID NO: 9054 - DNA, 446 bp, Zea mays
  unsure at all n locations
  Clone ID: LIB148-024-Q1-E1-G2
cccgggccgatacacgactctacactgagtcatctcactggactacgaccaggagatggagaccgccaagaccagctcttccgtggagaagagctacgagctccccgacggacaggtcatcaccatcggcgccgagcgcttccgctgccccgaggtcctcttccagccatccttcatcgggatggaagctgccggcatccacgagaccacctacaactccatcatgaagtgcgacgtggatattaggaaggacctgtacggcaacatcgtcctctccggtggcaccaccatgttccctgggatcgctgacaggatgagcaaggagatcactgccttggctcccagcagcatgaagatcaaggtggtcgctcctccagagaggaagtacagtgtctggatcggaggattcatcctggcatcnctcagcnacttccagcagatgtgga

SEQ ID NO: 9055 - DNA, 459 bp, Zea mays
  Clone ID: LIB148-024-Q1-E1-G3
gacgcgcgggccgatacaagactctataatgagtcggattagttctttgtatatttgtggtaccctaagacaaagggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacgttttaaaatatgttgctgcccagtccccttctcggaaatcaaggctgcaccctcatcaggaaccacagcagcagcaaccacaagtgcaggtggagctgcagcagcaaccacaagtgcaggtggagctgcagcagccgcaaccacaaaaacaagcagcacctgttatgcgcagaggagcatctattgctgctcggcaagcagcaatggcacagcaatctctggag

SEQ ID NO: 9056 - DNA, 390 bp, Zea mays
  unsure at all n locations
  Clone ID: LIB148-024-Q1-E1-F1
acccacgcgtccggagataattcagtagatctagtagtttaactccataattgttggatttcaatacattcaggaccgaggccggcgaatcaatcaagaacgccacctcctaggttagggcgtgttggacctgccatgggggacaggccggcgccgatcgagaaggtcgcggtgccggagaagatggccttgttcctccacgccgccgtcacgtcaccgggacgccagcagcatcacggcgcctcgtcgcacgaggcgcccgccgcgaacatcacgccgcggacaacaacagccaggaataagcagcagcacctgccggtgagccncggggcgtgcctctgctcgccgaccgttcacgaaggctcgttccggtgcaggctccaccgcggc

SEQ ID NO: 9057 - DNA, 285 bp, Zea mays
  Clone ID: LIB148-024-Q1-E1-D6
agtctacgtcgtctcactcaccccgcattcacgcctccctcatcaaatagcgtcccgcccttttcggacattcgcaggggggacaggaactcatccgccacggacacgagtccggcgacgaccttcgccgtcatcttatccgtcctcttctgtgccgcagctgtcaccgccgtctacatcgacgtcaccgactacttcatccaacgcctcgtctattgctacacctgccgctccgggttcgtgactaatgtcaccgagtacatcgctgccgccaatgtgatgctg

SEQ ID NO: 9058 - DNA, 447 bp, Zea mays
  Clone ID: LIB148-024-Q1-E1-D7
cacgcgtccacttgaatatgatgtcaacgtatccaagtcatttgaaaagctcaacaactggcgtgaggaattcctaattcaagccagcccatcagacccagagaatttcccatttgttgtgcttggtaacaagatcgatgttgatggtggtaacagccggactgtttctgagaagaaggctaaagcatggtgtgcttcaaagggaaacatcccctactttgagacgtcggctaaagagggcttcaatgtagaggctgcatttgagtgtatagcgaggaatgctgtaaaaaatgagccagaagaagatatgtatcttcctgatacgattgatgttgggggcgctggaaggcaacaacgttcgtcaggttgtgaatgctagaagatatggagcactgcgatttgctcggttggttggtctgattctctagggcttgttttggttggcct

SEQ ID NO: 9059 - DNA, 404 bp, Zea mays
  unsure at all n locations
  Clone ID: LIB148-024-Q1-E1-D8
tccccctcctttccaggtcccctcgcccgcgctctcagatctcgcgcgcctcccacaagggaaaccttgagccatgggcacagttgtggatgccgctccagcagttgtggctgaggtcactgagaacatgttgggtggcaagaaagttacagttgtatttgttctaggtggtcctggaagtggaaaaggcacacagtgtgccaacatcgtggagcactttggattcacccatcttagtgctggagatcntctgcgtgcagagattaaatctggctctgagaacggaaccatgattgagaacatgataaaggagggaaagattgttccatcggaagtgactataaagcttttgcangaggcaatgataaaaagtgaaaatgacaaattcctgatcgatggatttc

SEQ ID NO: 9060 - DNA, 425 bp, Zea mays
  Clone ID: LIB148-024-Q1-E1-D9
tcgtgggccgatacaagcctctagaataactcgtagaaacagagcaagagcatcgctctcgaagcaaaacgcgcaccacgccgtcgccggccggccacttcgcacgtacgtaggacgcgcacgcaccggtgcatatatggggctcctgaaccagctgtgggacgacacggtggccgggccgcgcccggactccggcctcggcaagctccgcaactgcagcgacgacgcccaggggagagggctggacgaagaagctgcgcgggaaagccaggatgggcggcggcggcggtgacgacgcccccggcacgccgaggagccccaccgtgtacgactgggtggtgatcagttcgctggacctctgaagcccaagccaagacgagaactgcacaaggaaacccaccaccaccatcaacacagctagcgaa

SEQ ID NO: 9061 - DNA, 402 bp, Zea mays
  Clone ID: LIB148-024-Q1-E1-E1
acacgactctacagtgactcctactaactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggaca

SEQ ID NO: 9062 - DNA, 170 bp, Zea mays
  Clone ID: LIB148-024-Q1-E1-E10
cattctggagagcaaatgtatcaaggcgggtcaattgacttagtttcaggtgcaaaatgccaatgctctccgagaactacacgcttactctttctcataaaacaacaaaacaagatgctgttatgggaattgtggctctggtgaaaataaagaaacgactacatcttcag

SEQ ID NO: 9063 - DNA, 431 bp, Zea mays
  unsure at all n locations
  Clone ID: LIB148-024-Q1-E1-E11
acaagactctaatctaagtcgtaggaaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtatgactgcaagatccttcccaactcgctggtgatggacttcgtgaacaacggggaggtgtccggggtcacgctgctcaactccaagttcttccacatgaacatgtaccagtgcaagaacatgctgatcaaggacgtgaccgtgacggcgcccggggacagccccaacacggatggcatccacatgggcgactcatccgggatcaccatcaccaacaccgtcattggcgtcngccacgactgcatctccatcggc

SEQ ID NO: 9064 - DNA, 394 bp, Zea mays
  Clone ID: LIB148-024-Q1-E1-E12
tacaacactctacactgactcgtatgtacatccgatccctgtccaccgcgttgggagcggcgcagcccatggacgacaacgagagagagaaagagaatgagaatgagaaggagaagcactacgggactgacgtcgaggatgaagaagaggacgaggaaggtaacaagcgagtcgtggtgcttggcccccaggtccccctcaaggagcagctcgagctcgacaaggatgatgagagcctgaggaggtggaaggagcaactccttgggcaggtcgacacagagcagctgggagaaactgcggaaccagaggtcaaggtggtggacctgacgatcctgtcacctggcagaccggacctgatccttccgattccgttccaggctgacgagaagggcta

SEQ ID NO: 9065 - DNA, 211 bp, Zea mays
  Clone ID: LIB148-024-Q1-E1-E3
gatagcctgtggcacgatcactggcaaagcagcttaccctgctctctgtccgtcctaccgtcagtccgtctaacaatcgaggtcgatgacgacgtcgccgcgcgtgaggctgctcggtatagcactggcgctcgcctgcgtgctgctcgtgaggtccgccgacgctgctgccgaggcgtcccctactccaggcggctccacctaagggtgc

SEQ ID NO: 9066 - DNA, 357 bp, Zea mays
  Clone ID: LIB148-024-Q1-E1-E4
cgcgtccgcgacgatggcccggccgcgcctcctcctcaggttcatgctcgccgacggcggccgtgctgaccacggtgcccggcgtcgcgctcgccaagtcgaagctcgccaatatgagcgacgacgtcttgaacgggcccctcctgaccgagaagatctaggcgaagaacacgctgatcgtgaggccggacgaggagttcaagaccgtacagtccgccatcgactcggtgcccgccgggtacgcgcagtgggtcatcacctacgtcagctctgggctgcacaggggcaaagttgtgatacgggagaaaaacccttcatcttcctgaggggcaacgggaaaggccgggactccatctc

SEQ ID NO: 9067 - DNA, 408 bp, Zea mays
  unsure at all n locations
  Clone ID: LIB148-024-Q1-E1-E5
ccacgcgtccgaccacacgtccggccacttcagttgcttgcaattgcttcggcaacaattctcttgcaaaaaaccttacccggggtcggtcggtccgacggtcagtccgtctaacaatccgattctcatgacgacgtccccgcgcgtgtggctgctcgccatggcactggcgctcgcctgcgtgctgctcgtgaggtccgccgacgctgctgccgaggcgtcnccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccaaccccacctcatgatcctcggccatggccactgatgagtgtaaat

SEQ ID NO: 9068 - DNA, 448 bp, Zea mays
  Clone ID: LIB148-024-Q1-E1-E6
acgcgtccacttcatccagcacgagcggcagctgtcggagcacgacagttgcagcgtccttcaggggaggaagaaaggggacgacggcacgagtttaaaccaacaatctctcgtcatatatatcataatagagagtacgacgacaaaagccatgggcagtaatggcagacatcataggcgcggagtcccacgcccgccacctttaccactttacagggattgggaggaggaagaggtcgccaacaataagaggctgtcgaagcagctgtccatgaacgagaccaccatggaggtcaagtgggagaagcggaagcggcagatacaacggcagaggagcagcatgcgcctgagcgaagccgacgacagggcaggtggcagcactgctgtctgtcctgttgacggcgaggcgagctcgagcgcggagcgggtggccactggtataaccgac

SEQ ID NO: 9069 - DNA, 431 bp, Zea mays
  Clone ID: LIB148-024-Q1-E1-E7
caacactctatactgagtcgtactactggatcacaggggactaccagatgggcggcgccttggagccgttggaccccggcgcggtgggcagcgtcctgcggtacggcctcgctgccaacgccctcgactacgaggccaccggggagtcgctcgtgtacagccagctgtacccgttcgagggcctccagaactacacctccggcatcatccaccacgtcggcctcgagggcctgaagcctgggaccaggtacttgtaccggtgcggtgacactgccatctcggacacaatgagcggcgtgcacgcgttccgcacgatgccggctgtcgggcctgggagctagcccgggccgattaccttggtcggggacctcgggaccacctactctaccacctcgactgtgggacacatggtgtgcaaatgcaccgatctg

SEQ ID NO: 9070 - DNA, 424 bp, Zea mays
  Clone ID: LIB148-024-Q1-E1-E8
ctctacactaagtcgtcatacctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcctggtggagagcccgcgcaaggactgcgacca

SEQ ID NO: 9071 - DNA, 386 bp, Zea mays
  Clone ID: LIB148-024-Q1-E1-E9
agctagctacccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaacgggagagagagtgacatggctgcgcgcattccgatgcgtgggcatgttttttgattcgacaca

SEQ ID NO: 9072 - DNA, 416 bp, Zea mays
  Clone ID: LIB148-024-Q1-E1-D5
acgcgtccacgcgacatcactccactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaacagctcg

SEQ ID NO: 9073 - DNA, 436 bp, Zea mays
  Clone ID: LIB148-024-Q1-E1-C2
agtgcaggctgctgctagccgtggcggcggcggccgtgctcgtggccgcggcagcgcaggcgcaggagacgtgctcggggaccgtccccgcgccgccgcgccgcggggcgcgggtgtccgtggccagcttcggcggcgcgggcgacggacggacgctcaacacggcggcgttcgcgcgcgccgtcgccagcatcgagcgccgcgccgcgccgggcggggcggagctctacgtgccgcccggggtgtggctcacggggcccttcaacctcacctcgcgcatgacgctcttcctcgcgcgcggcgccgtcatccgcgccacgcaggacacatcaagctggcctctgattgaaccgctgccctcatacgggagaggacgtgagctgcccggcggaagatacacaagtttaatccatggcaatgggcttcaggatgttgt

SEQ ID NO: 9074 - DNA, 438 bp, Zea mays
  Clone ID: LIB148-024-Q1-E1-C3
ccgggccgacacacgagtctagccttactctcgaaaccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagcccc

SEQ ID NO: 9075 - DNA, 443 bp, Zea mays
  unsure at all n locations
  Clone ID: LIB148-024-Q1-E1-C4
acaatactctaaactgagtcataatactatcaactacacacaggttgccgtgctcgcggatgacatattgaaaaatgtggaatatgatgctctgagggttattttcaacaagttccaatctgtcatatcgtttaagcccacaatggtaacaatactttcccccgaggttgcagaaaaagaatcagaagctggtgggaagatgggtgacctagattcttatgagattgaaggcggcgagacanaatcagagattttgcagaatctagctgagttccagttttcttgtgtcctgtacaatggtgcnctagagaatgcatgcagtgagcttggagcccgtatgtctgccatggacagctctagcagaaatgctggcgatatgcttgatcgtctcactctcacttacaacaggacacgccaagcatccaatcacacagagcttactg

SEQ ID NO: 9076 - DNA, 301 bp, Zea mays
  unsure at all n locations
  Clone ID: LIB148-024-Q1-E1-C5
acgcgtccacccaagcgtccgagtacgggagccgagaactatgtcnccatccagaggacgacgagcgtgccggcggcgagaccaacagagacgctcaagaacgaggaacaggaggtcgacgagctgctgatgcagttcgacgagaaggagagcataagcacctcctccattgaggagcacctgcaagaacggctccctgacgctgtcgatctgaaagccgtggatctcgacagcagcatgacgacgtcctcctcctccagtcaggaggagtgccaggatcacgagtgagaagcggcggaca

SEQ ID NO: 9077 - DNA, 441 bp, Zea mays
  Clone ID: LIB148-024-Q1-E1-C6
acccaagcgtccgcccacgcgtccggagacaccaagcgtcaaacttgccaagcagctagcaaccaacccaagaaagctagacaccatacccatggctcgcgctagcgtcgtcttcgtcattgctactctcctcttcgtcgccatggttgtggcaccgatggccgaggcaaagtccgctgatgccccctccgccgacgcccccgcccccgctgctgacgcacctgccgatggacctagcggaccggcgggtgcacctggtccccagggcgtcgagggtctatcgggcaatgaggacgacgatgatgactccaccaactaaggccaagcacgtcggtccggttgcatttggaacaagacatggaagaaaagtgagagcaatgtcgtttaaaaacaaaagtccataataatgtgtggtcatccgtgatatgttcttgctctccc

SEQ ID NO: 9078 - DNA, 457 bp, Zea mays
  unsure at all n locations
  Clone ID: LIB148-024-Q1-E1-C7
gggtcggccacgcgtccacggaacccggcgccctcaccgtcctcctcgcggacgagcacgtccgcggcctgcaggtccgccgcgccgccgccgacgactgggtcaccgtgcagcccgtccgcgacgccttcatcgtcaacgtcggcgaccaagtccagatactgagcaactccgtgtacaagagcgtggagcaccgggtggtcgtgaacgccgaggaggagcgcatttccctcgcgctcttctacaaccccaagggcgacgtccccatcgccccggcgccggagctggtggcggctgcgagcctgccggcgctctacccgacgatgaccttcgacgagtacaggctctacgtcaggaacaagggcgccaggggcaaggcgcagatcgaggctctcaangggcaggggaacacagaaagtcaattatagacgacgactagctagctactagctagtac

SEQ ID NO: 9079 - DNA, 432 bp, Zea mays
  Clone ID: LIB148-024-Q1-E1-C8
acttcagcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatctcctaccacgtcgtcaagctgggcatccggccggacatcccgaggtgctgcccgcgggcgctggtggagatcatgacgcggtgttgggacggcaacccggacaaccggccggagatgtcggaggtggtggcgctgctggagaagatcgacaccagcagcggcaagggcggcatgacgcccgtcgacgacgtcgcgcaggggtgctcctgcttcggcttcaaccaccgcagcgtcgcct

SEQ ID NO: 9080 - DNA, 412 bp, Zea mays
  unsure at all n locations
  Clone ID: LIB148-024-Q1-E1-D1
acacacgagtctactgacatgcactacaagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgnccaaagac

SEQ ID NO: 9081 - DNA, 210 bp, Zea mays
  Clone ID: LIB148-024-Q1-E1-D10
acacgcctctacactgactcgtaatacaaaggggctcaagacttcatcatgcatgcatgcataacacctcgagtaggagttgaagtacatgatcattgatggtatatatatagaggaagcatgtctatctaataagtccctcatccaaaattgttctttatgtcatgtatatgtacgtgcatatatatatataaaaatacgtctcctttt

SEQ ID NO: 9082 - DNA, 395 bp, Zea mays
  Clone ID: LIB148-024-Q1-E1-D11
cacgcctctacagtcactcgtaggacgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctgggtaccaggataagtgcgcagcatg

SEQ ID NO: 9083 - DNA, 396 bp, Zea mays
  Clone ID: LIB148-024-Q1-E1-D12
acaagcctctatatcaagtctgatcaaggtggaccaagagcagaaggccagcaactcgcggttcatgacccagaagccggcgtcggcgatagtgtcaaagctggagcagatcgctgagacagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcataattgaagccatcctc

SEQ ID NO: 9084 - DNA, 430 bp, Zea mays
  unsure at all n locations
  Clone ID: LIB148-024-Q1-E1-D2
agggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccnacaagaagcaggacgacaagcccaagccgacgccg

SEQ ID NO: 9085 - DNA, 400 bp, Zea mays
  Clone ID: LIB148-024-Q1-E1-D3
aatccaaataattttactaaacaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcg

SEQ ID NO: 9086 - DNA, 416 bp, Zea mays
  Clone ID: LIB148-024-Q1-E1-D4
acgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgct

SEQ ID NO: 9087 - DNA, 294 bp, Zea mays
  Clone ID: LIB148-024-Q1-E1-A1
acaacaccctagaatgagtcgtatgagctcaagctgggggcaacagaggcggttctactgtcagcgttagagagtttctttgacgttgttttgaactatccaaagatcaataggaggttatgtgacgtgatggagctcttgtcctggaagcaacccaagtgcccccaattgtacatatacagctccgccgacagggtgatcccagcgaaatcagtggaggcattcatcgacggccagcggaaagccgggcatgaggtgagggcctgcgacttcgtgtcatcgccccatgtggac

SEQ ID NO: 9088 - DNA, 422 bp, Zea mays
  Clone ID: LIB148-024-Q1-E1-A11
tacaatactctagaatgagtcgtattacaagagggttggcaggaagactaccttgcggcaggatttggccaatgctctagatataagggccttcgagaggatgacgaagctaggccactgcgatgtggagcttcttagaaaagagatgaatgagactgatgtccccgtatcttactcaggcactggcatccctgagaagtcaatacgcaaagcagctcttgaggttattctccgcaggctcctctcttttctcaagccagacacctttcagggtgccatcaaggcaatcaacgaaagaattctctctgtccttgatgctcctggttctggtcgtgttgatctgggtatgttcttcgccatcattgctccaatctgttcaggccctgtggataggcgcaagcgtatcgtctttgatgcacttc

SEQ ID NO: 9089 - DNA, 417 bp, Zea mays
  unsure at all n locations
  Clone ID: LIB148-024-Q1-E1-A12
tctatactgacgtcgtaatagttggcaatgagctcaggatatcctccccaacaaatcccacaaacgtttggttattatcagacacatggtaaaccagcttgctgcgagccatcacaggctgaaaggtacacgctgcatcagcaggctgcctatgcctgcgcaaaccgtacagccgcgtctgatgttgctctggacatgagagcacccccttttcagcatctatcggcagggcagagaagtgactcttgtgataggctgacagcagagacaaacttgtacacgagatcaaccaacggcatcgctgccactgcagcaggagtggcagcaactactcacagaaaggtcggcgttgttccgtttggcatgtcanacatgttatagtgactggatcatggccgaatcatggtgaatcctctg

SEQ ID NO: 9090 - DNA, 430 bp, Zea mays
  Clone ID: LIB148-024-Q1-E1-A2
caatccttgcacccctcccctccgtcaccccaccacatccggccagcccaacgaaaatgtcgcgcgccacagctgcggtcctcttctacatcctcgccgtcgctgcgctcagcgcggccgaggcaccggcagagtcaccgaaggcaggcagtcctgccaaggcaccggccgagtcaccgaacgcaggcagtcctgcagctcctgccaaggcacccgagtctgctgccacgagaactgcccccgctaatgcacctcaagccgcctccacccccgccgttgccgctgccccatcgtcgtcgtcgtctaggaagtctggtccagctgccgcgccgaccaccgccgcctctacaccgtcgtcttccacggacgaggagttgagcccttccgcgtcgggatccaccgccgacgtggcgtcgcctgccgctgatgg

SEQ ID NO: 9091 - DNA, 443 bp, Zea mays
  Clone ID: LIB148-024-Q1-E1-A4
acacgactctagactgagtcgtctcaaagtcggagagtgaagtttccaaggagatgttctctcgtcaaaactccggagaggccacgtccaaactacgtatacacgaagaagtctcaccggagaactgctctgctcttcagagctccaaggaggctgcacctgacgcatgtggggttgaagactccgtggacgtggagaagggcaagggctctcaccaagactccaaagacgatgtacctgtcagtgagagatgtgaacagtggctccatgtgctgaacaagaacgatgctgagagcatgagtgagaaacataagttggttgagcagatcaggatcctgttgaagaacgacgacgaacttcggaactatgcaggtgctaatggtattactgagccactaatccattttctgaagatggctatccacagaggaggtgtgcaatct

SEQ ID NO: 9092 - DNA, 275 bp, Zea mays
  Clone ID: LIB148-024-Q1-E1-A8
acgcgtctaccctagcttctggtccacatccttttctctcctcatctggggattaatcctgattgttcttctggcagtagtaagactagaaggatcggatcggagtcatcagcctatgtcgaggtcaggttcgggaatggccgtctgtgatgaatgcatgctcaagttccaggatctctccgcatgcaggagcttcggcttcatcgtgttcaagatgaaccagaacgtgcagcaggttggtttggacaggctgcgggggccaggagatattctac

SEQ ID NO: 9093 - DNA, 251 bp, Zea mays
  Clone ID: LIB148-024-Q1-E1-B1
atagtgtgtcgtattacacggggtttggcgcggcggcgctccttctgctggcgggtcgcgccgctgccttttggtgctttgggaaattggtgcgtggattgcgaggaaagttcaggggcacagatcaatctgtgggagtagccaaccaacttcaacatcgtgcatcgattagtcaggttcgtgacccaaagctacatgacgacctagaaactcttggcggctgtgactagctttttgcgtgccggctgttc

SEQ ID NO: 9094 - DNA, 425 bp, Zea mays
  Clone ID: LIB148-024-Q1-E1-B2
taaaatacgacagatgactgtcgtgagcatcatgtggtcattagtgcaggtgcaggtgctggtggcggtggcactatcatttctagtaggcggtgcctggtgtggtcctcccaaggttcccccaggaaagaacatcacagccaactatggtagtgattggctagatgccaaggcaacatggtatggcaagcctacaggtgccggccccgacgacaatggtggcggatgtgggtacaaggacgtgaacaaggcccctttcaacagcatgggcgcatgtggcaacgtccccatcttcaaggatggtctgggttgtggatcctgcttcgagatcaagtgcgacaagccagcggagtgctctggcaagcccgtggtggtatacattacagacatgaactatgagcccatttgcggcatacacttcgacc

SEQ ID NO: 9095 - DNA, 378 bp, Zea mays
  unsure at all n locations
  Clone ID: LIB148-024-Q1-E1-B3
tcaaacgtctacaatatgtcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcataccccaagggcgacttccttgtcngacaactcaacttcacangcccttgcaaagggcgacgttgacatccaggtggatggcaatctgctggcgaccaccgacctaagccaagtacaaggaacatggtaat

SEQ ID NO: 9096 - DNA, 85 bp, Zea mays
  Clone ID: LIB148-024-Q1-E1-B5
tctatattgaatcattgtattatgctcaccaatgatagttctactaaaggatgaacgagatactctttggttctttgaaagaatt

SEQ ID NO: 9097 - DNA, 435 bp, Zea mays
  unsure at all n locations
  Clone ID: LIB148-024-Q1-E1-B6
aattcagggtggttagccagatgcaggctatcgtcgagcgttatccatgctggggtgatactgttgaagtaaatacatgggttagtgctaatggtaaaaatggaatgcgtanggattggcatatacgtgattctatgacaggccacacaatactgaaggcgacaagtaaatgggttatgatgaacaaactcactaggaagcttgcaagaattccagatgaagtgcggactgaaatagagccatactttgttgggcgttctgctattgttgatgaagacaaccgcaagcttccaaaactgccagagggtcaaagcacttctgcagctaaatatgtgaggacaggcctgactcctcgttgggctgatcttgatataaaccagcatgtcaataatgttaaatacattgcgtggaatcttgagagtgcaccgattacta

SEQ ID NO: 9098 - DNA, 199 bp, Zea mays
  Clone ID: LIB148-024-Q1-E1-B7
agccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagttcaacctggtgctg

SEQ ID NO: 9099 - DNA, 294 bp, Zea mays
  Clone ID: LIB148-024-Q1-E1-C1
ctagcaaccagcccatgtctggtggcgctcacgacgagcttccaccggtggccaagacctctgccacgcccgaaccgtacgcatctctgaacgtcgccggcggcgggcagcccaacgagccggcggcggggaggccgccgaagctgtcgatggagacgttctcggggatgatcaagaggccgttcgccaagttcctgagcccggtgatcaagagcgtgtgcgccaagacggagtacccggaggactgcgagtcgtcgatcgggggcctcacgggggccggcgtcggggcggcca

SEQ ID NO: 9100 - DNA, 399 bp, Zea mays
  unsure at all n locations
  Clone ID: LIB148-024-Q1-E1-C10
acaacactctagactgagtcgtactattgtaaacgggttagcagaagaacacacagggtgacaacaaatccttgttcggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgacccctaagcagtctgcgtcttgtgcctgctgctgtagcggtagagcagagagagagatcaaatgtaaattacatttnttagctcaaattcacgacannnaa

SEQ ID NO: 9101 - DNA, 380 bp, Zea mays
  Clone ID: LIB148-023-Q1-E1-H9
ccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggtgtcaccgacgcgaccggcacctacacgatcgagctc

SEQ ID NO: 9102 - DNA, 342 bp, Zea mays
  Clone ID: LIB148-023-Q1-E1-G4
aacggtgactcgggcggactcgtgggcaggcaagggcgcaaccaataatagcaagtgtgatcatccgttgatccatcttgctaataagcctgcgtgcccttcattcttcctcgtctcgatatcgacgacgctccgttcggctccggcaaaccacatcaagtcgcgatggacatgaataaggtcgcctgcgccgtcctcgacgttgctgactctgccactgtggtcatcaccgcagacgcatcggcgtccgcctacagcaaagggtcttcggccgcgttcactgacgtcggtgccgtacttggcacctacgtgctctacttcatcccctactaccttcagtaa

SEQ ID NO: 9103 - DNA, 271 bp, Zea mays
  Clone ID: LIB148-023-Q1-E1-G5
tatcaacctgtacacttcagcaagagctgggaaaactaacaagacaattgttgcagttgcacctacattcgtctgtgctaatcgtgctgagaacagacgagagttttacacagacttaaaagatcaacgcacagctttggcacatgagaatatccagacacacgccagcaagagggaagaggaaaaagaatctctatgacaactgaggaataacttggacgtccgagcataacgcatgtgatacttcgagcactacggacacccaccaaac

SEQ ID NO: 9104 - DNA, 364 bp, Zea mays
  Clone ID: LIB148-023-Q1-E1-G6
ccgccacgtcgcgggtgggtttccaacagcgtcggatcgttgttctcccgtccttccgccctatcgcccatgccgatactttctaccagcatatatggaatccctccgctggtgtcttgctttttccctcggtctggtggcaggagttcctttctcctccttggctccattgtcgtccgttccttttcttcgtaccccgatttctcttgctttgtttccttgtcgcctgtgcaccggatccatgtgtgttggctcatcatttgtattgttcttgtccgtccaactgattagagtttctggcttggtagaagatcaccccgaccttgcttatcgcctcgtgttttccgtattttttgatattgag

SEQ ID NO: 9105 - DNA, 347 bp, Zea mays
  Clone ID: LIB148-023-Q1-E1-G7
cacacacgtacattcacccggcggcactaatggcctcggttccggctccggcgacgactaccgccgccgtcatcgtatgcctatgcgtcgtcctctcctgtgccgcggctgatgacccgaatctcaccgattatctcatccacggccgcgtgtactgcgatacctgccgcgccgggttcgtgactaatgtcacggagtatatctcgggcgccatggtgaggctggagtgcaagcacttctgcaccggcaatctcgagcgcgccagcgacggtgtcatcgatgcaactggtaactagactattcatctcatcgacagccacgatgacgacatctgccaggtggtgctg

SEQ ID NO: 9106 - DNA, 381 bp, Zea mays
  Clone ID: LIB148-023-Q1-E1-G8
gcatgatctccaactccaccagtgttgtggaggtgttctcccgcatcgaccacaagttcgacctcatgtacgccaagcgtgccttcgtgcactggtacgtcggtgagggtatggaggaaggtgagttctctgaggcccgtgaggacctggcggcgctcgagaaggactacgaggaggtcggcgctgagttcgatgagggcgaggatggcgacgagggtgacgagtactagagaagtttgctgatgacgcagcatcaggccagtgtgctgcccttatcccgtgatctgccgtgagttgctcctgctatcgtgttatgtgtgtctgttctgaagtattgtgtggtttacaacacctgatgttgtaagagttgttaattcccct

SEQ ID NO: 9107 - DNA, 374 bp, Zea mays
  Clone ID: LIB148-023-Q1-E1-H1
acccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgtcgccgccttcgcgtaccttcacccgtggaagacggcgtccactgtgcagcgctaccagc

SEQ ID NO: 9108 - DNA, 399 bp, Zea mays
  unsure at all n locations
  Clone ID: LIB148-023-Q1-E1-H10
cgcatccggttgcggggcaggtcggccgcggagcagaagagcgacgccgccgcgttcctcaccgacctgctgtccaactactcggccgccatcacggatctgcactccatcggcgcgaggaagttcgccatcatcaacgtggggctggtggggtgcgtgccggtggtgcgggtgctggacgcggacggcgggtgcgccgaggggctcaacaagctggctgaagccttcgacgtcgcgctggggccgctcctcgccggcctcgccgacaagctgccggggctgacctactcgctggccaactccttccgcctgacgcaggacgccttcgcggacccgaaggcgtcagggtacagcgacgtggccagcgcctgctgcgggagcnggcggctgctgggcgga

SEQ ID NO: 9109 - DNA, 383 bp, Zea mays
  Clone ID: LIB148-023-Q1-E1-H11
gcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcg

SEQ ID NO: 9110 - DNA, 381 bp, Zea mays
  Clone ID: LIB148-023-Q1-E1-H12
accacgcgtccggcggcaaggacctggaggccgcgcctgccttcaccttcgaggccggcaagacgtaccgcctccgcgtctgcaacaccggtatcaaggcgtcgctcaacttccgcatccagggccactacatgaagctggtcgagctggagggctcccacaccctgcagaacacgtacgactcgctcgacgtccacgtcggccactgcctctccgtgctcgtcgacgccgaccagaagcccggcgactactacatggtggcctccacgcggttcatccacgacgccaagtccgcgtccgccgtcatccgctacgccggctccagcgccccgccggcgccgaacatgaccgagccaccggccggctgggcctggtccatca

SEQ ID NO: 9111 - DNA, 431 bp, Zea mays
  Clone ID: LIB148-023-Q1-E1-H2
gatgactcccgggcagtgcaacctggtggtggaaaggctgggcgactacctgctcgaacaggggatgtaatgacaaccccttcccctggaatgcatgttgatgatgttgctggttccaacttcgttttcagtaataataacaacaaagcgaagaccctcctacctaccctatttgcttgagcggctcttgtccgcgccacaagataccaattgttgcgctgggaatattcagttacgatgacccgctttagttcagtttcttttttttgggggttggttcgatcatttggctgtagcgtgaatcgcttggacaacagactccaattactaagcaaatattttttcttctgcatatatttgaagaatcttgttcagggccccttttcaaaatgaacgcggggaattttttttttcttgtttccaatgtcttt

SEQ ID NO: 9112 - DNA, 389 bp, Zea mays
  Clone ID: LIB148-023-Q1-E1-H3
cggggccgaccaacccgtcgggttagatgccgcagcccgtcggcggcagctgccactcctgacatgtttgacgctctcgagagcggcccaggacctcctctagaagtgcctccctcgccatcgtcagccaagaagcgtttgtcccaggcgttcgaggtcaacccgagtgcctcagcgccgatcaaggtggcgttggagagggtaaagcggcactcgcagctaatttccagtcacaggatgtcgctgtcctgagtcaaagcaggagatgggacgcaaagtgttgtgattatacgatacgtcgggtgacacttgtgttttccttttgcgtgtgtacgtattacttgttacgtgtgacatggtgggattttttgtgcctacatatggtgggg

SEQ ID NO: 9113 - DNA, 446 bp, Zea mays
  Clone ID: LIB148-023-Q1-E1-H4
ggccacccaagccttcggaaggcaaaccattcacacccggccattccgagcagagaaggggaggtacctgctacgactagctagattccacgcccgatggcgcccaccaggatccgcgtggccttgctgagcttggcgctggtggggctgctcatctgccacctcgccaccaccgcctccgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgaccagttgaagcgaggaaggtggccaaaaactgaggggcccggctactatcttttgctataactaaagatagggcca

SEQ ID NO: 9114 - DNA, 426 bp, Zea mays
  Clone ID: LIB148-023-Q1-E1-H5
cccacgcgtccgcccacgcgtccgctctccaatctgacaacacttctcacagtcaagatgatgactcatattctgtcacttcttcaactgtaacttcagcaagagctgggaaaactaagaagacaactgttgctgttgcacctacattcgtctgtgctaatcgtgctgagaagagaggagagttttacacaaaattagaagaaaaacgcaaggctttggaagaggagaaactccaagcagaggccagaaagagggaagaggaagaagaagctctaagacaactgaggaagaacttggtcgtccgagcaaaacccatgccaagcttctaccaagagggacccccaccaaaggttgaacttaagaagggtgctccaacccttgcaaggtccacaaaattgacacggagaaagagctgcagtgaaaccc

SEQ ID NO: 9115 - DNA, 352 bp, Zea mays
  Clone ID: LIB148-023-Q1-E1-H6
acccacgcatccggccgtgaggcctcggtcgaagagtacgggctcacccgttgccgacattcacaccgggggagaggtgatcgaggggcatgggcaccattccggcgacaaccttcgcagtaatcataccggtctgcttccgtaccacgtgtggtacagcagtcgacgacaattgcactaacggagtcttgtagcgccacatgtattgacgacactaggcgcgccggtgttcgtgaataatgtcatgcactagatccatggcgcgaacgtgaaggtggcgtgcaagcatctcatcagcgggactgctcgagcgctccatcgacagggtgatggactggaaccgtacgtacac

SEQ ID NO: 9116 - DNA, 365 bp, Zea mays
  Clone ID: LIB148-023-Q1-E1-H7
ctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacag

SEQ ID NO: 9117 - DNA, 405 bp, Zea mays
  unsure at all n locations
  Clone ID: LIB148-023-Q1-E1-H8
gtcgtacgccggcgtccctgctagtgcctgccgttgaactctccggccaccattgatccgacctcccctaagccatctatgagtagagaaaaacagtgaacgccacctctgtactcgccccaccttatggcgcgtcgctcctgcagtaccggcccacgctctgcgcggtgctcaggtgttacggctgccctcaaatccgtcgtcggaccattggcactggggcaagcaaaagcacggacaggtgctcggcgtgctgcaacggcttccgatttgcccggctagatgaaagacggctggggagcatcttctctggggaacaccgcgcgtcatgggtgccttgccgaagttcagggacngcgtgattgctcatcgtcgttcatgctccaacgtggggcnacccatctc

SEQ ID NO: 9118 - DNA, 302 bp, Zea mays
  Clone ID: LIB148-023-Q1-E1-G3
ccttgcagaggactgtgaggtacagtttgagttcacggcaatggctgctaacattgaagatttgactgctggaatgctaggtcgccgtcccggagaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcaaatactaacactaccccattcccttccaggttccgggaggtctatgactactattcggcactttttg

SEQ ID NO: 9119 - DNA, 381 bp, Zea mays
  Clone ID: LIB148-023-Q1-E1-E8
ccacgcgtccgagaatggacaggttgttgcagtgaagcaacttgatcgcaatggccttcaaggaaacagggagtttctggttgaggttctaatgcttagtctgttgcaccatgacaatctagtaaacttaattggatactgcgctgatggagaccaacgtcttcttgtatacgagtttatgccattgggatcacttgaggatcatttgcatgatattccacctgataaggaacctctggactggaatacacgtatgaagattgctgctggtgccgccaagggcttagagtacttgcatgataaggcaagtcctcctgttatttacagggatttcaagtcctcaaacattctactcggtgaagggtttcatccgaagctatc

SEQ ID NO: 9120 - DNA, 392 bp, Zea mays
  Clone ID: LIB148-023-Q1-E1-E9
ggtcgttacaagcctctagaatgattcgtattatccgcggcggtgcctaggcccagcagagcagatggatcggagcaggtgcctacgcccagtctgccaggccgcgccgcgctcccgtcatcatctattcatctcctcacccagattttgcttccctcgctcgctctctcattcgtttgtgcagctgattacgctaggtctatttacgcaactgtcgtgtgtcgaattttaacagcgacggccatgcaccatacccccaccccacacatcattttgtttcttcctttcttttgattcgacgacgcctgtgattcatgcatgctctcgatcgaggcagagctgttgtatgttgttatggtgtactattctatttttttatttagaaagttttg

SEQ ID NO: 9121 - DNA, 391 bp, Zea mays
  Clone ID: LIB148-023-Q1-E1-F1
atttccctgtgctccgctccatccaggtctcctcttgctcataccgcaacgctctatctctttcgccgagctcctcgaaaccctaagagcgtgcttgaccggcggccgcgaggtgatggcgatggaccctgacgcggtagcgaacgccttcgtggagcattactaccgaacgttcgacaccaaccgcgcggcgctggttgggctgtaccaggagacctccatgctcaccttcgagggccagaagttccagggcccctccgccattgccggcaagctcggatctctccctttccaggcctgcgagcatcagatcgtcaccgtaaactgccagccatcgggtccccacggaagcatgctcatcttcgtcaccggtttcaaacgcaacgggccc

SEQ ID NO: 9122 - DNA, 388 bp, Zea mays
  unsure at all n locations
  Clone ID: LIB148-023-Q1-E1-F11
cccacgcgtccgggcgaggtgtttgtgcccatcgacgacctcctggccggcgccgacaagggtggcgatccgaggcccgtgagctaccaggtgcgcaggccgcactctggccgcgcccacggcgtcctctacttctgctataagttcaccgaggtccccgccgtctcttgtgtctcggaaccggaaagcaaacaagtccagtacgccaagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccancgtacgggtacaatgctg

SEQ ID NO: 9123 - DNA, 361 bp, Zea mays
  Clone ID: LIB148-023-Q1-E1-F2
gaatcaagagtcatctctatgtctttgacattgcacggatgcagcttttgcctcgacgcataccagttgactccacactgctgcatgaccatcatagccatgtgacacggccaacagcgtggcttagtcatataaatgtgacgtaatacctcgatccaatgtccacgaacaaggattctacatacgctgtcgcctagatggctgctgtggccgaccgctgtattcactacgaaggtgaattccgtctcatcatgaacatcatcgtcaatgcactgattcccttgccgcacaaccagtctggcaatcgccctatcggctcgtcaactaccatgctgccgagcgatccggactgtgatttctc

SEQ ID NO: 9124 - DNA, 393 bp, Zea mays
  Clone ID: LIB148-023-Q1-E1-F3
gggccaaccaagccttcgggaaaaggggaagggcggcaaggaaagggctccccttcttgtcccttcccttcttcttcttcttcttcttctctcaaaaacccaatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctgg

SEQ ID NO: 9125 - DNA, 420 bp, Zea mays
  unsure at all n locations
  Clone ID: LIB148-023-Q1-E1-F4
ggccaaccaacgcgtcgggctacccaggacaatgctctgaatctttgcaccgagaaagtcttactggcacgccaagcttatgacctgatagagagccatataaaacgccttgatgaagacttgggccagtttgcagaagatttaaagcatgaagggaagatacctccagatgaacctacagtccttcctccagttccggtggttagcagggatgagaaaaggaggtttggttttagtacacctcaagcatcaaaaaaatttagagagagggaatgggacagggaaaggggtatggactttgatttaatgccccctccaggtagcagcaagaaagcaggtacatctatggatgtggatcanacaattgattcaaatgaaccgacatactgtatatgccaccagatttcaaatggtgacatg

SEQ ID NO: 9126 - DNA, 381 bp, Zea mays
  Clone ID: LIB148-023-Q1-E1-F7
ataatttcaatacaggttgaaaacttgaaatcaacacaaaaaatacctgaaaaaggtacaagcaaagaaaccttaaacgtgccatggaacacacgtccccaatggggctatcgttaccatttcaacatacacgaccattttctacacacaactttgagtgaagatttatcggacacaggtggtaatcgtctgacatgtcctgagatacacggagactgatggtgccaggctagtgggttgagtacaggatgagcgcaaccggtagtgtgtatatcacgttctttgtactcaagaattttgtacagacagaaggcggtgcggatagcatgccttgcatacataataatttcaatacaggttgaaaacttgaaatcaacacaa

SEQ ID NO: 9127 - DNA, 385 bp, Zea mays
  Clone ID: LIB148-023-Q1-E1-F9
gttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgac

SEQ ID NO: 9128 - DNA, 360 bp, Zea mays
  Clone ID: LIB148-023-Q1-E1-G1
cacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacga

SEQ ID NO: 9129 - DNA, 404 bp, Zea mays
  Clone ID: LIB148-023-Q1-E1-G10
tctcgcgggtcgatgcaagtctctagaatgaggcgtattaagagagagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccatgtccggcaagcctctatggtacgagggggt

SEQ ID NO: 9130 - DNA, 418 bp, Zea mays
  Clone ID: LIB148-023-Q1-E1-G12
gcggtggataagctcctcaccaggggcagcatgctccagctcgtccatgtgagggttgaagcaaacaaagatgagggtgacgcagagataacacagctatttatatcatatagagggtattgtgctcgtaaagggatgcatctgaaggagttgatcttggatggcactgacatctccaaagcaataattgactatgccactagcaatgccatcacagacattgtcgtcggcgcatcaactaagaacacattcatcagaaggtttagaaatcccgatgtcccaacgtgtttgatgaagatggcgcctgattattgcacggtacatgtcatccacaaggcaaaagccatccaggtgaaggcagccaaagctcctgcaccctttgctactctccctccaaagcaacactcgcaaccaaaca

SEQ ID NO: 9131 - DNA, 385 bp, Zea mays
  Clone ID: LIB148-023-Q1-E1-G2
cagaagtttgaggcaactgttggtagcaaacgctggggactgccgcgccgtcctgtgtaagaaagggacagcggtggaggtgtcaaaggatcacaggccgacatacgacgcagagcgtcaaagggttatcgagtgcggtggatacatcgaagatgggtacctcaacggcgtactctctgtgacccgggctttaggggactgggacatgaagctgccccaaggctctccgtcgccccttatcgcagagccagagatccactggaccaccctgacggaagacgacgagttcctcatcatcggctgcgatgggatatgggatgtgatgagcagccagcacgcggtgagcacggtccgcaaaggcctccggaagcacaatgaccccggc

SEQ ID NO: 9132 - DNA, 426 bp, Zea mays
  unsure at all n locations
  Clone ID: LIB148-023-Q1-E1-E7
gttgaaggtagcaagaagactaaatggtgtccagctcctgactgcacatgtgctgtggagttccttggtgatgaaaactatgatgtttcatgcaattgcatgttcagcttttgttggaattgcactgaggaagctcatcgaccagtgaactgtgagactgtttctaagtggatattaaaaaacagtgcagaatctgaaaacatgaactggatactggctaattctaagccctgtccaaagtgcaaacggccaatagagaaaaaccagggatgcatgcatatgacatgcacccctccttgtaaattcgaattttgctggttatgtctgggtgcatggtcagatcatggagagagaacaggtggcttttatgcttgcaatcgttaagaatcaagcanagaaggaggaattttacgacaagactgatgc

SEQ ID NO: 9133 - DNA, 380 bp, Zea mays
  Clone ID: LIB148-023-Q1-E1-D12
accacgcgtccgccacctttaccaccgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacga

SEQ ID NO: 9134 - DNA, 385 bp, Zea mays
  Clone ID: LIB148-023-Q1-E1-D3
ccgggtccaaccaagcctccaatactccggtgctccaccaacattaacaacctccgctccaacaaccgcaaacgggaagaaagggttcccaattggccaaggctgttaccggctcattggtggtaatcatcaccaggggcccccggcatgtcatcaacgtcggatgactaggacgctacagagaccacaaggagctgaacgacatcacggtacgagcactgcgtgctcaaaaatactaacaacggcgtgcgcaacaagtcgtacgtgaatcccgactccgttctgactgattcgcatcgcaccttcgacatcatcatgatggaggacgtagccaaacccatcgtcatccatcagtacttctgcccgcataacgtatgccctggca

SEQ ID NO: 9135 - DNA, 387 bp, Zea mays
  Clone ID: LIB148-023-Q1-E1-D4
cccgggtccatccaagcccccaaattaacttcctacaaggcgagggatgggaccattggactgcataaggaattgcgtccaaatggcatggggcccggcaacaatacgccgtcagccgcagtcaaccagatggttgccgacgccagacactacatcgacaaagactacaatgagcatatgaagcatctgcatgacacgaaacacagactgtgtagtctagaaaacaaactaacggacgtctgatgtgtccgaccaggaggtcaacagcatcctgaagcagttcgataagaaggatatggagtacatgcagttgcagaggcacattgttaacgtcaaagatttcgagctgctaacaatgatatggaacggagcttttggcgacgtcag

SEQ ID NO: 9136 - DNA, 385 bp, Zea mays
  Clone ID: LIB148-023-Q1-E1-D5
gcacgggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacata

SEQ ID NO: 9137 - DNA, 377 bp, Zea mays
  Clone ID: LIB148-023-Q1-E1-D6
ggacgaaatggcagcgactgtcgcctcgtttttttgccaacaaacaaaaacaaagcagcggtgaagggaggggaggaaaggaaacagcaaccacatgcgattatttcttggggattccgcccctccgacctatctaagcggaccataaccacgggcagcaggacattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggacaacgggcacgccaagtaccgggtggccgtcattggcaacggg

SEQ ID NO: 9138 - DNA, 385 bp, Zea mays
  Clone ID: LIB148-023-Q1-E1-D7
gccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaag

SEQ ID NO: 9139 - DNA, 362 bp, Zea mays
  Clone ID: LIB148-023-Q1-E1-D8
atggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaagtggatggcaatctgctggcgaccacggacctaagccagtacaaggaccatggtaattg

SEQ ID NO: 9140 - DNA, 313 bp, Zea mays
  Clone ID: LIB148-023-Q1-E1-D9
taaacacgcgtccgcccacgcgtccgggcctcgtcgccgccccctccttttcccctccctcccacacgcaccgccgcgtccgcccccttcgctgcccctgcccggtcggttccgatggggtacgtgctgtcggcggtggcgagggtgctggagcagcccacggcgtggggggcggcccgggagatggcgctcctcgcggggccgctctgggcggcggtcctcctcgggctcctgctcggctgggcctggcgcccgcgctgggcagctggactcgtcgccgcccccgcgcccgcagccgccgcgcaaccgccct

SEQ ID NO: 9141 - DNA, 367 bp, Zea mays
  Clone ID: LIB148-023-Q1-E1-E1
tagtgctccgctaggtcaatcgaagagtcgaaagatcccagctttcccatcccatggcgggcggcgacctcacgcctcctcctcctcctcccgaagagacgccgccggcagcggcggccgaggacctgatcgagatcgtggaggaagggtcggggcggctggacatcgcgcggtacgtggaccacgtgcgcgacctgtcggcgggcgccatcgcgacgttcgatggcacgacgcgggaccacttcgcggggcggcgcgtggtggagctccggtacgatgcgtacgcggccatggcgcggcgccgcctggctgtcatactgctggaggcccggtcgctgcacgcgcagctgctgctggccgtggagca

SEQ ID NO: 9142 - DNA, 377 bp, Zea mays
  Clone ID: LIB148-023-Q1-E1-E11
cacaaacagatcgatcgattacagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgccgcgacg

SEQ ID NO: 9143 - DNA, 354 bp, Zea mays
  unsure at all n locations
  Clone ID: LIB148-023-Q1-E1-E12
cccacgcgtccgcccacgcgtccgcgacaccaccgtgtggtcgacaaaataaaaaggagagagagagagatggctctgtcgtctcgccgtatggccgccgcaccattcttcgtcgtcgtccttctcgtcctcgtggcggcagagaggacgatgggcagggtggtggtggaagagacgctctgcttgtcgcagagccatgccttcaaaggcgtgtgcctcagcaacaccaactgcgacaacgtatgcaagacggagaagttcacaggcggcgagtgcaagatggacggcgtcatgcgcaagtgctactgcaagaaggtctgctanggcatgaccggcagcaagccccagccgtac

SEQ ID NO: 9144 - DNA, 430 bp, Zea mays
  Clone ID: LIB148-023-Q1-E1-E2
agcaatgcgtcggcctacgcgtccgctgagagcttcgaaaggctggagaagatcgggcagggcacgtacagcagcgtgttccgggcgcgggagctggccacgggcctgctggtgtcgctcatcaatgtgcagttcgacattgtgcacctccagaacttgcagttcatggagcaggaaagttgtaaccgccgcatcctcagtggcctgccgaagctcgtcgaactcgaaggcatcaatacctcccgctcctctccctccatctaactcatcttcgaatacctctagcacgacctggtcggcctcaactcctcatccgatatcatcttcaccgagccccagatcaagtgctacatgcgacagctgctggtaggggctggcgcactgcaatgcacgcggtgtgatgcaccgggacatcatttgcgccaacctg

SEQ ID NO: 9145 - DNA, 367 bp, Zea mays
  Clone ID: LIB148-023-Q1-E1-E3
aagtccccaaaatgggtcctatctaaggtggaccggatgccaagcaagcaatggcccaacggggccaagaacaacttcaagtacaagtgggaacccaatggacaaattcggaactttctccacttcccgtcaatcggatgcaacgggcggcaggcgggtacggcgccatcagcgtggtgagccccctcctcatcacggtcgccttcgaccagccgccgccggagagcgaccacgcggtgctcatcggcgactggtacaccaaggaccacgaggtgctggggcgccagctcgacgccggcaagagtctgggccgccccgcaggcgtgctcatcaatcgcaatggatgcacagatcaggaagccacaac

SEQ ID NO: 9146 - DNA, 357 bp, Zea mays
  Clone ID: LIB148-023-Q1-E1-E4
aggtcaaccaaccccaaaccaaggaaaaattccattggcaagaagaaggaattgcctcccaatggcaaggagcccggcaacaatgcgccgtcaagcgcaaccaaccagagggttgcggcggccaagcagtacatcgagaaacactacaaggagcagatgaagcatctgcaggacaggaaagaaagacggtgtagtctagaaaagaaactagcggacgctgatgtgtccgaagaggaggtcaacaacatcctgaagcagttcgagaagaaagagacggagtacatgcggttgcaaaggcacaaaatgagcgtcgaggatttcgagctgctaacaatgatagggaagggagcttttggc

SEQ ID NO: 9147 - DNA, 385 bp, Zea mays
  Clone ID: LIB148-023-Q1-E1-E5
gatacaaccctctacactgagtcgtagtagacgagatccacacgctcatcgccgccatggacgccgacggcaacggcaccgtggagttcgacgagctctcctcctccctggcgccgctgctcctggggccctgccgccccgccgtggccgtcgaccacgcgcagctcgccgaggccttccgcgccttcgaccgcgacggcaacggcttcatctccgccgccgagctcgcgcgctccatggcgctcatgggccaccccatctgctacgccgagctcaccgacatgatgaaagaggccgacaccgacggagacggcgtcatcagcttccaggagttcacagccatcatgggcaagtccgccgtcgacttcctatgcctcgctgctct

SEQ ID NO: 9148 - DNA, 364 bp, Zea mays
  Clone ID: LIB148-023-Q1-E1-E6
agcgagcatatccacggcgatggaggcgagagcggccatgagctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctg

SEQ ID NO: 9149 - DNA, 392 bp, Zea mays
  Clone ID: LIB148-023-Q1-E1-D11
aggacgcgtgggcggacgcgtgggcggacgcgtgggcgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccact

SEQ ID NO: 9150 - DNA, 425 bp, Zea mays
  Clone ID: LIB148-023-Q1-E1-B8
ctgaaatggtgggagaaaaatgctggaccaaatatgattgacatccactccacagtggagttcttggatgcacttagagatgctggagacaatcttgttattgttgagttctacggaacctggtgtgcttcatgcagggctctctttccaaggctctgccggacagctttggagaaccctgatatattgtttctaaaagtgaattttgatgaaaacaaacctatgtgcaaacgactgaatgtcaaagtccttcctttcttccatttttatcgtggagctgacgggctacttgaggctttctcctgttccttagctaagtttcagaagctgaaggatgccattgcaatgcacaacactgctcgttgcagcattggtccacctgttggagtttgcgaatgttgacttgctggataacgcgagccctc

SEQ ID NO: 9151 - DNA, 366 bp, Zea mays
  Clone ID: LIB148-023-Q1-E1-C1
cacacgcgtccgctcctcccaaggctctctgcgagcagccgcggcggcggcgcccgtgcgtcctccttagcttctcggcagcgcgcgaccgcttcctccggggccggttcctctcggcgggcctgcgccccttctccgtccgcctcccctcgccggccggcaccagcaccgtcgtccacctctgggcgccgccgcggtccgcgcggcggcccgtgctcctcctccacggcttcggcgcgtcggcgacgtggcagtgggccccgtacctccgcagcctcctcgcggccggcctcgaccccatcgtcccggacctcctcttcttcggcgcctcctcgtccacggtccccgaccgctccgacaccttcc

SEQ ID NO: 9152 - DNA, 403 bp, Zea mays
  Clone ID: LIB148-023-Q1-E1-C10
gcgacgtgccccccgccgtgaacggtcccctccatgtcatccccaatgtcatcaccgccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacggcctccg

SEQ ID NO: 9153 - DNA, 380 bp, Zea mays
  Clone ID: LIB148-023-Q1-E1-C11
cagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgggaaactcgacggccgcgttcgccgcgccgcgcggctacgcgctggccacgcccgtggccggcctcctcgcgtacgacgcgtcggcggggcccgacgcgcgcgtctcgctccgggcgctcggcgcgccggtgcgcgtcgagttcaaggacgacctgtcggcggcggcgggtctggacaagggggtcgagttcgacgc

SEQ ID NO: 9154 - DNA, 363 bp, Zea mays
  Clone ID: LIB148-023-Q1-E1-C12
acacgcgtccggggctggcatcgctgccctcttgtccctgacctttctgcactgatctttccttggcgtggcttccattcacgttttccttcttcctctccgtgtttccctcttactcctcaaatgtagctctaactgtaacataatgttccttaaatagatataaattgtcatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaaaggttcaaagcttacttacccttgaatgcaagttcaaagcccttcaaaaggtgccccaa

SEQ ID NO: 9155 - DNA, 360 bp, Zea mays
  Clone ID: LIB148-023-Q1-E1-C2
gaaacaatccttgcacccctcccctgcgtcaccccacaatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaagaagtctggtccagctgccgcgccgaccaccgccgcctctacaccgtct

SEQ ID NO: 9156 - DNA, 376 bp, Zea mays
  unsure at all n locations
  Clone ID: LIB148-023-Q1-E1-C3
aaccaagcctccgcctggaatccaacaacaaagccaagaaggttcggtcaaaagaaaaggataattaaggccccgggggccattcaaacaaaccggcggcggcaaccggccggccgggcatgacgataacacggacaatgtgccaaggcctgctgcttccactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtcgatccgacctgcangangaagcaacagctaccgtaat

SEQ ID NO: 9157 - DNA, 366 bp, Zea mays
  Clone ID: LIB148-023-Q1-E1-C4
tcccgggtccatccaagcccccaaaattaatccttgtaaggacggcaaggggccggacacgccgctggaaaaagcggtctccggccggctgaagcaattcagggccatgaaccaattcaagaaggctgcactgcggttcatcgcggggtgcctgtcagaagacgacatccgtgggctcaaggagatgttcaagagcatggactccgacagcagcggcaccatcaccgtggactagctgccgacacggctggccaacaaggtcaccaagctgatcgatgccgaactccagcagctcatcgaagctgcctactccaacgggaacgggacgatcgactacgaggagttcatcactgccacgatgcacat

SEQ ID NO: 9158 - DNA, 380 bp, Zea mays
  Clone ID: LIB148-023-Q1-E1-C5
gttggagagatttttttttacccgagaagctgcgccgcgcgccaatctgatcatctccatgcgctgaagatcgttggtgcccgccatgcttcccgatgattgctgccacatcgtcgctgaggaaatttcaagccccatagctgcacatatactcgacttctactacggcgacgacggcctgggcgatgacctctttgccgcggtgactgccacctctggcccattccctgccactgacgatgatgtttcttcgtctaccgctaccacccctcctatctgcggctacagtgaagacaccgcagctgctggtggagccacagcctacaccccgttgacatccttcgacaccactctcacagccctcctggaggaagagcagc

SEQ ID NO: 9159 - DNA, 343 bp, Zea mays
  Clone ID: LIB148-023-Q1-E1-C8
gcatgatgcgtcgccgagccatgacgatgacaatagccgccgtgctctgcctgctcctcttctctggccgtcacgccgcggcggagaagactttccgcggaggctgaggcggaggctacagcgggttggatgccggtggctgaggctgcggctgcagctactccaccccgagcgaggcatcgccatccacgcctgccgctggggagactactaccccttcgtcaggcggcggttactccacccctagcgaggcagcgccatccacgcctgccgctgaggagacgaccactactccttcgtcaggcggcgggggttacggccgtgcaaccagcaaggcttcatc

SEQ ID NO: 9160 - DNA, 414 bp, Zea mays
  Clone ID: LIB148-023-Q1-E1-C9
gaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtccatcctctctttcttttcccctttctcaaagagctaggaccttgctcgactgagcatcaggctgtagggctctttgtgatcatcttttgccagttttcttcttgtagcagaagttgttgggcatggaactcctgttcctttcaccaatagaagcataatgatcagcactgtgaaacaatttttcc

SEQ ID NO: 9161 - DNA, 395 bp, Zea mays
  Clone ID: LIB148-023-Q1-E1-B5
ctcgcgggccgacacacgcctctaggctgggtcgtggtagccggcgccacagcctctcctgctgtcgctgctggtcgccgtgctagcggtggccgccgatgtacgctaacgccggccaagccaatcccctgaggcttggcgggcgcgtggtacaccacagctaaggtaagttcaccgccgggccgtggaaacacgcccacgcgaccttctaccgtgggcgggacgggtccggcatcacggctggctcttgcggctacaaggatactcgcacgcaggggtatggcgtgcacactgtggccgtcagcacggtgctgtacggtgacggcacggcatgcagatggtgctacgacgtatgctgcgtgaacagccctagcgggtgcaagcccaccggagca

SEQ ID NO: 9162 - DNA, 404 bp, Zea mays
  Clone ID: LIB148-022-Q1-E1-H9
cggcgacttcgatgaatactggcagcagcgcaagctcatggccgacgccgcggctgaggccacgtacaagcatgacccggtcgaggtcgccaaccaacttaaccgtgcagtccacagatccgtcgagaaggaggacattggcacgaggcgggagatgatggggacgacgacgaggaagtctaagttcagcgggccgtgcagggcgacgaacccgatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgacgtggtgaacccgcgccccggcacgctccggtggggcgtcatccagatcg

SEQ ID NO: 9163 - DNA, 382 bp, Zea mays
  Clone ID: LIB148-023-Q1-E1-A10
aggacgcgtgggcggacgcgtgggcggacgcgtgggtgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaagccccctgaaaatgctgcgcggcctcaactctactcgcg

SEQ ID NO: 9164 - DNA, 360 bp, Zea mays
  Clone ID: LIB148-023-Q1-E1-A11
acgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgccaaccccatcgccttcctccgcaaggagccgctccccaactgcggcgagctgctccgcgcct

SEQ ID NO: 9165 - DNA, 412 bp, Zea mays
  Clone ID: LIB148-023-Q1-E1-A12
aaccgactggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaagcccgacgcggcggcactggtggtgacggtgacggacctgtgcccggccaa

SEQ ID NO: 9166 - DNA, 363 bp, Zea mays
  Clone ID: LIB148-023-Q1-E1-A3
ccttggccggtcccttggccggccccttgggccccccaagttcggtcaaccggggcgggctaacaacccttccaaaaaagtaccacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggag

SEQ ID NO: 9167 - DNA, 465 bp, Zea mays
  Clone ID: LIB148-023-Q1-E1-A4
accggtcctagttcccgggtccaaccaagccttcagagcgccccccattcaaattcaaattcaaggggcttgtcatggcatccaaacttatcctcaaggaattaaaggacttgcaaaaggaccctccaacatcatgcattgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaaggttttgctttctatctgctccctgcttactgattccaacccagacgaccctcttgtccctgaaattgctcaaatgtacaagacggatc

SEQ ID NO: 9168 - DNA, 359 bp, Zea mays
  Clone ID: LIB148-023-Q1-E1-A6
acaccctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatgtatatacagctaggatcgatcgtcagtaaaatggcaggctccgccgtcctgaggagccccctgtccgtcctcctctacatcctcgccgccgtgcccgccaccgccgcggcgacaccgaccgacgccgccatcgacaaggcgtacgcacatctcgtcaacctcacggccaagcactagtactgggcggagcgcg

SEQ ID NO: 9169 - DNA, 387 bp, Zea mays
  Clone ID: LIB148-023-Q1-E1-A7
gcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaagtcaccaaggcctgcagcgtc

SEQ ID NO: 9170 - DNA, 383 bp, Zea mays
  unsure at all n locations
  Clone ID: LIB148-023-Q1-E1-B1
cgcgtcgcgcgtccccaccgtgcccgcccgcacaagccgccgaatgagatcctgggatccccctgcgacatcctcctccacgcgccatggccgcccccgacgtcctcgcgtgccgctccccgaggtggcgggcatggtgcgcgcagctatcgcgggggtcacgacggcgacgcgattccaggagctggtagactggatggaggagcggaaggcggcattcanggacgacggcaagtggacagagacggtgaatctggggctcaggagccccgcgctcatcatgttcgggctgcttcagttcgccatcgacagggacctcgggttcgggaagaccagcctcgtgctgccctgngtgcgccatggccggctggggtccgcgtccg

SEQ ID NO: 9171 - DNA, 374 bp, Zea mays
  Clone ID: LIB148-023-Q1-E1-B10
aaaaaacattgatgtttattcacatagccccagaaccagatgctattagtgagtccataagtactttgaagttcgccgagcgtgtttccactattgagcttggagcagccaagtcaagcaaggaaggaggaggaggaggaggaggagaagccagagagctcaaagaacagattgcttgcctcagggcagcattagctaggaaagatggagatcatgagagcatacgaagcactcaatcgagcccagacatatatagaatgggaacgggtaatgcatcacctgcgtccaggcacccaatagaagatgggatcatagagaacgactcagcattgggagatttggctgaacactcacagttcgggagcagcaattcc

SEQ ID NO: 9172 - DNA, 375 bp, Zea mays
  Clone ID: LIB148-023-Q1-E1-B11
aggacgcgtgggcgccagcaccaaccgcggatgcaaggcaattgccgagtccggtggggcctccagcgtcgtgctcaaggacgggatgacgcgagccccggccgtccggttcccatctgcacgccgcgccgccgagctcaaggcctttttggaggacccagcgaactttgacaccctggctatggtgtttaacaggtcgagcagatttggaaggctgcagggagtgaagtgtgcgattgcagggaggaacctttacatgaggttcagctgcagcacaggggatgccatggggatgaacatggtctccaaaggtgtacagaacgtgctggactacctccaggctgacttccctgatatggatgtcatcagcatatc

SEQ ID NO: 9173 - DNA, 348 bp, Zea mays
  unsure at all n locations
  Clone ID: LIB148-023-Q1-E1-B12
accacgcgtccggaatactcccatgacgccactaacaaattcaacatttaccctgagcaaatcccttcctggcttgttgactggattcctgagaaaggaggttaccttatagggaatctgcagccagctcacatggattttaggttcttctctcttggcaacctttgggccatagcttcgtctctaactactccaaaacaagctgagggaattcttagccttattgaagaaaaatgggatgatcttgtagcaaacatgcccctgaagatatgcttccctgcaatggaagatgatgaatggcgcattattactggcagtgattctacnaatgacccatggtcatatcat

SEQ ID NO: 9174 - DNA, 397 bp, Zea mays
  unsure at all n locations
  Clone ID: LIB148-023-Q1-E1-B2
gcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttggggtcacganaaaggac

SEQ ID NO: 9175 - DNA, 378 bp, Zea mays
  Clone ID: LIB148-023-Q1-E1-B3
ggcacgtctcactctcactccctcacacagatattaaggaaaggtcccgcccttttctcccgacatccataaggggggaggggaaaatacgtacattcacccggctgcaataatggactcggttccggctccggcgacgactaccgcagccgtcatcttatgcgtatgcgtcgtcctctcctgtgccgcagctgactacccgagcctctccgactacgtcatccatggccgcgtgtactgcgacacctgccgcgccgggttcgtgaccaacgtcaccgagtacatcgctggcgccaaggtgaggctggagtgcaagcacttcggcaccggcaagctcgagcgcgccatcgacagggtcaccgacacgaccggcaacta

SEQ ID NO: 9176 - DNA, 67 bp, Zea mays
  Clone ID: LIB148-023-Q1-E1-B4
tcccgggtccatacaagcccccaaaatgaatccttataaccgcccccttggccttgacccgcccggc

SEQ ID NO: 9177 - DNA, 402 bp, Zea mays
  Clone ID: LIB148-022-Q1-E1-H8
ctaattttcatttcaaggaagacaactgtgtaattaagagaaggaacgggacaagatgttctttcagaggaagaaatcaaagaaagccaaagactccagaggatcgcagaagaaggggaaagatgggcgtgggaagaatgatcttttcgatcgtgccaagggagggcttgatgccctcgcaggaagcctgcaggaagccaagaaggacgccgaaacggcgactgagaagcttcaaggggatgtgaagtcgggcatggaaacgatccggcacaagggctcaggcctccttgagaaagccaaagaagaactcgggagtcactccgacgccagccgttcctcaaaggaactagagcgaggaagcgaggaacaggggaacaacaaggacatggacgctttcagtgc

SEQ ID NO: 9178 - DNA, 408 bp, Zea mays
  unsure at all n locations
  Clone ID: LIB148-022-Q1-E1-G3
cggacgcgtgggttcaagcacctcctcttcccccgccgggcaacaactcagccgccgcaaccgccacatcagccatgggcgcctgcgcaaccaagcccaagacgcttgaggggcaggccccatctgatgccgccgtctccacacccaaggttgcgcccgaggccactccaatctccgttgaggttgcggctgatgaacaggtagctgacaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaatgtcgccancgccgccgagaccacga

SEQ ID NO: 9179 - DNA, 414 bp, Zea mays
  Clone ID: LIB148-022-Q1-E1-G4
gcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgccaacccctaccgccgcggctgctccgccatcacgcgctgcgcccgcaacatgaactgagcccagcgctagctgctgccggggcgcgccgtcgtcgccgagccggtcggtctggtctggtctggtctgcctgcctgccaggtcacgcagcctggctccaccgatcgcacaccatacattgacgtcgtcgtcgcggccgtacgtgccgttggacggtggaagaggcggtggcgctacgacagtatatatatacaca

SEQ ID NO: 9180 - DNA, 412 bp, Zea mays
  Clone ID: LIB148-022-Q1-E1-G5
gttcgtggatgccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacgaccagca

SEQ ID NO: 9181 - DNA, 414 bp, Zea mays
  Clone ID: LIB148-022-Q1-E1-G6
cggacgcgtgggcgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgca

SEQ ID NO: 9182 - DNA, 388 bp, Zea mays
  Clone ID: LIB148-022-Q1-E1-G8
ctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgccccatcgacggggtcaccgacgcgaacggcacctacacgatcgagct

SEQ ID NO: 9183 - DNA, 404 bp, Zea mays
  Clone ID: LIB148-022-Q1-E1-G9
gcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttt

SEQ ID NO: 9184 - DNA, 381 bp, Zea mays
  Clone ID: LIB148-022-Q1-E1-H1
tacccacgcgtctgctaacgcgtccggataggaacgcgaacagccgacgatcgcctcatcgccatggcacgctctgtccccatcgcgcctctgctcatgctcaccctcctcctcctcctcgtctccactgcgtcagctgcacggaccgtgggcgacaccgtgcaggacacgtgcaacatcacagtattcctcaggatctgcatggacagcctcaccgcacagccatagagccagaaggctatcccgctccggatggcataactgttcgtgaacatcgcggccgagaagggatgctggattgccacgttcgtgcacgggaagtatatcaatgccatggacagcaccgtgttcaagtgctacgacagctgctcggatgacgtc

SEQ ID NO: 9185 - DNA, 405 bp, Zea mays
  Clone ID: LIB148-022-Q1-E1-H10
acggtatcaacatcattgcgctcgtagtcggtgtgtcccgcgccgtgtacgcggagatcccgcagtacagcaagcttctgggcggcgggttcttcagcttctgggtgctggcgcactactacccgttcgccaaggggctcatgggtcgccgcggacgcacgccgaccctcgtctacgtctgggcgggacttatctccatcaccgtctccctgctttggatcaccatcagcccgcccgacgacaggatcacccagggcggcgtcgatgtgtgatcatccaagcttcaccaacgagagattaccaaacaaagaatagctgaaattttctggacgatttgcctagtttttgtactgaacactatgtctacttacgcgtactaattaattactgaccaatagtgtctat

SEQ ID NO: 9186 - DNA, 401 bp, Zea mays
  Clone ID: LIB148-022-Q1-E1-H11
agccttcgagggaccatccgggagtacacgcattacagcgagtacaagaactgggtgtggaagtcgcaggacgacctgttcctcaacggcgccttcttcaaccagtccggcggccagaacgagcgcatgtacgacaggctcgacctcatccaggccaagggcggccagtacgccgagtcgctcaccatgtacgccggcgcgctcaactgccgcgtcggcaggaagtgctagtgcgtgtgcagctctaggctgcagctttcatcattggcgatcgatcgtaacaatgcaaagttgtgttgtatataactcttgtgtttggaatgccgcccgtaattaatggtcaactctaacactgcttgcctttgcctgccggccagcaaaaagaaggctcgagcaacgga

SEQ ID NO: 9187 - DNA, 280 bp, Zea mays
  Clone ID: LIB148-022-Q1-E1-H12
gtgacccctggtttcttcagccttagaatctatcggtacgaggccatgattatcacggacttaaacgtttgcgatcacggggactgctccaaacgtgacgacaggatccagggccacacactttgcatggagcttagcacttgtgtcgatgatctcagcgatgatccgtccgacacgcagcacgatacctccgatgtgttctaggagctgcctgaagtggagctatgctcacagaatcgtcatcagcagtatacggcggtccatggtccagtctgacatc

SEQ ID NO: 9188 - DNA, 409 bp, Zea mays
  Clone ID: LIB148-022-Q1-E1-H2
gtgcctgctcgtcgtcctccacagcatgctgctgctcagggacggcgccgcccgccgcccgaggtgctgcgctagcgctacggcgtgcaagagcaagcaggcgtccaagccgtgctgcgcgacggtgaagccggtggcgacgacgaggcacaggcacgggcacgggcacgggcacgggcacgcaggcgcggggaagcccgggacgctaggaggcgacaagcagggtaaggactgccatggttgctgccagaaggagagcaagccgcccgaggacgccgtcgtgatcgccattccgggacgggccgtggagcaccggaaggaggccttccctcacgagaacgcgggagccggggggtgctgcgctgcagcgcacggtgccgaagacgaggtatgcattgtcatcagccgc

SEQ ID NO: 9189 - DNA, 300 bp, Zea mays
  Clone ID: LIB148-022-Q1-E1-H3
tctagcgtcattctgtgtaacctcgagtacgcgctgcagctgcaggacgccatcccgcccgagggcgctcggcagggcggcgacggggacgaccaggacggcgccgctgcggcgggcggcggtcgcgctttcgttccctcgggcggtgccttgtccgtcacgtccacggcctctgccgcggacttcttctctctgttttcctccttgctctacattgtccgtcgctcgctaatcattcctctgttttcttcccgctcttctatctgtttctttaattctccttcgtcatcgcttttctcg

SEQ ID NO: 9190 - DNA, 413 bp, Zea mays
  Clone ID: LIB148-022-Q1-E1-H4
cggacgcgtggggaacgccaaggtggcgttcgagctgtcggagcggctgccgcacctgccgctgcggatgcaggagcactcgcgccgcgcgctggcgttcgccgagcggatgcaggggctgggcctgcgcgtgctgtacccgggcctcccgggccacccgcaccacgcgcgcctggccgccatgggcaacccgggctacggctgcggcggcatgctgtgcctcgacatgggcaccgaggagcgcgccaaccgcctcatgcaccacctccagaacaccacccagttcggcctcatggccgtcagcctcggctactacgagacgctcatgtcctgctccgggcagcagcacagcagcgagatgccgcccgaggaacgcgcgcgcgcgggcatctccccggggcctcgtccgcatg

SEQ ID NO: 9191 - DNA, 407 bp, Zea mays
  Clone ID: LIB148-022-Q1-E1-H5
aggctccccaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgactactgctacgagcgctgcgccaacggcaagaaagaccccgcctgcaccaagatgtgcaaccaggcgtgcggctccacggaccacggcgccggtgccgccggcgccgcgccggcttgatcgcccagcgcattcatcgcttcagctcgatataatcgctgctccgtcagcaacccacatatgattcgattaatccttctcctctaa

SEQ ID NO: 9192 - DNA, 295 bp, Zea mays
  Clone ID: LIB148-022-Q1-E1-H6
acccacgagtcaaaggctccccaaggatagcatagcagcagcactcacaatagcaaaaaccaccatccgtcgtcgccaagcgtaccaatgagccaacgacatcaccaccgcccagcgggaatggggcacaacatgaggattgtcgcgctggccttggtggacctgctggtggtggcggcggcgccgcccgtcgccaccgcgtacggctgctacgaccactgctacgatccctgctccaacgggagcagagacccctgcctgcatcaagatgtgcaaccaggcatgcggctctact

SEQ ID NO: 9193 - DNA, 393 bp, Zea mays
  Clone ID: LIB148-022-Q1-E1-H7
cgccgtggccggcgcccgagcccgcgaccgggtcacgcccgcgccgccgtgaccggcgtccgcgccggggactggccgtgtcctctccgagaccgagcgtcgcgcgcctatgccgccggccggacctgcgcctgcgcccgcaccgtgccgccgccgagcgcggtcgtgccgaggagcgctcgcgccctgtccacgccggctgggccgtggccgagccaccaggatcgctccagccgaggagccgcgcccgtggaggaccgccgtggtccgtcggggctcgccgaggccgaccggccggtggccagccgcgccggggccagccgcgcccacgagccggtggccagccgcgcccgcgcgccggtggctggatgcgccaggctgctgcggccagcg

SEQ ID NO: 9194 - DNA, 413 bp, Zea mays
  Clone ID: LIB148-022-Q1-E1-G2
cccacgcgtccgcccacgcgtccggtcccattctgatcctgtggacagtgggttaataatagtaataaaaatgataatccacctcctctgcttcccaggcccagcagcaggagctcccccgtctccgtcctcctccgcctctgtcagggtcccggtcggacttcctcacgaccgccgcgccaaatcccgtctcgttcctccgttccgctgcgcatcctcaggaatggaacttggcgccaccactgccctgtaccctctgcaccgctgcaaaaccatttacctggtcaggcatgcccagggcattcacaacgtcgcaggcgagaaggacttcggcgcctacatgtcacatgaactgttcgatgctcagctcaaccctttgggttggaaccaagtcgatggtctgcgggagcatg

SEQ ID NO: 9195 - DNA, 405 bp, Zea mays
  unsure at all n locations
  Clone ID: LIB148-022-Q1-E1-F1
cgccatcgagcacccgtggcgcaacatcctggagcgcaggtaccggccgcagctgacggtggcagcgctgatccccttcttccagcagctgacgggcatcaacgtgatcatgttctacgcgccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggtacgcagatgttcgtctcccagatcgtggtgggcacgctgatcgcgctccagttcggcaccgccggcgtgggcgagatgtcncgctccaacgcctggctgctggtgctcttcatctgcctctacgtcgccgggttcgc

SEQ ID NO: 9196 - DNA, 399 bp, Zea mays
  Clone ID: LIB148-022-Q1-E1-F10
gatcacaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaac

SEQ ID NO: 9197 - DNA, 399 bp, Zea mays
  Clone ID: LIB148-022-Q1-E1-F11
ctctctcttcttcttcttcaatcctccctccccgcgccggagttggaggagggagaggggacaagctttccggcgccgacgccgacgcggacccggcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcagtgacccagatcgtcttcccaacgagttgggcagtatgagcataacggacgacaaggacgttgaagatattgtagtcaatggcaatggggcggagcctggtcatatcatagtgaccagcattgatgggagaaatgggcaggcaaag

SEQ ID NO: 9198 - DNA, 124 bp, Zea mays
  Clone ID: LIB148-022-Q1-E1-F12
gatgaagtccgtcacacgcgtgaaggaggccacttggaaatgcatcttcgtgcaggttcatctgcacagctctgtaccaacattcacacggcgagcgtcggacgctgttcaaaggcaattcaga

SEQ ID NO: 9199 - DNA, 414 bp, Zea mays
  Clone ID: LIB148-022-Q1-E1-F2
cccacgcgtccgcccacgcgtcagggcgacggtgacattgtggcagtggacgtcaaggataagggctccgacacgtacgagcctctgaagcactcctggggcgccatctggatgaaggacagcgacaaaccgcttaagggacccctcaccgtccgcctcactaccgagggaggcaccaagtccgtctacgacgatgtcatccctgccaactggaatgccaacaccgcctacaccgccaaataattaactttagtgctgacaatactttaagccgacctatgctacctatactagattgggttggatcccaagcaatgcattacacatgcatgcattggaccgtgatatctatttgctaccactaccctattacgacagtgatgctggcgccaacaatgatggtgtcatcctcct

SEQ ID NO: 9200 - DNA, 405 bp, Zea mays
  Clone ID: LIB148-022-Q1-E1-F3
gtccacggcgacgatctgcagcggcgatggctcggcgaccggacgacctagcgttggccgccatcacctttgcgatcgtcgccttgtgcgcgcggtatgcatcggccgtgggcactacaccccagtcaaccttcagctacaaggagggtgaccctaccgggcctacaaaatgggccacattgcagaaggactgggatgtctgtgacagcggcaccgagcagtccccgatcgacgtcgccaaggtggaggtctctgaggatttagacccgctgcagcagacctacgagcctggcgacgccgtcatgcacaaccggctccacgatttcatgctgaactggacaggagggaacggcggcctgacaatcgaagggaagaagtacaagctgaagcaggtgcactggcacg

SEQ ID NO: 9201 - DNA, 414 bp, Zea mays
  Clone ID: LIB148-022-Q1-E1-F4
cccacgcgtccgggaattgatggggcagaaagaaaccgttcagtctcaacttgacaattttcgtagagttgcaatagatgaaaattttgatgaccatgcaataagacaatgggatcaacgaaataggtcttcagagtcccttccacataatgtgtctgaagatgctctttcttcttttgatacttacgatgttgtttatggagaacaagatggtctaggcccaaaagcatttgatgtacatccaatatctatcttgcatcaaccaagaaaccatatttctgataacattcagatatatcaaccaaataaggaggcttcctcagaggtctctgaggagcattgcaaggaagtccagtgcatcgaaacaaatgagcttaagaggagtccattattctttcctgttgatcgatatca

SEQ ID NO: 9202 - DNA, 386 bp, Zea mays
  Clone ID: LIB148-022-Q1-E1-F5
cttcttcgccgtcggcatgggcccgggcaaatggacgccagcgtcccggagcacgtacaacctcctggacacggtgagccggcacacgatccaggtgtaccctaggtcgtggacggcggtgatgatgacgttcgacaacgcgggcatgtggagcatccggtccaacatctgggagaggcagtacctcggcgagcagctgtacgtgagcgtcatctcgccggagcggtcgctcagggacgagtacaacatgccggagactagcctccgctgcggcaaggtcgtcggactgccaatgccgccgtcctacctctccgtctagagcatgcacgcatctcgctcggtttccccttccttccatcacgtgcgcacggtgctgtatacacaat

SEQ ID NO: 9203 - DNA, 398 bp, Zea mays
  Clone ID: LIB148-022-Q1-E1-F6
aaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatctttgctggaaagcagcttgaggacgggcgcacgcttgccgactacaacatccag

SEQ ID NO: 9204 - DNA, 399 bp, Zea mays
  Clone ID: LIB148-022-Q1-E1-F7
ccacgcgtccgggcgccctgtatgaccacatggggctgcactacttcaagtcctgcaccatcaggggcaccatcgacttcatctttggctctgccaagtccttttacgaggactgcgccattgtttccgtgaacaacatggaggagatcatgaccttgcctgtggcaccacctcaacttgacattcacgacaatccaatcaaggttgccccatggaagggaggcttctccttcaagacatgtaccatcaccggggaagggcaacatatcttcctcggaaggatgggcacgccttccatctactcctacacccagattgctaaggaggttgtgcccataatctacgacaaagggaacatcttcatgcccagtaatatgactggtagacgctgtgccactt

SEQ ID NO: 9205 - DNA, 347 bp, Zea mays
  Clone ID: LIB148-022-Q1-E1-F8
ccgacgcgtccggttaagctcgtgctcctatcgctcttcaccgtctgcatcaccttcgcatttcagctgagctgcctgaccgctaacgggccagtgatactgccagcggaggcgatcacgattgtggtggtgctggggctcaccttctacaccttctggtgctgccaataagggctacgagttcgaattcctggggccgttcctggtgtctgtctgcctcatccacatgctcttctagcaccagcgtatcatctgcgtgctgggcaagacccggaccatggtgtaacgctgcatcgctcagctcgtcttctccggtttcatgatctatcatcaccgacaaccgcatc

SEQ ID NO: 9206 - DNA, 402 bp, Zea mays
  Clone ID: LIB148-022-Q1-E1-F9
caaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaaga

SEQ ID NO: 9207 - DNA, 405 bp, Zea mays
  Clone ID: LIB148-022-Q1-E1-G10
ccggcgtccgcctcgccgtcgccgtcgccgccgcgccaccagcagcccccgctgccgccgcgccccaacaagccgtcggccgtgccgaggttcggcgtgtgggacgagcagaacgccgcgatggcggcgcagggattcacggtgcagttcgagaaggtgaagcgccaccgggaggaggccaggaccgcccccgcgccgcccgtgcagccgccgaagctgctgtcgtcgcccgaccacgcagcgccgccacgcgcgcggcgacacgggaaggggaaggccaagaggtccttcatgtccaggatctacaggtgcctgttcccaagggtcagagagtgagtgatccgacgatggttatacacaaccgctcagccgtatacggtgtactacgtgttcttcgacagagac

SEQ ID NO: 9208 - DNA, 401 bp, Zea mays
  Clone ID: LIB148-022-Q1-E1-G11
acggacgcttgggcaactgcgaggtgctgggcaccgtggacttcatcttcggcaactcggcggcgctgttccagaactgcctcatgacggtgcgcaagcccggggacagccagtccaacatggtgacggcgcatgggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaag

SEQ ID NO: 9209 - DNA, 406 bp, Zea mays
  Clone ID: LIB148-022-Q1-E1-G12
tacccacgcgtctgggacggcagcgcggcggctttcggcgacatcgtctcctctcgcctgccgccactgccaaccgccagaacgcaggcggagctacattcgaaccaattcgacacctccagcagcggcgggctgctggatcagtcgatgctgatcggcgacgaacacctgctgcggcccaacccgagtatggtcaaggtctcctccatgcccgcgctctcctaccgtgagccggatgggtccaggatgctgccagcccatggcgccgggagcgacggcgacgtctcctcgctggggcactgccctccgggacaggacctccaccgtggacgaacacgaacgtgcgtacacgcggcacaaacacgatgatcatcgtctcaccatgtggttgcatgcatcgggaaac

SEQ ID NO: 9210 - DNA, 396 bp, Zea mays
  Clone ID: LIB148-022-Q1-E1-E9
caattagctggagacgagcattctcagtcacagaaaatttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccag

SEQ ID NO: 9211 - DNA, 392 bp, Zea mays
  Clone ID: LIB148-022-Q1-E1-D6
cccacgcgtccgctcatacccaagggtgacttccttgtcggacaactcaacttcacaggcccttgcaagggcgacgtgaccatccacgtggatggcaatctgctggcgaccacggacctaacccagtacaaggaccatggtaattggatcgagattctacgtgtggataacctggtcatcaccggcaacggaaaccttgacgggcagggcccagccgtgtggagcaagaactcctgcatcaagaagtacgactgcaagatccttcccaactcgctggtgatggacttcgtgaacaacggggaggtgtccggggtcacgctgctcaactccaagttcttccacatgaacatgtaccggtgcaaggacatgctgatcaacgacctgaccgtgac

SEQ ID NO: 9212 - DNA, 412 bp, Zea mays
  Clone ID: LIB148-022-Q1-E1-D7
cggacgcgtgggcggacgcgtgggtgagcctccgtttgcggtgcgacagctcctccaggaccggcccccgcgcgcgtgccgtacgtgccagggacgacgccgggcggccgatggagttcacgtcgtcctacttccacgccttcggcaaccccgacctcgcggcggtggtctccggcgacggcggcagcgcgcaggcccaccggccgcgccgctccaccgacggcgcgaaggcggaggacggcaggagccccaccaccacaacggcgaggcgcgcgccgtccatgttctgcgtccccgacacggaggcggaggagcccaacggcttcctggacgagtgcaccctctgccgcaaggcgctctgcggcgacatcttcatgtacagatgggacacgccattctgcagcgacgattg

SEQ ID NO: 9213 - DNA, 395 bp, Zea mays
  Clone ID: LIB148-022-Q1-E1-D8
gcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgac

SEQ ID NO: 9214 - DNA, 396 bp, Zea mays
  Clone ID: LIB148-022-Q1-E1-D9
acccacgcgtccgcccacgcgtccggcaaattaccgcgatggctcccaagatcctagtcatccttgtgttcctcgccgtggcctcaccggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttactttcgacccatcaagctggacgagatgaagacacgcaaacgcatcctcccaacgctgctctccgtcacgacaagaaactcggcgtcct

SEQ ID NO: 9215 - DNA, 383 bp, Zea mays
  Clone ID: LIB148-022-Q1-E1-E1
ccacgacataacatggctgtgaatgtgagaatcatgtggtcgtcgatgctggcacaggttgcgatggttgtggcgttggtgttcttggtgagcggcacatggtgcggtcctcccaaagtctccccaggcaagaacatcacggtcacctatggcaaggactggctggacgctaaagcgacatggtatggcaagccgacaggtgccggtcacgattacaacggtggaggatgcgggtacaatgacgtgaacaagcccaccttcaatatcatgggcacatgcggcaacatccccatcttcaaagatggactgggttgtgggtcctgcttcgagatcaagtgcgataaccctgtggagtgctccggcaagctcgtggtggtgcacat

SEQ ID NO: 9216 - DNA, 405 bp, Zea mays
  Clone ID: LIB148-022-Q1-E1-E10
cggacgcgtgggcgaagaacaagggtaagggaggcaagaaccggaagcgtggaaagaacgaggctgacgacgacaagcgcgagctcgtcttcaaggaagacgggcaggagtatgcgcatgtgacccggatgctcggcaacgggcggtgcgaggccacctgcgtggacggcacgcgtcgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttcccgagacgctcaggctcaacgatggcgtcgacgtcgatgggcccgaggacggcgaggagaacggcgact

SEQ ID NO: 9217 - DNA, 406 bp, Zea mays
  Clone ID: LIB148-022-Q1-E1-E12
gagccgccgccaccagcgccggtgaggtcacctctaccgctaacgaaatcatcacctcctccaccaccgtctatggtcgccatccccaccacaagcacactcacctcctccatcatctctaataagctcacctcctcctccgatgcaatcccctccaccgcctgctccagtcagctcaccaccagtacctataaaatcaccaccaccggttccagtaagctcaccacctcctcttggcgcaatcccctccaccacctgctccagtcagctcactaccaccacctgtaaaatcacctcctccagcggctccagttagctcaccatcgcctcctgtgaaatactcttcaccacctactccagtcaactcactgccaccatctgtaaaattacctcctccactagctcc

SEQ ID NO: 9218 - DNA, 398 bp, Zea mays
  Clone ID: LIB148-022-Q1-E1-E2
cccacgcgtccgcccacgcgtccgggcttcttcgtcgtacgccggcgtccctgctagtgcctgccgttgaactatccggccaccattgatccgacctcccctaagccatcgatgagtagagaaaaacagtgaacgccacctctgtactcgccccaccttatggcgcgtcgctcctgcagtaccggcccacgctctgcgcggcgctcaggtgttacggctgccctcaaatccgtcgtcggaccattggcactggggcaagcaaaagcacggacaggtgctcggcgtgctgcaacggcttccgatttgcccggctagatggaagacggctggggagcatcttctctggggaacaccgcgtgtcatgggtgccttgccgaagttcaaggacggcgtgattg

SEQ ID NO: 9219 - DNA, 411 bp, Zea mays
  Clone ID: LIB148-022-Q1-E1-E3
ctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggcggcggctaccgcggtgccgcctgcaggtgccagtgccaagacctccagcagcaacgatgcccgcgacggcgccatgggcagcgtgcaggacgagccgcggcagcagcgccacgatgactatcaacccgagatcggtcccgagaa

SEQ ID NO: 9220 - DNA, 409 bp, Zea mays
  Clone ID: LIB148-022-Q1-E1-E4
gccatcgccatcgcgcaccgcctccccgtgtcccctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgccagctc

SEQ ID NO: 9221 - DNA, 378 bp, Zea mays
  Clone ID: LIB148-022-Q1-E1-E5
cgccgagccatgacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctg

SEQ ID NO: 9222 - DNA, 404 bp, Zea mays
  Clone ID: LIB148-022-Q1-E1-E6
gcccggagccggccgatcgggggagcgcagcaggcgggccgcgccggccgccgcaccaccgggtagcccaggccgcgcgcgcgcgccgtccagctcgtctgctgtcgctcctccgtgatggccgacgtcgacgtggacgccaacaacgaggccgagcaaaggacgcgctcggagccggggacctccatgtcgccgtcatcggaggccgacgacgacacggccagcagtacacccaacgagtccccggcgcgcgccttcgcggggcacacgctcgaggagccgcctcggcggcgggcgccgtcccggcggtcccgtcccgttcggatgctccagagcgtgtgccggtcgctcccgctgctgaacccgcggtgcgggcggccgatgatgcatgccggggcgtgccg

SEQ ID NO: 9223 - DNA, 378 bp, Zea mays
  Clone ID: LIB148-022-Q1-E1-E7
cccacgcgtccgcccacgcgtccggtctctgtcgtcatcgtcgtcatcaaagagtccacataagggaaggattgaaaagaagcggaggatcctcacgaacaggtacgagctcgggcgcaggcgcgggcaaggcaccttcgcgaaggtgtactacggacggaacctcgcatccggcgagagcgtggcaatcaatgtcagccacaaggagaaggtgatgcgcttccgcatgatcgatcagatgaagcgcgagatctccgtcatgcgcctcgtcagccaccccagcgtcgtgcagctgcacgatgtgatggccagcaggaacacgatatacttcgccatggagtacgtctggggcggcgagctcttcggacgggtcgcccg

SEQ ID NO: 9224 - DNA, 387 bp, Zea mays
  Clone ID: LIB148-022-Q1-E1-E8
gcaactcctcctcccacgcctgccatcaacgcagccgccgcaaccgccacatcatccatgggcgcctgcgcagccaaacacaccacgcatcatgagcaagacgtagcagatgccgccgtctctacacccaaggttgctcccgaagcgactccaatctccgttaatgttgctcgctgaagaacatgtacctgagagtgtgctagtggaagaacctgatgcggctgccgatgttgaacatcataaagctaaagatgtggtcgctccacatgctgccgtagccgagcctcatcacactgaagaagatgccgtggagaagaacgtcgacaaagatgacaagccagtagctcccgcgaatgcagatcatcacgtcgctagcgccgccgagac

SEQ ID NO: 9225 - DNA, 410 bp, Zea mays
  Clone ID: LIB148-022-Q1-E1-D5
cccacgcgtccggcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactaatggaggcggtgagcatgaacccgcgggaggagagtctgaggaacggcgccatcatcaggtccgagcggccgagcgccaggaactgcct

SEQ ID NO: 9226 - DNA, 426 bp, Zea mays
  Clone ID: LIB148-022-Q1-E1-B9
gggccgacccacgcgtccacacctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaag

SEQ ID NO: 9227 - DNA, 402 bp, Zea mays
  Clone ID: LIB148-022-Q1-E1-C11
acggacgcgtgggcaagcagcagccaatggcttctcgttcgcccaccattgccctggtcctcatccttgcctgcttctcctcgccggcggcggccttcaacatcaccaggctactcggacaattctccgacttcacaacctttaacaacctcctgtctcagacgaagctcgcggaggatatcaaccgccggcagaccatcaccgtgctcgccgtggacaacggcgccgccggtggcatctcctccctcccatcagacgtccagcggaaggtgctctccatgcacgttgtcctcgactactacgacaccgccaagctggaggccatcaagaaccactccgccctgctgacgactatgttccagtcctccggccaggccaccgaccgcatgggcttcctcaact

SEQ ID NO: 9228 - DNA, 407 bp, Zea mays
  Clone ID: LIB148-022-Q1-E1-C12
taagcgcacggaccgtgggcgacaccgtgcaggacgcgtgcagcaagacccagttccccaagatctgcgtggacagcctcgccgccaagccggagagccagaatgcgacgccgcgcaagctggcggagctgttcgtgaacatcgcggccgagaaggggtccgggatggccaccttcgtgcaccgcaagtacagcgacaaggaggacagcgacatgttcaggtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgatgacgcctgcaaggacctgcccaagaccagcgacaatgacgacgtcgtc

SEQ ID NO: 9229 - DNA, 393 bp, Zea mays
  Clone ID: LIB148-022-Q1-E1-C2
gcccgacgcgcggtgggagaaagacgacatgcccgtgggccgcgtcatgggcgacatgctgatcctccccaccggcgacctgctgctgctgagcggcgccgccaagggctgctccggctggggcttcgggcggcagccggtgctgaccccggtcctgtactcgccgctgaaggtgcatggcccgctgttcctggcgctggcgtcgtcgaccatcgcgcgcatgtaccactccaccagcgccgtgctgccctacgccacggtgctggtggccggcggcatcacgaacgcggcgtacaacttcatcggcgtggacttccccaccgaggtgcgcgtggagcggttctccccgccgtacctcagcgatggggccgccggcaaccgcccggtgctgga

SEQ ID NO: 9230 - DNA, 373 bp, Zea mays
  Clone ID: LIB148-022-Q1-E1-C5
cccacgcgtccgcttccgcatccagggccactacatgaagctggtcgagctggagggctcccacaccctgcagaacacgtacgactcgctcgacgtccacgtcggccactgcctctccgtgctcgtcgacgccgaccagaagcccggcgactactacatggtggcctccacgcggttcatccacgacgccaagtccgcgtccgccgtcatccgctacgccggctccagcgccccgccggcgccgaacatgaccgagccaccggccggctgggcctggtccatcaaccaggccaggtcgttccgctggaacctgacggccagcgccgcgcggcccaacccgcagggctcctaccactacggccagatcaacatc

SEQ ID NO: 9231 - DNA, 405 bp, Zea mays
  Clone ID: LIB148-022-Q1-E1-C6
ccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctg

SEQ ID NO: 9232 - DNA, 388 bp, Zea mays
  Clone ID: LIB148-022-Q1-E1-C7
ccgcttcgtgcgccgcaagaacgtgctcctcagcgtcgactccgacaagacggacgaggcggagctgcaggccgccgtggagcgcgcggcgcgcctgctggcgccctacgacgcggccatcgccgagtacacgagccaggcggacgccaccaccatcccgggccactacgtcgtgtactgggagctcatggtgagggagggcggggcgtcgcccgacgccgccgtcttcgagcgctgctgcctggagatggaggaggccctgaacgcggtgtacaggcagggccgcaacggggacgccatcaggccgctggagatccgggtggtgcgcggcggcacgttcgaggaggtgatggactacgccatctcgcgcggcgcctctatcaaccag

SEQ ID NO: 9233 - DNA, 399 bp, Zea mays
  Clone ID: LIB148-022-Q1-E1-C8
gtgggcgcggcgaagggcatcgagtacctgcacgaggtggccaacccgccggtgatctaccgcgacctcaaggcgtccaacatcctccttgacagggaattcaacgccaagctctccgacttcgggctcgccaagctgggccccatgggcgaccagagccacgtcagcaccagggtcatgggcacgtacggctactgcgcccccgagtacgccatgaccggcaagctcaccaagatgtcggacatctacagcttcggcgtcgtgctgctcgagctcatcaccggccgccgcgccatcgacgtcacgaggccgtccgaggagcaggtcctcgttcactgggcaacgcctctgctgagagacaggcggaggttcatgaagctggccgacccgttgctgggc

SEQ ID NO: 9234 - DNA, 406 bp, Zea mays
  Clone ID: LIB148-022-Q1-E1-D10
aggagaaccagcagcctccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgc

SEQ ID NO: 9235 - DNA, 401 bp, Zea mays
  Clone ID: LIB148-022-Q1-E1-D11
aacctgctgtccaactactcggccgccatcacggatctgcactccatcggcgcgaggaagttcgccatcatcaacgtggggctggtggggtgcgtgccggtggtgcgggtgctggacgcggacggcgggtgcgccgaggggctcaacaagctggctgaagccttcgacgtcgcgctggggccgctcctcgccggcctcgccgacaagctgccggggctgacctactcgctggccaactccttccgcctgacgcaggacgccttcgcggacccgaaggcgtcagggtacagcgacgtggccagcgcctgctgcgggagcgggcggctgctggcggaggcggactgcctgcccaactccaccgtgtgcagcgaccacgacagccacgtgttctgggaacgcta

SEQ ID NO: 9236 - DNA, 400 bp, Zea mays
  Clone ID: LIB148-022-Q1-E1-D2
cattcaagcacctcatcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtagtggaggagccggctgcggcggccgacgttgatcatcacaaggctaatgaggtggtcgctccacaggcggacgtcgccgagcccgatcacaaggatgaggaagccgtggagaacaccgtcgtcgacgacgagaatccagcggcagccgccaatgcagaggaaaaggtcgccaccgccgccgagaccacgacg

SEQ ID NO: 9237 - DNA, 414 bp, Zea mays
  Clone ID: LIB148-022-Q1-E1-D3
cgagaggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactaactccactaagcgtgtgcgtgc

SEQ ID NO: 9238 - DNA, 415 bp, Zea mays
  unsure at all n locations
  Clone ID: LIB148-022-Q1-E1-D4
ggctgacatgtccaaggtgctgcaggtggagatctcagccggcgccgccgaggaggacgccgtggctgcgactgcgactgcgcctgcgccggcgtcggcgtcggcgtcctttgggctcttctccggggagttcctccgccggcacgggctgcacctcctgggcacgtcctcgacgtggttcctgctggacatcgccttctactcgcagaacctgttccagaaggacatcttcagcgcggtggggtggatccccaaggcggcgacgatgaacgcgctggaggagctgttcagcatcgcgcgggcgcagtccctgatcgcgctgtgcggcacggtgcccggctactggttcacggtggcgctgatcgacgtgttggggcggttcgcgatccangtgacggggttcctgatgatgacg

SEQ ID NO: 9239 - DNA, 393 bp, Zea mays
  Clone ID: LIB148-022-Q1-E1-A2
tacagacacttgtgataaaaaaaaaaaaaaaaaaaaaaaaaaaaaaaaaaaaaaaaaaaaaaaaaaagggcggcggcccaaaagggttcaaaccatgatttagccttaaatggaagttattagcccttcaaaagtgtcacgaaatttcaattcacggccgttcttttaaaaacttcttaacgggaaaaaccttgcgtttaccaaacttaacccctttgaagaaaagccccctttcacaaccgggtgtaaatccaaaaaggcccgtacaattgacctttccaaacatttgccaaccctaaagggaaagtggaacccccctgttatcggagaatcattcacgccggttttggtggtaacccacaccttaacggcaatatttgcaacctcccaacc

SEQ ID NO: 9240 - DNA, 401 bp, Zea mays
  Clone ID: LIB148-022-Q1-E1-A3
gggccacgcgtccgccgccatcagcgctcgcccgcgcagatctcgctctcagcgctcgcccgccatccgctctccatgcttagggtccgccatcagcgctcgacacattcgcctggctgctcgacgcattcgccagcgccaccttcaaccagatcgactccgcctaccgtgaggccggaggggatcctttcgtggctgccagtatcctgtcctccacgcaggacacgcacccgccgcagcccctgccgccaccggatctctcgccaaggacaggctggtgcaggaggccactcctagaacctgtcatccgccgccatcaacgccctcctcctagatcccatcatccgctgcgaatctccgttcagctccccctcgcgctttcgtcgtcgccgtggaccgct

SEQ ID NO: 9241 - DNA, 386 bp, Zea mays
  Clone ID: LIB148-022-Q1-E1-A4
ccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctgtgctgctgtgctgact

SEQ ID NO: 9242 - DNA, 390 bp, Zea mays
  Clone ID: LIB148-022-Q1-E1-A5
aatcggacggtcgatagatcgatccacgtacgcgcatacccatgcaccacctctagctagtttcggtttgatttcattccatttcttctttccatccatccacccaatccaatcaaattagtaatgagcaaaggtgctatcatcggcgcgtcgaccgtccttgtggtggcggtggtcgcggccgtgtgcgtggtgtccttcaagggcaactccggcaagggcgatggcgacgagaacctgtccatgtcggtgaagtcggtgaaggccttctgccagcccgcggactacaaggagacgtgcgaggcggagctgtccaaggcggcgggcaacgccagctcgccgtcggacctggccaaggtcatcttcaaggtcaccaccgacaagattcac

SEQ ID NO: 9243 - DNA, 407 bp, Zea mays
  unsure at all n locations
  Clone ID: LIB148-022-Q1-E1-A6
atccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgangaggcgctggaccacctggacgacaccganggcggcctcgacga

SEQ ID NO: 9244 - DNA, 367 bp, Zea mays
  Clone ID: LIB148-022-Q1-E1-A7
cccacgcgtccgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaaca

SEQ ID NO: 9245 - DNA, 381 bp, Zea mays
  Clone ID: LIB148-022-Q1-E1-A8
gtgcaagtccgtgcagatcgacaaagtgacggtcacggcccccggcgacagccccaacacggacggcatccacatcggcgactccatcaacgtgacgatcatcagcaccaccatcggcgtctgcgatgactgcatcgccatcggacccgggagcacgatgatccgcatctatggcgtcaagtgcggctcaggccacggcatcagcgtcagcagcctgtggcgctacaaggacgagaacgacgtggaagacgtacaggtgacggggtgcacgatcacctgcaccacgaacggcctgcgcatcaagtcgtacgacgactctatgtcgtcgctcaaggccagcgagttcctgtacgacggcatcacaatggacaatgtctccta

SEQ ID NO: 9246 - DNA, 415 bp, Zea mays
  Clone ID: LIB148-022-Q1-E1-A9
aggcgacctcatcctgtcgggcgccacgtccgtgttcggcgccgcgcccgtggaggtctccgtgaaggtggccggcatccactggcactacggcagccggtcccacgccccggagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgatgaacgggatggtggccttcac

SEQ ID NO: 9247 - DNA, 411 bp, Zea mays
  Clone ID: LIB148-022-Q1-E1-B1
ggagccggccgatcgggggagcgcagcaggcgggccgcgccggccgccgcaccaccgggtagccccggccccgcgcgcgcgccgccccagctcgtctgctgtcgctcctccgtgatggccgacgtcgacgtggacgccaacaacgaggccgagcgaaggacgcgctcggagccggggacctccatgtcgccgtcatcggaggccgacgacgacacggccagcagtacacccaacgagtccccggcgcgcgccttcgcggggcacacgctcgaggagccgcctcggcggcgggcgccgtcccggcggtcccgtcccgttcggatgctccagagcgtgtgccggtcgctcccgctgctgaacccgcggtgcgggcggccgatgatgcaggccgggggcgtgcggatcgcgccg

SEQ ID NO: 9248 - DNA, 426 bp, Zea mays
  Clone ID: LIB148-022-Q1-E1-B11
tcctgggccgacacacgcgtctacacatgcgtctgccaacgcgtccggtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcgccggcactgggaagcagacaatcctcatacccaagggcgacttccttgtcggacaactcaactttacaggcccttgcaagggcgacgtgaccatccaggtggatggcaatctgctggcgaccacggacctaagccagtacaaggaccatggtaattggatcgagattctacgcgtggat

SEQ ID NO: 9249 - DNA, 397 bp, Zea mays
  Clone ID: LIB148-022-Q1-E1-B12
tacagtggctctcgttagttcgcgaaggcgccccttcctgccctcacatccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtcggcgatgtggcggtgggcgcggtggctacaggcagcggcgaccgggtggcggcggattgcggggtgtgcgccatctgcctcgacaggatagcgctccaggagacggccctcgtcaaaggttgcgaccacgcctactgtgtgacctgtattttgaggtgggcatcctacaaggagaaccctctctgcccacagtgcaagcatcc

SEQ ID NO: 9250 - DNA, 405 bp, Zea mays
  Clone ID: LIB148-022-Q1-E1-B2
gtcgctcttctactacttcgtggaggccaccgctgatccggctacgaaaccgcttcttctctggctcaatggagggcctggctgctcttcatttggaatcggagcattccatgagataggtccgttccgtgtggacacggatggcaagacactctgcaattttaaatacgcctggaacacagtggcgaacgtgctgtacctggagagccccgtgggcgtgggcttctcgtacgccgccaacacgggcgtgtacaaggtgatgggcgacaacatgaccgcggacgactcgctccagttcctgctcaagtggctggaccgcttcccggagtacaagggccgcgacttcttcatcgccggcgagagctacgccggccactacgtcccggagctcggccgctccatcct

SEQ ID NO: 9251 - DNA, 109 bp, Zea mays
  Clone ID: LIB148-022-Q1-E1-B3
aggtaggcgtggctcagtttatgtgatactgctagcgatggatgatgatgatctgcgtgtaattgaattaaagaattgtgctgatctttctacaacactgttccacatc

SEQ ID NO: 9252 - DNA, 379 bp, Zea mays
  Clone ID: LIB148-022-Q1-E1-B4
cccacgcgtccggccacgtgcacgccgaggaatcgctgcccgttgtggccaaaagcggcgcggcggtggcaaggaacgacggcgactcgcggctgctcgtcgacctggagcccgtgccggcgatcagattcagcaagcggcacggcgactacggcgccggcgaccacgcgccgccgtacgccaagaccttgtccagcagcttcaaggagccggcccgtgtcgcggaccgccgccctctctccggccccgggcagctcgccgcgtccaccggtttcgcctgggccaagaagccccggtccgtcgccaggtcttcgacggcggcagccgccgtcacgaagcggagctactccaagggttcagggaccatgaacaacagcag

SEQ ID NO: 9253 - DNA, 305 bp, Zea mays
  Clone ID: LIB148-022-Q1-E1-B5
gttttacaacaccttttactcccagcagaaaatacataatatgcatgtactcctctttttttccgtatagtaatataaacaaattttcacatgtgtttaaaaaaaaaaaaaaaaaaaaaaaaaaaaaaaaaaaaaaaaaaaggaaaaaaaaaaaaaagaaagaaaaaaaaaaaaagaaaaaaaaaggacggcggacccaaaggatcaaggcgtacgaaagcgtggaagcagcatcacatgtactgaaaagtggaacggaaaattaattcacaggccgccggtaaagaacttcgtgcagggaaaag

SEQ ID NO: 9254 - DNA, 381 bp, Zea mays
  Clone ID: LIB148-022-Q1-E1-B6
gcgtgaacgacgcgccggcgctgaagaaggcggacatcggcatcgcggtggacgacgcgacggacgcggcccggagcgcgtcggacatcgtgctgacggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcggcacgggcatcgtgc

SEQ ID NO: 9255 - DNA, 402 bp, Zea mays
  Clone ID: LIB148-022-Q1-E1-B7
ccacgcgtccgcagatggccatggagggtcgtcgtcgtcgtcgtctcgttctgtggctcgtgatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtagccctccgccgtatctgtcgcttgcacccaacggctccagccctctgctcgcgcagactgctctcaccactggtgtcagctacgcttccgcagacg

SEQ ID NO: 9256 - DNA, 355 bp, Zea mays
  Clone ID: LIB148-021-Q1-E1-H1
cgccaggtcttcttcggggcccaggtcgctgccgcctacatcaggggccccaagttttcctacttcctaggacccctcgccggcgacgagcaccaccagcttggttcactcccaacaaaatgtcagccaatgtgggtgaatcaactagcggtgtcagcagcagcgatgcagctggggggagctttgagtgcaacatatgcttcgagctgcctcaggagccaatagtgactctctgtggccacctcttctgctggccgtgcctttaccggtggctgcacattcacgcacactcgccagagtgcccagtgtgcaaggccctcgtggaggaggacaagctcgtccccctttatgggcg

SEQ ID NO: 9257 - DNA, 406 bp, Zea mays
  Clone ID: LIB148-021-Q1-E1-H10
ggctggttcgtggatggcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgccc

SEQ ID NO: 9258 - DNA, 403 bp, Zea mays
  Clone ID: LIB148-021-Q1-E1-H11
cccacgcgtccgaacaatccttgcacccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaagagttgagcccttcgccg

SEQ ID NO: 9259 - DNA, 404 bp, Zea mays
  Clone ID: LIB148-021-Q1-E1-H12
cccacgcgtccgcccacgcgtccgcggaagccgtggttggtgcgctgagaggggagctcgcagcaaccgctgtgaatgcgcccatggtcccagctgagatcctgtcagagctggctccatatgtttctctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaacgcggactacacggccaagcatcgcggcctccgcctcacggaggagcgcgtggcgcacgacagccccgcggcggaggcgccgctggagtccgtc

SEQ ID NO: 9260 - DNA, 313 bp, Zea mays
  unsure at all n locations
  Clone ID: LIB148-021-Q1-E1-H2
gaactactccgtgctggaaccttcagaagggaccagccccccacgacgtgaaagggaaactccccaaaacgtaaaaaacaactccaactcaacaagaaaggcattggcccccttacaaggaccttaaggaaaaacggagcgcttccngcngtcgcggctagccagacgatggccatgatcaatangctgcangangagaaggctgcaatgcanatggaggctctgcagtacctgangatgatggaacagcaagctgaccacgaccacctggcgattcaagacctgcacgatttgcttacggagagggagaaag

SEQ ID NO: 9261 - DNA, 374 bp, Zea mays
  unsure at all n locations
  Clone ID: LIB148-021-Q1-E1-H3
cgcccgccccggcaattgttgttgctgctgcgcgcanggcggttctggattgcggtctgccccacccacgaacaatccatggctccatctccgcctcggcgtgctgcgctcctcctcgccacggtgcttctgctggcggcggccgggtccacccccggcgccacggctgctggcatcttccaggtgcgccgcaagttcaccgccggggtgggagggggtgctggcgccaacatcagcgcccttcgcgcccacgatggcacccgtcacggccgcctcctcgcagccgccgacctccctcttggcggcctcgggctcccactgacactggcctctattacacggagatcaagctcgggacgccacccaagcactac

SEQ ID NO: 9262 - DNA, 244 bp, Zea mays
  unsure at all n locations
  Clone ID: LIB148-021-Q1-E1-H4
accaacgcgtccgcccacgcgtccgcaaagattggtgaaggctgggatcatagcctgcagtccaaggagcagatggaaacggtgcagaagatgaagcaagaagctgctacaaggcggcaaagggccttgtcatacgcattctctcaacagtggangaacaagaacacctcttctgcgcgagctgcgcatgggcctgctcccatgtacatggaacctggcaacccgaactggggctggtgctggg

SEQ ID NO: 9263 - DNA, 361 bp, Zea mays
  Clone ID: LIB148-021-Q1-E1-H5
gaaagacggaacggccttctgcaagcactccgctgacatctccagctccacgaccgcgtccgtcgctttcgcgtccaaagcctccaccgtccacgagatccagaacaagtctggcatcttctcgttcgatctgtcgtggagcgagatcgcaaccttgaagcccagcatcatctcccccttcgctcaggcaggcatgttaagaaatcctgcagcgaagaatgccggcaagctgatgactttgcccgaattcttagacttggccaaggccagcaacatcaccggtatactgatcgaaatagagcatgcttcctacctcgccaagagagggatcggcgtggtggaggcggtgtccagcgcgctg

SEQ ID NO: 9264 - DNA, 350 bp, Zea mays
  Clone ID: LIB148-021-Q1-E1-H6
agaaccgcaaccgctcgcttccccgcacctccccacctttcgctccctccctccaattgcaggatcggcaccgatgcgattcgaccgcggcctcgcatccggtgcggaggtctgccattggagggaggctcctctccgctgcgcgcgcgcgtcgcggcctgggcgagttacctgctggttcctcgtccctcgggagagattttgcgatccttggcgttactgttcgattgcaaacagtattgctgcttctctgaggaggcattagggctatgggcagttgaactgaaccgccgcagcagaaatccatttcgagggagagagatatcaaagaggagagtgagtgatcatgg

SEQ ID NO: 9265 - DNA, 418 bp, Zea mays
  Clone ID: LIB148-021-Q1-E1-H7
ggcggaaagctgccgaagtgcggcgccaatgtgccctgcgaatatagtgtcacctacggtgatggtagctcgacgataggttcctttgtcaccgatgcgctgcagtttgatcaggtgactagggatgggcagacacagccggctaatgccagcgtcattttcgggtgcggtgctcaacaaggtggggatttgggaagttcaaaccaagcccttgacggaattcttggttttggtgaggcaaatacatcaatgctatcacaactaactaccgctggtaaagtgaagaagatatttgcccattgtttggataccataaaaggaggtggaattttttctattggggatgtggtgcagccaaaagtaaaaacaacgccattgggtacccgaacaggcaacactacaatgtgaaccttaagac

SEQ ID NO: 9266 - DNA, 269 bp, Zea mays
  Clone ID: LIB148-021-Q1-E1-H8
cagatcgcaaacggtgcataccattacccaggaagctgctacaaggcgtcagatggccttgtcatacgcattctctcaccagtggaggagcatgaacacctcttctgcgcgagctgcgcagtggacatgctcccatgtacatggaaacctggcaggcccgaactgggggctgttgctgggcgagagcgctgggatggcggctaccaggccgtgggagaaccagaccatgccaccgccggccactggccgcgcagcatccaaaagcgcta

SEQ ID NO: 9267 - DNA, 401 bp, Zea mays
  Clone ID: LIB148-021-Q1-E1-H9
acacccacgcgtccgcccgggccacgctgacgtgctctcccaagaagctcatccagcaggtggtgttcgcgagctacggcaaccccatgggcatctgcggcaactacaccatcggcagctgccacacgccgcgcgccaaggagctggtggagaaggcctgcctcggcaagcgcatctgcacgctgcccgtgtccgccgacgtctacggcggcgacgccaactgccctggcaccaccgccacgctcgccgtgcaggccaagtgctccaagaggtcgcccagagccgcgcagtaatttcggtagtcgtcggcttcggcctcggcttgttacctcccgtcatctttcattcttcattgctgatgctgctgctgtaccatgggaccatgatttgaccggagacat

SEQ ID NO: 9268 - DNA, 399 bp, Zea mays
  Clone ID: LIB148-022-Q1-E1-A1
tcgcgggccgacacaagcctctacagtggttcctgctatgaattatatggtttctcacatttcttactaggcgactttgggttctagttatattccaggacctgccggagaggatcaagctgctgcaggaagagatcgggcagtagcaggaggaggcgccgggcatgctcagcgttttccgggacctcaaccccgacgagatggtggccaggaacaccccaagtccgacgtggtgcggaaggagggcggcgacacccgggtggagatctactgtgccgcgtgcacttcaacggtgatggctcgtgggatgtgattagggatggtaatggaattgtctcttcacaatttctttgagcccttaattaattttagttcaaaaatgaatagaaatagaacctg

SEQ ID NO: 9269 - DNA, 404 bp, Zea mays
  unsure at all n locations
  Clone ID: LIB148-022-Q1-E1-A10
atgcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccangaggagtgcgacaaggcgtacgtggtg

SEQ ID NO: 9270 - DNA, 422 bp, Zea mays
  Clone ID: LIB148-022-Q1-E1-A11
ggccgacccacgcgtccagtgaacccgaagaaggccatggaccctggcctcgtgtacaacatgacggccatgggctacgtgccgtacctgtgcgggctcaactacacggacgacaaggtgagcacgatcatctacccggagccgccggtgtcgtgcgccaagctgtcaaggctcgaacaggacgacctcaactacccgtccatcaccgtcatcctcaaccagccgcccttcaccgcgacggccaaccgctccgtcacgaacgtcggcgcggccagctcgacgtacaccgtggaggtgaacgtgccggcgtcggtgacagtggaggtgaacccgccgaagctgactttcaaggcgctggaagaggtcctgaactactctgtcacaatcaagtcggccaacggccaggcgcttaccggccctgt

SEQ ID NO: 9271 - DNA, 427 bp, Zea mays
  Clone ID: LIB148-021-Q1-E1-G6
cgattacagcaatggcggccaaggtgttcctcctcctccgactcagcatggtcgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcggtcgcgttcgacggcgcggtggcgccggacccgggccg

SEQ ID NO: 9272 - DNA, 275 bp, Zea mays
  Clone ID: LIB148-021-Q1-E1-F10
acggctagttcacccactggtattcaagctcctgcgggcagccatatccagagtcagctgacatggtcaaccggttgtgaaaagcgcacaacctccggcaccagtttccttttcgtttccccttttttgcacataaaattgacaagtcgctgaaattgccagttttcccctcttggattatgtcggataaaatgcgtatactcttcggttttggagatatatgtctagactctagagcgtgagggaaggttataaagtcttgtatgtctttgttc

SEQ ID NO: 9273 - DNA, 325 bp, Zea mays
  Clone ID: LIB148-021-Q1-E1-F11
gcagaacgtagaatctggtgagctggagttagagctagaatgggttccgatcctctagactatgataactcccctgatccttttgtctaaaaaactatcctcaagatgcatcaaaattttcaagctgtccactttgatgatcttggacatttttgctggatggcttgaatttgttaaaaaaatgtcattgttaaatatcctggtgtaactgtcagctataatcacagcctttcatttcccccctttggttgtcatgccttgtaactactcgccgtctcttgattgttgttgtattgtcccattgaaaggacatgtgtattataag

SEQ ID NO: 9274 - DNA, 401 bp, Zea mays
  Clone ID: LIB148-021-Q1-E1-F12
acgggagtccgggaaggagctgaccagcaacgcgctggccatcatcgagaaggcctcgtcggtcctggtcgcgctccacattcccgggttcacccatcggaggttacttggcaacgacgaagaaggaaacatggagaatcaacccaaagtcaaacactcgggtagtacgttcctgggcgagctcaaagacgacgtcacggcggccgacaaccgcaggctgctcaacgtcgacgaagaagaaaacatggagaatgaacccaaagtacaacactcgggtagtacgttcctgggcgagcgcgacgacgacgtcccggcagccgacagccggaggctactcagcattgaggaagacaccccgcagtgggtgaacggaccagagaggccgctgctcaaaggcaact

SEQ ID NO: 9275 - DNA, 359 bp, Zea mays
  Clone ID: LIB148-021-Q1-E1-F3
acgcagcgcctggggtcggcgacgagaagggtgcggtcgtaccgggtgaagatgtccttgacctccttcttggcggcctcgtcgacgtacttctggtagtaggcgacgagccccttggcgacggcctggcggatggcgtagatctgcgacgtcttcccgccgcctcggacgcggatcctcatgtcgatgtccttgaacctggagcgccccgccagcaggatgggctcgaaggccttgaggcggagcatctccggcctgatgagctcaatcgggacgccgttcaccttgatcagcccgcgccccggcttggtgtaggcgacggccacagccgtcttcttgcggccgaagcactggaccgt

SEQ ID NO: 9276 - DNA, 415 bp, Zea mays
  unsure at all n locations
  Clone ID: LIB148-021-Q1-E1-F4
tcccgggtccaaccaagccttcaggaacttcttcttcccccgccggcaaacaatcaaccgccgcaaacggcaaattaaccaatggccccttggcaaacaaacccaaaaacccttaaggggaaggcccaacttaaggccgcgttttcaaaaccaaaggttccccccaaggcaatccaaaccccctttaaggttccggctaataaacaggtacctaaaaaggtgttgttggagaacccggttgcggcggccgacgttgagcatcagaaagctaatgaggtggtcgctccagaagcggccgtcgccgagcccgatcacaangangaggaagccgtggagaagaccgtcgtcgaagangagaagccagcggcagccgccaatgcagaggaaaaggtcgccancgccgccgagaacacga

SEQ ID NO: 9277 - DNA, 385 bp, Zea mays
  Clone ID: LIB148-021-Q1-E1-F5
cacactagatatacacaattagatgggacatgcttcggcctctgatggcaacaagattggatatcagctgccatggagggtgctagctattcagtcttagcgacgtcatcaagctccaaggccacagcaccaacaaatgcattttgttgctgctgttcgtgccttttgtacacatgctaacacataatccatgtcatttgtgaagagaagctgccatggacagtgacttcatccacaatattatgtggatggcggcagctggagatgttaggccccgatcgaatggtgatcagcagatgagacttgcttgggcttttctggcactcgtagttctttgctgtctgtaacatctttctcaatgtacgttatcatgtgcatgtgcaac

SEQ ID NO: 9278 - DNA, 359 bp, Zea mays
  Clone ID: LIB148-021-Q1-E1-F6
ctctcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaag

SEQ ID NO: 9279 - DNA, 423 bp, Zea mays
  Clone ID: LIB148-021-Q1-E1-F8
cttctctaagcttcggaaactggtgctgggaaaagggaaagagaaccgtgaaatttctactctggagaggagagtgtctatttcaagttgttccttcgatgacttcactggaagggattcacatgatagctattcttcgttcatggcagaaccaaacatgcctgatagtcgacggcatggtgatcatggctttggtacacattcttctttggacagcgcaaaatctagtcctcttggcacagaaattgtaggtgaaagaagtgaccattctgtggtgaagagtgtatcttctagagaggaaaaggtaaatgcattcggtcccagcattggccttgatagtagcaaggccatacctgaggatgttgagattcataaatttgctgatgcgctgatcacatcaaggtcaggttccatgtcatcaag

SEQ ID NO: 9280 - DNA, 404 bp, Zea mays
  Clone ID: LIB148-021-Q1-E1-F9
cggacgcgtggggcgcgccatcactccactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgccc

SEQ ID NO: 9281 - DNA, 350 bp, Zea mays
  Clone ID: LIB148-021-Q1-E1-G1
cccacgcgtccgcccacgcgtccggcgcgccgtcgtccccgtctggcgtcgcgtcatgtaacgatgagccgccggcgccagcggtgctgcaaaaggtgcgagcggagcatctgctctacgactactgcgaggatcagaaccggttcaaggacacggggctccctaaggaatgtaccgcagactagatgaagccctaccaactaatagtgtgattagacatgggcatagttcatcgaaacagagaaatcgatccgaaatcaaaaccaaaagaaatgatatacggagtacatgaattatgattcacttgtattgtataactatacttcatttatgtctgatgtctcacattg

SEQ ID NO: 9282 - DNA, 406 bp, Zea mays
  Clone ID: LIB148-021-Q1-E1-G10
aaagaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgc

SEQ ID NO: 9283 - DNA, 404 bp, Zea mays
  Clone ID: LIB148-021-Q1-E1-G11
cccacgcgtccggtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaa

SEQ ID NO: 9284 - DNA, 357 bp, Zea mays
  Clone ID: LIB148-021-Q1-E1-G12
agaaaatggtcgcggcggcggcggaggtgtcgacggcggcgacggctagcagtagccccccggcggaggagggggagcggcgggacgagagcgagagcgacggggagatggcggggctggcggccgtgctggacttcgacatgctgtgcgcgtccgtggcgctgtcggcggagaggaggaaggccggcgcggcgctggcgggcgcggccggcgactgcggcggtggaggcggaggggtgcagaggatgtgggagggcgacgtcgtgctggattgcctacacgaccggcgattcgcgctcgagacgtcctgctgcccatgctaccggtttggtaagaacatgcggcgagccaatctcg

SEQ ID NO: 9285 - DNA, 339 bp, Zea mays
  unsure at all n locations
  Clone ID: LIB148-021-Q1-E1-G3
gtgatctgtctagccgtttcttgggtcagtgctggaaggtcaaactgttggtggaaacctcaccggggtgcttcaacgaacgcgaaggtgtcgctgtcatttagcgcgtcttgattggatttgacctgttggcctgntggcgtgttgtcgttgattgagctcgaggatgatgaaatgggggctcagcagcggcacgcccgcggattcctactacgaggtacggtcagattgcacggacggtgtgcccaagagcaagttcaagatcaaggctggcaaaacattaagtgctcggaaatggcaggctgcatttagtcccgatggctgtcttgatattgcctc

SEQ ID NO: 9286 - DNA, 334 bp, Zea mays
  Clone ID: LIB148-021-Q1-E1-G4
acgaacccttggccggacccttgggaaagctccaagcctggccaactggtcctcacccccaaaattggcaacatctccgaaattgaaattaaagagcacggttgccatgacttcccctttgaactcaaagaaggcccgggccggaactggacgcttgacacaaagggcccactcaaagtacccctctgcaatcgcctttgcaacaaatcctggcgctaccgcatcgccgatgatgtcatccctgaaaattttaaggccgacaccacctacaagaccaacctcagcatctgatcatcctcttatgaggaataatattttgaaagagctcatctga

SEQ ID NO: 9287 - DNA, 364 bp, Zea mays
  unsure at all n locations
  Clone ID: LIB148-021-Q1-E1-G5
gatttttgtgaatggtgaaggcgtgggtagatactgggtctcataccgaactcttgctggaactccttctcaagcactataccatattccgcgtcctttcttgaaatccaaggacaaccttttggttgtcttcgaggaggagatgggcaagccggatggcatcctcgtgcagacggtgacgagagacgacatatgtctgttcatctcggagcacaacccgggacagataaagacgtgggatacggatggtgacaaaatcaaactcattgcagaggatcacagcangcggggcaccttgatgtgcccccctgagaagacaatccaagaagtcgtctttgccagcttcggcaacccaagaggcatg

SEQ ID NO: 9288 - DNA, 351 bp, Zea mays
  Clone ID: LIB148-021-Q1-E1-F1
cttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcggcgccatctgggcgttcagcgtcgtcacctacttcccgctggacgtgctcaagttcgccatccgctacgcgctctccggcaaggcctggaacaacatcaacaacaagac

SEQ ID NO: 9289 - DNA, 369 bp, Zea mays
  Clone ID: LIB148-021-Q1-E1-D5
cccacaccttgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaag

SEQ ID NO: 9290 - DNA, 361 bp, Zea mays
  unsure at all n locations
  Clone ID: LIB148-021-Q1-E1-D6
cccacgcgtccgcgccgtcctaccttcatatacctagcagtgtctctgcatagaaagataaaaggtaggaggaggcgcagtgcgtggtgggattatttgtgaggagatattggagttattatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgaggccacgtacaangcatgaccggtcgaggtcgccaaccaac

SEQ ID NO: 9291 - DNA, 347 bp, Zea mays
  Clone ID: LIB148-021-Q1-E1-D7
atcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggaccta

SEQ ID NO: 9292 - DNA, 421 bp, Zea mays
  Clone ID: LIB148-021-Q1-E1-D8
ctcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaagacagccacgaggaggacatctgcgaggtggtcttggtggaaagcccgcgcaaggactgcgacca

SEQ ID NO: 9293 - DNA, 355 bp, Zea mays
  Clone ID: LIB148-021-Q1-E1-D9
aacagcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggtcgcggaggcgccggctccgtctcccaacagcggctcctccgcggtcgcacccgccatcgtcggggccgccgtggcctccatcttcgcgtactacattcactgagccgccggacgacgagccggagccggagggaagagaccaaggtggggggagagacttggctgcgctgcgctgctctgcggctcccgcgcat

SEQ ID NO: 9294 - DNA, 338 bp, Zea mays
  Clone ID: LIB148-021-Q1-E1-E1
cccacgcgtccggttgcggagaccgctgccgcccccaccaccacggaggtggaggtggagtcccccaagaaaggagcggcgccggtgccagagcccatcgtcgttgtcgccgcagtggaggacgtggtggcggacaagttcgtggcggtggtgaaggaggcgatcaagaagccggagatggacgagaaggaggtggcgatgcggagattcctgggcagccgggtgaagacagcgatggagccgcggtcagagtcggagcagccgcggcgccgggaggtggctcggagcaacgacgtgatcgaggcggcacgcaccaagctgatgcagaagcgccagtg

SEQ ID NO: 9295 - DNA, 403 bp, Zea mays
  Clone ID: LIB148-021-Q1-E1-E10
gggaggcaaggacctggaggccgccgcgcccatgctcaccttcgaggcgggcaagacgtaccgcctccgcgtgtgcaacaccgggatcaaggcgtcgctcaacttccgcatccagggccacgacatgaagctcgtggagctggagggctcacataccctgcaggacgtgtacgactcgctggacgtgcacgtcggccactgcctctccgtgctggtcgacgccgaccaggcgcccggcgactactacatggtggcctccacgcggttcatccacgacgccaagtccgcctccgccgtcatccgctacgccggctccagcggcgccccgccggcgcccaacatgaccgagccaccggccggctgggcctggtccatcaaccaggccaggtcgttccgctggaac

SEQ ID NO: 9296 - DNA, 397 bp, Zea mays
  Clone ID: LIB148-021-Q1-E1-E11
ccgacgcgacgattcctctcctccgcccgttcccaccgatctcacgctctctctctcttcctccgtcgcgtcgggtcggcgtcgccatcgccggccatgggttgcggtggctccaaggaggccgtggccaccggcaacaccagcgccggcagcaaggtcctccggaggaagccctcctccgtctccaccggcgcaagccacacatccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgc

SEQ ID NO: 9297 - DNA, 404 bp, Zea mays
  Clone ID: LIB148-021-Q1-E1-E12
cgacgtggcggcgcgctggccggcctgctccgcgcgggagcgccgcggcggcgtcgacgtgttccgcctgctgtggcgcaccgcgttcgtcgcgctcatcaccctgtgcgccgtcctgctgcccttcttcaacagcatcctgggaatcctcggcagcatcggcttctggccgctcaccgtcttcttccccgtcgagatgtacatccgccagcagcagatcccgcggttcagcgccacgtggctggcgctgcaggccctcagcatcttctgcttcgtcatcaccgtcgcggccggggctgcctcggtacagggcgtgcgcgactcgctcaaaacctacgtgcccttccagaccaggtcgtgatgagcactgcacgtacggtcccatatgtagctcaaaaacttaa

SEQ ID NO: 9298 - DNA, 398 bp, Zea mays
  Clone ID: LIB148-021-Q1-E1-E3
aatcccttgtccatgttccacacacatgcagggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgcgggcatcagcgagctggagggcgtcgtgttcgaggtcgtcatcaccttcgcgctcgtctacaccgtgtacgccaacgcgccgaacccaagaag

SEQ ID NO: 9299 - DNA, 414 bp, Zea mays
  unsure at all n locations
  Clone ID: LIB148-021-Q1-E1-E4
acccacccttccgcgcggacacggtgagggtcaaccggaactccgtggcgcagataaatggctacttcctgacgcacttcaccgacacggtcagcaacctacaggacgccaacatcaccgtgtttgtcggcgtactcaagaacgagttcatgaacctcggcttcgactacttcgctgacncgacggtcgagatcgctacctacacgttggcagtgctggctgatgggctcgtcacggacaaccctgccactgcagcttcctacttcaggagtccatgcagtgacatgaagctgaacctgagctacacgatcctgcctgcacaacctggcgctctggtcaacctggcatcnccggggggccctggctccggcgggagccccggcaccgttgctccaacccgctgacgttgtggac

SEQ ID NO: 9300 - DNA, 318 bp, Zea mays
  Clone ID: LIB148-021-Q1-E1-E5
gggatatcattttccttgttttgttgccaagtgaaatgattgttgggcactactacttcccccttaattcttgatcccgccggacagaatgcagaggcagctgagcgtctcctcgatgcccaagctcctgccggaggaagccgccctcggcggcgacgacgacgacgtcgaggccaagcccgagaaggcgccggccccgcggccgtcggggaaggagcggtcggtgcacctcgtaccgctcatcgtcgtgctctgcttcctgctcctcttcctctgctcccacgccccctctccctctgacatgtccagttttgggaa

SEQ ID NO: 9301 - DNA, 415 bp, Zea mays
  Clone ID: LIB148-021-Q1-E1-E6
agaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaagtggtttgtgccatccacgacctcctggccggggccgacaagggtg

SEQ ID NO: 9302 - DNA, 352 bp, Zea mays
  Clone ID: LIB148-021-Q1-E1-E7
ggccccttgccggcgggaactcaccagaccaggaatcgtgctggcaaccggcgcaagtctggagatagggctgataaagctaattactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtc

SEQ ID NO: 9303 - DNA, 426 bp, Zea mays
  unsure at all n locations
  Clone ID: LIB148-021-Q1-E1-E8
cggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctcccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacgtggagtacgccggcaagaacaacanaaccatggccgtctgcagcaacgccaaggggcacgc

SEQ ID NO: 9304 - DNA, 307 bp, Zea mays
  Clone ID: LIB148-021-Q1-E1-E9
acgagttcgacgagtggatccgcgaggtcgacgtcgcgcccgacggcaccatccgctacgacgacttcatccgccgcatcgtcgccaaatgatcccgtcccctccgagtctccattccgccgatccaccctcgcgcgctcttcgtctgtaataacttcgtctcccatccccgtgatttcattttgtttcccttctatggctggctcatttgaattcaatctggcctcctcttcgttccgagactgctcggataaaacggataatggttgctgtgtgattatcaaccaatcaacgattaattattagt

SEQ ID NO: 9305 - DNA, 408 bp, Zea mays
  Clone ID: LIB148-021-Q1-E1-D4
agccttcgagagccctccccttccttcggtaggtgcatggctccgggggtccacattgggcaaccaaccgttggcaacaagaccaataataaacccctcctcctcctcggccttgcgttcggccccccttgtgccggccccggccgcgccaaagccccccggcggggcttcaacaactgggttggcaataaacaagcagagctacgccctgtacgcgcaaaaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaaacacaagcgcgtgatcctggatctcaagcccggcgctcatt

SEQ ID NO: 9306 - DNA, 412 bp, Zea mays
  Clone ID: LIB148-021-Q1-E1-B9
accacctccctttacagtatttaaggatcgctgaagctgcagaacggcatgaagagatgaaggaactgaatctgatcatggatcaatctacatgttcatgtcaagtggaggatgccaaaaatctggaactacgatgccctgtatccgaaattctccaaaatagagaatgtatacattttcaatgataagatcctagccaaacatttctctttctctgtatagttcttgtcaaagtttgaagagtttggagttgaacctaccttgttgagtggaaggggattgtgttcagaaaactttagagatgctttttagattgccgggatgtaaattgttgccagctggaaggccttgacttttaacagtctcaaacaataacatttaagcatggattacctcttgcatagtaatttcc

SEQ ID NO: 9307 - DNA, 385 bp, Zea mays
  Clone ID: LIB148-021-Q1-E1-C10
agcggcggcggcggctctggacaaggggttcgagttcgacgccaccaccgcgcggtgcgtgacgttcgcggccagcggggaggtcgtggccacgcacgccgtcgcgccgggctccgcgtgcgccgtgaacggcacgggtcacttcggtatagcggtgctgctgcccgagacgccgccgccagcctcggccgtgagggccaggtggtgggcgtggacggtgggtgtcggcgccggtggggtgctgggagccagcgccttgacgctctctgtggccggcgcggtgagctggaccaggatgcggcgaagggaggagatggatcggcgggcgatggccggggaggagctggggaggatgacggtgcgcgggagcaggatgccatcggcg

SEQ ID NO: 9308 - DNA, 406 bp, Zea mays
  Clone ID: LIB148-021-Q1-E1-C11
gtcgtcgtcgtcgtctcgttctgtggctcgtgatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtagccctccgccgtatctgtcgcttgcacccaacggctccagccctctgctcgcgcagactgctctcaccactggtgtcagctacgcttccgcagacgctggcgtcctcgactcaaccaacgagggcaagtg

SEQ ID NO: 9309 - DNA, 405 bp, Zea mays
  Clone ID: LIB148-021-Q1-E1-C12
ggcaggtctactagcattagagcacaaagagcaccttgcttcgatttctgtatcatctcaccaggaagagctaagcaacattacatatgagctcaacatcatccatgaaagaacaaaagcaactaagatgcctatagagctacaacaagcaactgaagttgtggaacaagcaaaagctaaggctttgatggcccattatgaggtggcaaaagctagggaagatgcggatcaagttaagtcacaattaaatgtcattaaattgagactagaagcggcatcaagggagatacttgcagtgaatgcatctaaagaaattgcaaccacctcagcaaatgcattgcaagaatacaaagatgaagcacatatagagccccaagatgagcagataagaaataactatatgac

SEQ ID NO: 9310 - DNA, 374 bp, Zea mays
  unsure at all n locations
  Clone ID: LIB148-021-Q1-E1-C4
aaaataaccagtggtattaaccgttggttcatccttgcaaaaagcctgcgtgcccttcgttcttcctcgtcccgattccgacgacgctccgttccgctccgggcaaacacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtantcggttggattccgtttatatatatat

SEQ ID NO: 9311 - DNA, 362 bp, Zea mays
  Clone ID: LIB148-021-Q1-E1-C5
ggaacatccatcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgc

SEQ ID NO: 9312 - DNA, 347 bp, Zea mays
  Clone ID: LIB148-021-Q1-E1-C6
ctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgac

SEQ ID NO: 9313 - DNA, 405 bp, Zea mays
  Clone ID: LIB148-021-Q1-E1-C9
cttaccctcgaagccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacac

SEQ ID NO: 9314 - DNA, 371 bp, Zea mays
  Clone ID: LIB148-021-Q1-E1-D1
cccacgcgtccggcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggac

SEQ ID NO: 9315 - DNA, 405 bp, Zea mays
  Clone ID: LIB148-021-Q1-E1-D10
agccacgcgtccgctgaaagctgatagctgtcaaactcgagatgctggctcaactgcctcaacagctattattgtaggtgaccgtttgcttgttgcaaatgttggagattctagagccgttatttctaaaggaggacaggcgattgcggtttcaagggatcacaaacctgatcagacagatgagagacaaagaattgaggacgcagggggctttgttatgtgggctgggacatggcgagtgggtggtgttcttgctgtctctcgcgcatttggtgataaactcttgaagcagtatgttgtcgctgaccctgaaatcaaggaggaggtggtcgacagctcccttgaattcctcatcctggctagtgatggactctgggatgttgtcactaatgaggaagctgttgc

SEQ ID NO: 9316 - DNA, 325 bp, Zea mays
  Clone ID: LIB148-021-Q1-E1-D11
gacacacgccactaaactaagtcggatcaccgcgcacagatcatcgacatcgccgctgccatcgaggtcctgaccgtacggacgacctccacaagcggaggatccgccgcgctcgtggtgatatgcatcacgacactgtccgccaacctgtgaaacataacggaggcgaagcacaccagcacgtacaaggtggtggacgcggtgacggtgctaaagatgcaggtggacgtctgcacgaagctcttttaggccgcgcaggggatcgccatggacgaggtcaatgcggcctccacgctcgacgagcagtcggcgctgaagctctgca

SEQ ID NO: 9317 - DNA, 401 bp, Zea mays
  Clone ID: LIB148-021-Q1-E1-D12
cgctgtcgtccttctccttcaagctccaggacaggcgagggcggatgcaccgcttcagctgtgaggttcagagcttgacgcctctggtgacctgcatcctgcggaggctcggcgccgacatcgaccctgaccgcctaccgcaaatcctgtacgaagacgaggaccgggacaaggtggtgctcgcgtcggacgacgacctcgcggcggcggtggaacacgccaggctcgccggatggaagggtctgaagctgttcctggactactccggcaccaccgggcgcaggaaagcggtggccaccccacgtggcgccatggcggtgggcatgtccagccgggacgcgtgggcggcggcgtacagcggggtcgccgccggggctgccctcgtcactggcatcggcgtc

SEQ ID NO: 9318 - DNA, 393 bp, Zea mays
  Clone ID: LIB148-021-Q1-E1-D2
gcaagcagagatcagatcatccatcggcaatgtcgaacatcgggcagtccttccaggccggcaaggcggaggcccagggcgagtaccaggcggagcacgcggcgcagtgcgtcaaggacaccgccggagccgcggccgacagcgcgcagctgcagcagcaccgcgccaccggcaccgttgagcaggtggcgcatacgggccacggcgtggcggcaggcgtcaaggacacggtggcgggcgcggcggttggcgtcaccaacacggtggcgggcgtggcggcgggcgtcacgaacacggtgaccggcgcggtggcgggcgtcacgaacaccgtgaccggcgcggcggcgggtgtcaaggacaccgtgaccggcggccactgatccacgacccacc

SEQ ID NO: 9319 - DNA, 372 bp, Zea mays
  Clone ID: LIB148-021-Q1-E1-D3
gggaagggggagaaacagaccaccagatcgatcgagacctcgccgtcgtccggcagggttaatataatttggttcttctccggccgggtgtgcatggcaaaacgacccacggtgcccaagttcggcacctgggacagcggcgatgccgggtacacggcctacttcgacaaggtgcgcgagaacaagggcgccacggcgccgccgctgcgccggccgcgcagccccaacgaccccgaccccgaccgcgagcccgagccagaggaggggccaatgaggagagtccccccgccgtcgtcgtcgaggccggcgaccgcaggaggccaccgcgagccgccgccgccggggcggcgccacgggcagagccacggcgaa

SEQ ID NO: 9320 - DNA, 416 bp, Zea mays
  Clone ID: LIB148-021-Q1-E1-B8
aacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagtttttttatttgcttttttttgcagacaaatacaaaccacacacatatatatatttggtaaagatcggtcgtattttcattttcaccgggaagatttgtaactgtcctcctccctcc

SEQ ID NO: 9321 - DNA, 422 bp, Zea mays
  unsure at all n locations
  Clone ID: LIB148-020-Q1-E1-H8
cggacgcgtgggcgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcanacaatgaacgtgcagcagcccgctgatgttgccggacccagcgagggggtggcggc

SEQ ID NO: 9322 - DNA, 403 bp, Zea mays
  Clone ID: LIB148-021-Q1-E1-A11
ggggattggttgctcgtcggcatcaccgggtgaaccctccccaaatcggaccgctttgcttgattgtgagggcggctagggtcgcccgagactgctattcgtgtccacaggccttcgatgggcggtgtggccgggaattgctcgccggggatcgtcttcgccgagaagccgctccgtctcgtggttaggcttgccatcaattcaatcacagcagtgtggacacgaggatctgaagaatcaccctggttactggaatctcaagtgctaggagaagaacaggtggttcaagaggagccacatatcgaggagttcgattcgatctaggtggcgtctcccacttgactttctggcgccaatgatggattttagatccttttatatttatcttttattttgtaagact

SEQ ID NO: 9323 - DNA, 402 bp, Zea mays
  Clone ID: LIB148-021-Q1-E1-A12
acattcaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaatgtcgccaccgccgccgagaccacgacga

SEQ ID NO: 9324 - DNA, 279 bp, Zea mays
  Clone ID: LIB148-021-Q1-E1-A2
acttatccgtcctctgctgtgccacggctggcaccgccgtcgacaccgacctctccgagtaggtcatccaaggccgcgtctattgcgagatctgctgcgcctggttcgtgaccattgtcaccgagtacatcacggagcgcagtgtgacgcgcgagtgcacgcacatcagtacctggatgccccatcgctccagcgacggcgtgacagatcggaaaggtacgtgaacgatctcactcctagacacacaggatgacgacatctgcgaagtggtcctggcgg

SEQ ID NO: 9325 - DNA, 352 bp, Zea mays
  unsure at all n locations
  Clone ID: LIB148-021-Q1-E1-A3
ctcgcgggccgacccacgcgactgagctcatcatgacaatgacaatagccgccgtgctcctgctgccctcctccctggcgtccccccgcgcggagaagactttccccggaggcngatgcggacgctacagctggttggaagccgatggcggacgcagcggcggcggctactccaccccgagcgatgcagcgccatccacacctgccgctggggagactacgaccccttcgtcatgcggcggttactccacccctagcgaggcagcgccatccacgcctgccgctgaggagacgacgacgactccttcgtcaggcggcggaggttacggcggtgcaaccggcaaagcttcctc

SEQ ID NO: 9326 - DNA, 287 bp, Zea mays
  Clone ID: LIB148-021-Q1-E1-A4
acccttcggccaaaccttccgctcacccgtcagccaacgcgtccggtggaggcaaatttcctttgtaccctggctcaaggcaagtaattacctggaaacccggttggtggggcttctctcagattttatccctccttgtagcaacttccaagaactcgtccattgattcatttgttgtcttgtacgaaacatttgttccaacatgtgtcatagatattttcaatgggttaatttctaataaaactatgtttacaagcaacaacatgcaatcgtgacggtgatcagag

SEQ ID NO: 9327 - DNA, 74 bp, Zea mays
  Clone ID: LIB148-021-Q1-E1-A5
tctttcctgcccaaaaataattaaatgctcaacgagatggagacgtgtgaaatgaatagattttcttgctgctc

SEQ ID NO: 9328 - DNA, 351 bp, Zea mays
  Clone ID: LIB148-021-Q1-E1-A6
gcaccatcatcacctccaccgtcggcacctgaggagttcatcttgccaccaatcatggcgcagcagtatgcgtcgccaccgccgcctctgttccaaggatactaagcggtgatcacagcgcgctctactgacgatgagagtaatcgcgacgagggaggccaggagaagcagtgacaagtcgatcgcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaacatgcaaatggagaaggaattgtttctgcctttc

SEQ ID NO: 9329 - DNA, 367 bp, Zea mays
  Clone ID: LIB148-021-Q1-E1-A7
gcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgct

SEQ ID NO: 9330 - DNA, 407 bp, Zea mays
  Clone ID: LIB148-021-Q1-E1-B10
acggcaaggtggtttaaccacattgatgcgctcgtgaggctgagcggaattactgcagagggccaaggtgtgaaggttgaatcctcagcagttccttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgtccagatggaagggctgctctggggcgcatccaagcttgtcccagttggatatggtatcaagaagctgca

SEQ ID NO: 9331 - DNA, 64 bp, Zea mays
  Clone ID: LIB148-021-Q1-E1-B11
aaataaatcataaataaaaaaaaaaaaaaaaaaaaaaaaaaaaaaaaaaaaaaaaaaaaaaaaa

SEQ ID NO: 9332 - DNA, 402 bp, Zea mays
  Clone ID: LIB148-021-Q1-E1-B12
agggcaagcctacccacggcttgtcctcctcgccctcgtggcgttgttgtctgccggcctcttcccgcaggcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgacaatttggccgtgctgaacatgcaggtggccgcgttcgccaagcgcacagcgcaggcgcggaagcacgtcgcggtggcggcccgcactattccaccgccgcaggcacaggccctcaggacctgcgacacgatgtacatgaacacgcaggacgccatcggcgcggcacagcgagccatcgcgttcaaggacac

SEQ ID NO: 9333 - DNA, 376 bp, Zea mays
  unsure at all n locations
  Clone ID: LIB148-021-Q1-E1-B3
aaaagaagtcgcctaattctttcgatcgaattaggcgccttcttcgtcncacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcanggacgacccgatgggggacgcggagatcgacgtggcgc

SEQ ID NO: 9334 - DNA, 386 bp, Zea mays
  unsure at all n locations
  Clone ID: LIB148-021-Q1-E1-B4
agccttcgaccaagccttcggccaagccttcgggttcaaaaccttcaaaaccccggcatgttcgtccccatccaagccgttctccccccggatgccaatgggccttacaaaaggtaccttctccaatccggaaaatggtttaagcaaaacgttcccaaccaagaaggaatagcccttccccaagccaatcttcggccttgactgggcgggtccgaactcaccgactaactaatgaagattctgactgagcgcggctactccttcancaacaccgctgagccgggaaatcgtgagggacatgaaggagaagctcgcctacatcgccctggactacgaacaggagatggagaccgccaagaccagctcttccgtggagaagagctacg

SEQ ID NO: 9335 - DNA, 368 bp, Zea mays
  Clone ID: LIB148-021-Q1-E1-B5
gaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttctttgttccctctttctccttaatttaacgaattgatgcatgccgctgatgttcttccccctgagagagggattaacac

SEQ ID NO: 9336 - DNA, 361 bp, Zea mays
  Clone ID: LIB148-021-Q1-E1-B6
gaccctcctccccctctccggcgcgcgacgctcgccgccgcgcctcccctcccctcctccgaacgccgtggctgccgtgcgcccgaccggccggtgacggacacggcagctgctacgagaggaggaggatatatactagtatatagctagagcaattattagctggtcgtaagcatgaatcgattggacatgatagacaacatcgacggccgtcgggtaaccaagaacaaggcgcgcatccaagttggcgactcctcttcgtcggacgaaagcgacagggagaaggaggaagatgaagaagaagcacatgaggaagtggccaaggcgcccccgttgggttggaatcatcacaatcaccacg

SEQ ID NO: 9337 - DNA, 314 bp, Zea mays
  Clone ID: LIB148-020-Q1-E1-H7
gcgcagacacacacaaccagatgtcacccaaatccacccgtcggcacctccgcttcaagatgcatatctttgtaaaaaccctgactggcaagactatcaccctcgaggtggagtcgtctgacaccattgacaacgttaaagccaagatccaggacaatgagggcatccccccagatgaacagcggctcaactttgctggaaaacagcttgatgacggacgcacgcttgctgactacaacatccacaaggtgagcaccctccaccttgtgctccgatctcaagggacgcatgcagatctttgtgaaaaccctgac

SEQ ID NO: 9338 - DNA, 370 bp, Zea mays
  unsure at all n locations
  Clone ID: LIB148-021-Q1-E1-B7
caataacccagtcggcaggcgtgacccgatgctctctcgtcgtcggatcgtcgccaccgtctcctccgcgtcgtctacaccgacatggacgaccggcagtatgccggactgaccaaggcaggtttgggcgtgctggccttcaactcgggcctcgccatctacaactcctggggcgacgcgagctccgtcgcgttcgtgctctccgcggactccatcctcgtgctgctcttcctctgcctccgtgagctggagctgcaggggcggccgggggccgccggcaggggcagggatgtcgggatcatcagagccgcggtgtggacgctgacgacgctgctctcggccatgttcgcgtctanggtggcgccgctga

SEQ ID NO: 9339 - DNA, 434 bp, Zea mays
  unsure at all n locations
  Clone ID: LIB148-020-Q1-E1-G12
gccatgggcgcgggataccggctgaggcatggcaggcggctctggcttcccacccttctgttcagagatgggggtggtgggcagtatttcatctttgggttccacaatgctcacgtgatcaggcagaggcttcttagggccaatcttaccagtcgggtcccaaggcagcatgatctttaccttgatgcccagcacaccctgtctgagcagcacatggcgcacggcggtgtccacatagtagttaacagggtccccactgtggatcatgaggccatccacaaacttcatggatttagccctctgtcctcgaagtttcccagacaccacgacctcgcagcctttggccccactctccatgatgaaccgcagcacaccatagcaggccctccgcacagcaaggcctcctangagtttgtaacgcagagactctgcct

SEQ ID NO: 9340 - DNA, 308 bp, Zea mays
  Clone ID: LIB148-020-Q1-E1-G2
ctagatcgcgagcggcgccctttttttttttgtggttattgtattcatgtcgtggttatgcgcatgtgcttctgtattaagccttgttttttatgggaacagaaaagtgttgataagtcccactataatgagtgttttttaaaccccattatagtgatttgagaggggattttaagattatgtcaggcaatataaccgtgcgttctcaattgggtcaaccccaaccaacgtcccttctcccttcccgaaggttggatcgtccttggtccttttgaaagaggttacttccccaaaggatacaaggttgg

SEQ ID NO: 9341 - DNA, 431 bp, Zea mays
  unsure at all n locations
  Clone ID: LIB148-020-Q1-E1-G3
caagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatnctgaacaattgactaacatgcatatnatatatactaggtaaaatccccgtgcattgcaacggaaaacacttgtgtatacacaggtcatttt

SEQ ID NO: 9342 - DNA, 424 bp, Zea mays
  Clone ID: LIB148-020-Q1-E1-G4
cggatacgctcgccgtcgaggcgctgcagaagatggttcaaggcaagttcaggcacctgccggtggtggataacggcgaggtggtggccatgctggacatcgccaagtgcctctacgacgccatctcccggatggagagggcgtccgagaaggggaaggcggcgatcgccaacgtcgcggctggcgacgacaagtactccatcgtcgaagctctcaaggagcaaatgttcaagccctgcttgtctgccattattggcgaagactcaacagtcgtcatggtgtcgcctggtgattccgtccttgcagctaccaagaggatggtggaagcgcatgcgacctcagccgtagtggccgtggggagcaagccgcaaggcatcctgacttcaagggatatcttgatgcgcctggtcgctaagaacctgtc

SEQ ID NO: 9343 - DNA, 429 bp, Zea mays
  Clone ID: LIB148-020-Q1-E1-G5
gtgatttgaaatacttgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactatgcagtgctaaacaagatcgctcgatcgttcgccatgcatcgacaacctattcttaataacgttcattaatctcgtcctatttatgacgaatgtcatgtatgtcctggtgactgtcatgtatattctgatgactgtcat

SEQ ID NO: 9344 - DNA, 425 bp, Zea mays
  Clone ID: LIB148-020-Q1-E1-G6
gccaccctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccag

SEQ ID NO: 9345 - DNA, 328 bp, Zea mays
  Clone ID: LIB148-020-Q1-E1-G7
agccaccctcgtcgcaccctcgctccctcacacacatgataaaggaaggtcccgcccttttcctccgacatccacaaggggggaggggaaaccacgtacattcacccggcggcaataatggcctcggttccggctccggcgacgacgaccgccgccgtcatcctatgcctatgcatcatcctcacctgtgccgcggctgactacccgaacctccccgactacgtcatccagagccgcatgtactgcgacacctgcctgctccgggttcgtgaccaacgtcaccgagtacatcgcgggcgccaatgtgacgctggactgcaagcacttc

SEQ ID NO: 9346 - DNA, 427 bp, Zea mays
  Clone ID: LIB148-020-Q1-E1-G8
cgccgtggcacggcctcgaggccggcgacgacgcaggcgcgaggcgccggagggtccggccatgacgtcgtccgtgcggcagtggtggcgccgcgccgccgctgcgctcaaggacaggaggagcctgctcctggcgcgcctgcgcccgcgccgggccgggtcgtcgtcgtggcaccaccgggagctggaggcggccgtgatccgcgcgacgagccacgaggatcggtggatggactaccggagcgccgcgcgggtgttcgcgtgggcgcgctcgtcgcccacgttcatccggcccgtcatgtgggcgctggcgcgccgcgcgcggcggacgcggtgctgggtcgtggcgctcaagtcgctcatgatggcgcacggcatcttcctcggctcgggccgcgcgccgcgcgccggccgcgtccccttcgag

SEQ ID NO: 9347 - DNA, 355 bp, Zea mays
  Clone ID: LIB148-020-Q1-E1-G9
gccatgggcccgggatacatgacctcattggggcccagctggtggactgtgtctccaccacttctggaaccctcctccgcctgccagagacctgaggactctgttcatcattgcacacctccccagggtggggattgaggggcccagaagggctgcctgccctggctcaggcagggtcaccttgggaaggctcggaagcacaaatgagtgctgggcttgctgctgtgccaagggtcatatgtgactgccgctgttgacctgcgctgcgtcacagtggaggggtttgggcctgtgcttctctgccctttcacgaaagtggagccagaaaccttgccaaggccatggctgctgtctt

SEQ ID NO: 9348 - DNA, 237 bp, Zea mays
  Clone ID: LIB148-020-Q1-E1-H1
ccgacgcgtccgttcacgcgatcagatctgagagcgtgcactcgatgtggcgtcaccgatattatcgtcgtcctggtactgtttgcagggtgcaacccaatgggggctggcatccttccaacagtattcggcttcaacgatattcatcatgcataccggctgaagtcgctcatcggtagtgatacataatgatgacaaccaaacttgttctggggacatgcaaaccggggtgtgtgc

SEQ ID NO: 9349 - DNA, 414 bp, Zea mays
  unsure at all n locations
  Clone ID: LIB148-020-Q1-E1-H12
cgggctcgggatacaatgataccggttcctccatcgtccaccgcaaatgcttctaggcggactgttagctgcgttacaccctttttcttgacanaacctaacttgcgcagaaaacgagatgagattggcatggctttatttgtttttttttttgtcttttttgattttttttttttttggcgcttgactcaggatttaaaaactggaacggtgaaggtgacagcagtcggttggatcgagcattcccaaagttctacagtgtggccgaggacttgattgtacatggttttgttttttttttaatagtcattccaaatatcgcgaaatgcattgttacaggaagtcctttgccttcccaaaagccaccccgcttctctctaaggagaaggggccagtcctcgcccgagtccacac

SEQ ID NO: 9350 - DNA, 415 bp, Zea mays
  unsure at all n locations
  Clone ID: LIB148-020-Q1-E1-H2
agcacctcctcttcccccgccgggcaacaactcagccgccgcaaccgccacatcagccatgggcgcctgcgcaaccaagcccaagacgcttgaagggcaagccccagctgaagccgccgtctccacacccaaggttgcgcccgaagccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggangaagccgtggagaagaccgtcgtcgaggaggagaagccagcggcagcagcccatgcagangaaaaggtcgcccacgccgccgagaacacgacgacggtggaggcgaagaagaac

SEQ ID NO: 9351 - DNA, 347 bp, Zea mays
  Clone ID: LIB148-020-Q1-E1-H4
gggtcgcagcgcacgcgtccgcccacacgtccgagaagaatcagatcaccttctttacctctgcgtacgatggttcttgtaaagatgctgcagattcctgaaagacggtacttgaactgcccggagcatgttgtattttcttaagatgctggaactaagacggcttagttgaattttcactatcaagtgagtctcggtcttgccccaaaaagaatgttttgtacctcctctgtcccaatttatacgacaatttataattcgtaaaaaaaaaagtgaccgaaacaaaaagcaaaaatcaaagaaccataacagaaagaagaagaaagagggggatccgccaggagttc

SEQ ID NO: 9352 - DNA, 430 bp, Zea mays
  Clone ID: LIB148-020-Q1-E1-H5
gtatcatgacgctatcactacggagaacatcgaagtacatggtgaggaagtaaggattcagcgccctgaacatcgcgtggactgcaaaatgtctcctgaggttgagcgtgagtggcaccgtgttcaggccacagaggacatgtctgccgcacgggctgcagcggaggtaggtgctttctctcaggccgtggcaatcctggaagcccgtaggaggatactggaagcacaagcagcacaatcttcagacgaccagttcctggcattgatggcggagctgacggagatgcagcagagagtggagaaccggcggaagtacgaggagtcaggcagagctttcatgctggcaggcctgagctcagactcatggcagagagcatctgcacgaggggactcatcagagatcactaccactattcatacctaccagacg

SEQ ID NO: 9353 - DNA, 377 bp, Zea mays
  Clone ID: LIB148-020-Q1-E1-H6
aggcgcacacacacacaaccagatctcccccaaatccacccgtcggcacctccgcttcaagatgcagatctttgtgaaaaccctgactggcatgactatcaccctcgaggtggagtcgtctgacaccattgacaacgttaaggcgaagatccaggacaacgagggcatccccccagaccagcagcggctcatctttgctggcaaacagcttgaggacgggcgcacgcttgctgactacaacatccacaaggagagcaccctccaccttgtgctccgtctcaggggaggcatgcagatctttgtgaaaaccctgaccggcaagactatcaccctcgacgtggagtcctctgacaccattgacaacgtcaaaggccaag

SEQ ID NO: 9354 - DNA, 330 bp, Zea mays
  Clone ID: LIB148-020-Q1-E1-G11
gcatgatccctaccgccatgggcgcgggatacaatcaccatggatgcacaagtctcatatataaaaatggtgtagtaattgcagaaaacctaggtttatcctcccatatacttcaaatcagctactagatgaggtataatacttaatacactgtagatgcaaggtctatagttgtaattacaatgtaaatgctatgtaaatagttgctgaatgtgtaggatgttcaagtgtttgcatgttggtacttgactgaactttttttcttctttcgaaaggatgtcaacccattggttggctgaatccgtgaatgtggaactcattgagtcgagt

SEQ ID NO: 9355 - DNA, 306 bp, Zea mays
  Clone ID: LIB148-020-Q1-E1-E6
cggacgcgtggggcgatgcctggatttggagaaccacttcatcgtgacattgtcctaacaatacgtactttatatatgatctctctcagtgctattactggagtaaccagcaggatactcacactgcttagaggtgacaaagtccgcatacacttacaggcacatgaataaatgagaagcagtcagcgcctgttacgacgaagagccataccatccgtttcgttgtagttgtagctggatacgtcagttttgcactatcgaacgacaactaagtcgaagctgatagagtaagtgtaacacgtttat

SEQ ID NO: 9356 - DNA, 392 bp, Zea mays
  Clone ID: LIB148-020-Q1-E1-E7
cccacgcgtccgaccaaaccgacgatggcgtcgactaagacggtcctcatcgtcgcggcgatgcgtctcatcacgctcgtgctggacgccgcccctccggcgaccgccatggactgcaaggccgggtgtgacgatgtcacgggcccactccacatgaacatggaggactgcatgaaaaggtgcaaggacatcgctgctaagcaagggcctagggacccttacaaggataacaaacttgacatcccatgaactagttaatgctcctatatcatctgcctatccatgcatgcattgcattgcgtatgcacactgtgcgtgactgcccacacagttcgacaatacaccggatctcgatgggattgtaatcgtgtccactcgatcgagagatcgat

SEQ ID NO: 9357 - DNA, 352 bp, Zea mays
  Clone ID: LIB148-020-Q1-E1-E8
aacccacgcgtccgaccaggccgacgatggcgtccactatgacggtccacatcgtcgcggcgatgcttctcatcaagctcgtgccggacgccgcctctccggcgaccgccatggactgcaaggcctggtgtgacgatgtcacgggccgattccacatgaacatggacgactgcatgagaaggtgcaaggacatcgctgctaaacaggggcctacggacccttacaaggataacacacttgacatcccatgaactacttaatgctcctatatcatctgcctatccatgcaagcattgcattgcgtatgcacactgtgcgtgcctgcccatacagttcgacagtacaccgatct

SEQ ID NO: 9358 - DNA, 340 bp, Zea mays
  Clone ID: LIB148-020-Q1-E1-F1
gcccggctcgcccgagaacatcctctactaccacatgatccccgagtaccagaccgaggagtccatgtacaacgccgtgcgccgcttcggcaaggtgcgctacgacacgctgcgcctgccgcacaaggtcgtggcgcgggaggccgacggctccgtcaagttcggccagggcgagggctccgcctacctcttcgacccggacatctacaccgacgggaggatctccgtgcagggcatcgacgccgtgctgttcgcgccggacgacaccaaggccacgcagacagccgaccctaacaggaagcctcccgccatcgtcacccacaagaagaagatcaagctc

SEQ ID NO: 9359 - DNA, 454 bp, Zea mays
  Clone ID: LIB148-020-Q1-E1-F10
gcatgatccctaccgccatgggcgcgggatacgggagagggctgttcccctctcccccagtgcctcgggaggctgagactgggttgtgcgtcttgctctgcctaggtcccacagcaagaggagggctccgtgcaggggtgatccttatcacttgaagtcctctctggccagagtccctcaccttcccacagcccttgctaatgattaccataaaagctgcctccggcctggccttctagcctcagcccagtcaaaagtcccacctttaccatttgatttggtgtgtgcccttagagggaattcagagctccgttaggctcatagaggggcccagaccaaagatatggagggaggggtcccatatcagcaaacacctcaagtttcctgcactgtgactgcatttaagaagcaaagctttgtcaggtctaccagagcagctgataagcctgcagaa

SEQ ID NO: 9360 - DNA, 449 bp, Zea mays
  Clone ID: LIB148-020-Q1-E1-F11
gcatgactcccagccgccatgggcgcgggatactctagtttaaggcagcatttgaatggaagcagctgacttctgacaacagtcctttgtcttgaggcggtgagtatcttctgtgtttattatgccaggatttcactgctgactatagattcttcccagactgaggggctgaagatcgatcatgtttcaaagagttctttgaactgggctgtaggctagagcagagatgttttctttttctgatcataaatacttcaggttcacaaactacttcttcataatgccaaaactggaatgttctgtagtggggacattatagcagcatacacaaatgctaggatggaaacattagtgctggagatgtttgacagagtgatttgcactacaaatgtaaaacaaaacacaggctttgacaagaacaaaggattataaaaacatgcctaaaaatc

SEQ ID NO: 9361 - DNA, 447 bp, Zea mays
  Clone ID: LIB148-020-Q1-E1-F12
gcatgactcccgaccgccatgggcgcgggatacatgttcatggctggtctcgggctgctggttgtcgttggccttcatcagctcctggaatctagaaagcgcaagaggcccattcagaaggtagagatgggaacctcgagtcaaaacgacgtcgacatgagctggattcctcaggaaactctgaaccagatcaataaagcttcaccaagaaggttgcccaggaaacgggcacagaagagatcagtgggatctgatgagtaaatgttcctttgtgcaacaattcggtctttacttaacccgccctaatgtttttcggcctgatgggaattagtgcagagaagccatatcaccatagaaggcggctactacttatgtgtggactgagcaatccgagtctgtggcgatcatattgctgaaaatgcactgcatttatttttctaaagtaac

SEQ ID NO: 9362 - DNA, 357 bp, Zea mays
  Clone ID: LIB148-020-Q1-E1-F3
acccacgcgtccggctggttccatggctggaaccatacatgaaactttccttgcaatatacagtgggaaacttctacagagcttggctgtagcaactagccaagggtcattcttgtcggtggatcagattatctacaatggaatcggctttacaattgctgcaacttccactgctgctatcactatttatgcaaagaaagcgcttcaaaagctccaagcggaggacgagatattttgagaggtccaaggccaggatcaaacccgtaacgctagttttctttcaggtgtactatatatgaacagctggtactaatctggtttcctgtgtcgactaccggactgctactaacatccatc

SEQ ID NO: 9363 - DNA, 425 bp, Zea mays
  unsure at all n locations
  Clone ID: LIB148-020-Q1-E1-F4
cgcgatggcgtggaacgtgttccggttctgcacggctctccgtgggctgggttccatcatgatcctactcgtcctcgccatcgtcggcgttacctactacgctgtcgtcctctgcaactacggccccgccctcctcaccggcggcggcaccactctcgccgcgctcgctgtcctgctcctcttccactttctgcttgctatgcttttatggagttatttttctgtggtgctcactgaccctggttctgttccaccaaattggaatcttgattttgatgcggagaggggagaaactgctcctctcactagctcagagttcagtagccagatgaattcacagcaatctgtggctcttggcaatacggcaaatccaaagggcaaggtactgtangaaatgcaaccagttgaagcacctcggtgccaca

SEQ ID NO: 9364 - DNA, 429 bp, Zea mays
  unsure at all n locations
  Clone ID: LIB148-020-Q1-E1-F5
cggacgcgtgggtttcaccaaggattccggtgccttatttcacaagacaaaaaaagtctcaagggtcttgattcttgtatgaactcaagatttatggtggatcttggagctgtgggatgctaagcctggtctagctactagattatgaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatctggggaaaccattgcacatccaacctccatggctcaatgcattttagcagtgggagaaagcatggtttctgaagcggaacctcttctgcaagtggtggagtgtcgcatttgtcaggangaagata

SEQ ID NO: 9365 - DNA, 422 bp, Zea mays
  Clone ID: LIB148-020-Q1-E1-F6
gtcagagcgagggcatttaaattagatcgagcagagcatctaatagtaaaaatctagactatattacttatagaaataagcggggtccgtgccctcactgggctacacataggtccgcccgggcggggcggagccgcggaggcgcggaccgcggagcgggagcctgacccatatccatccctccgggcgcggagaggagggggaagcagagcagcgggcgcggcggacatgacgccgatgcggctggtcgtccgagcctgcaccgcaccccccatccgcgtactggaagtcgaggaagtcctggaagctgctctccctgtacattgctgggttcacctcgtcgaccagctcctcggcgcagcagaccttctcgtccttggagagactatggatgctggcaatggaaattcttgcttcatcag

SEQ ID NO: 9366 - DNA, 432 bp, Zea mays
  Clone ID: LIB148-020-Q1-E1-F7
cccacgcgtccggctccccgtccttctgtaggtgcattgcttcggtggtccaccatggcgcaacgagcggtggccacgatgacgactaataagcccctcgtcctcctcgcactggcgtccgcgctccttggtgcggcgccggccgccgcgaacgcgcccggcggggcgttcagcaactgggtggcgatgaaccaacagagctacgcgctgtacgcgcagaagtccgtcggggacgggggcaaggagcccctggacaagaagctgtcagaggcggagaagatcaaggtcacctacgtggtggaccccagcggtaacggtgactacaccagcatcaccgcggcgctggaggatatcccggtgagcatcacgaagcgcgtgatcctggatatcaagcccggcgctcagttccgcgagaagctgttcctgaacatc

SEQ ID NO: 9367 - DNA, 370 bp, Zea mays
  Clone ID: LIB148-020-Q1-E1-F9
catgatccctaccgccatgggcgcgggatacaacttgactaagctggacaggaggaattcggggtatgtcctgaggctgtgagctttgggtcccatgcagctgggggagtccatacaaacctggaagtaaaccgtgtctggtttgtaaccttcgcttccgtgaatagagagggtggattaaatggttcccaggaagccctctgcgattgttgctcagtcactcagttgcatccagctctttgcggctccatggactgcagcacaccaggtttcctggtccttcaccgtctcctggagctggctcaaactcaggtccattgagttggtgatgccatccagtcatctagtcctctgtcatccccttctgcct

SEQ ID NO: 9368 - DNA, 206 bp, Zea mays
  Clone ID: LIB148-020-Q1-E1-G1
gccgatgtgtgcatgaaggagagctttcccggtggcgagtgcaagcaggtcgtggccacgcgcaagtgcttctgcaagaagccttgctagttcatcggtcttgctaattgttgatgggtgcttcattaatttgatttgatgggtctcatggctacgagaaacaaaactacttttgataaaatgcagggcatgaaaagcgtttctgc

SEQ ID NO: 9369 - DNA, 292 bp, Zea mays
  Clone ID: LIB148-020-Q1-E1-G10
aaccaggggcctccaagtgaaagctcttcctgctcccactgctccccagccctgtcccaacatggcatatgtgggaaagcggcaggcctgaagcaaacgatgttctggctgtggtaagcagtgtcacagcatccctagtcagtgatcacagagtcacctgggttaaaagtctaggtctcacagtcaaggcaaggattatgaaggtgacacggcaaaggtggtctgaaggtgctcataattttctcaaattcagtggggaagggaaggttggaatgatgtccttcaaggccac

SEQ ID NO: 9370 - DNA, 342 bp, Zea mays
  Clone ID: LIB148-020-Q1-E1-E5
cggacgcgtggggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaagtgcggtgcgtggacagcccc

SEQ ID NO: 9371 - DNA, 352 bp, Zea mays
  Clone ID: LIB148-020-Q1-E1-D1
agcggttcaaagctgaccccggcaccgccgccggcctcctccgcctcgtcttccacgactgcttcgcaaacggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctgggacggcgcgactcgctcgtgtccaaccgcgaggacgccgacaacctgccgggcccggacat

SEQ ID NO: 9372 - DNA, 429 bp, Zea mays
  Clone ID: LIB148-020-Q1-E1-D2
cccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccactgccgccgacagggccgccgatgaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccc

SEQ ID NO: 9373 - DNA, 350 bp, Zea mays
  unsure at all n locations
  Clone ID: LIB148-020-Q1-E1-D3
gtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctcccgggcgggcngnctcatccggtccctctagcgcaccagcgccatcctcgtcgtctgagtcctccgccgcaccatgcccatcttctga

SEQ ID NO: 9374 - DNA, 429 bp, Zea mays
  unsure at all n locations
  Clone ID: LIB148-020-Q1-E1-D4
cgacaagatggcatgcacaaacaatgcgatgagagccttgttcctcctgatcctcttctgcatcgtgcatggtgagaatgaacagtcaaagggcatcgatgcgaaagcgtccgggcctggtgggtccttcgacatcaccaagttgggcgcctccggcaatggcaagacagacagcacgaaggctgtgcaagatgcatgggcatctgcgtgcggcagcactgggaatcagacaatcctcatacccaatggcgacttccttgtcggacaactcaacttcacaggcccttgcaatggcgacgtgaccatccaggtggatggcaatctgctggcgaccacggacctaagccagtacaatgatcatggtaattggatcgagattctacgcgtggataagctgntcatcaccggcaagggaaaccttgacgggca

SEQ ID NO: 9375 - DNA, 363 bp, Zea mays
  Clone ID: LIB148-020-Q1-E1-D5
gttctagatcgcgaggatccccccacaccttgagacctgcgttgtcacgcacccatcgaggttggggccgccagcaggttcagccgttcctgttcttgataaaacgacataaggatggcagtgtttcatggagctgtcctattcttgtttctcctcctcgtcgcagcataagtgggaaacagcgatgccagaatgggagtagccatgctcatgcatgccttgataatggagaacgcgaaacagcatgacacggataataacgaggagaacagcacggagaacgaatacagtcaatgcttatcgccgaatctccagttcgagggcttctgcttcaacagcgacagatgcgccgaggtgtgcatg

SEQ ID NO: 9376 - DNA, 294 bp, Zea mays
  Clone ID: LIB148-020-Q1-E1-D7
cccacgcgtcggacgatcttgccattaccagctcagcttcacatgtgcatcgtcttcgcagcacacacatgtttaatagtttcagggactgggattgctcgattaactcaactcatgctgacgagcatgtatgccccctgtggtactggttccacatgtgtgcaggagtgcttaacccgcttctaggcgatgcctacgagacctgcccgaagtgtcacagtcagcgtcattgattgatagtgagagcatctacagcacgctcgaagcttgatgacggtgattgttactgctcag

SEQ ID NO: 9377 - DNA, 420 bp, Zea mays
  Clone ID: LIB148-020-Q1-E1-D8
cccacgcgtccgcccaagacaaaacatggatgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaatgactggctggacgctaaagcgacatggtatggcatgccgacaggtgccggtcccgacgacaacggtggtggctgcgggtacaaggacgtgaacaagccccccttcaatagcatgggcgcatgcggcaacatccccatcttcaacgatggtctgggttgtgggtcctgcttcgagatcaagtgcgataatcctgtggagtgctcgggcaaccccgtggtggtgcacatcacggacatgaactatgagcctat

SEQ ID NO: 9378 - DNA, 198 bp, Zea mays
  Clone ID: LIB148-020-Q1-E1-E1
atttcttctttccattgctagagaaacgggttatcttttttttcccacatttataagcggcaatacatgcgtgcacctgtagtagtgtgaccatatgtactgtgctctcggtttgtatatcgatagtagcatataaagctactactcccgatttgtaactatagatctcggtattaaagccattttatttttattttt

SEQ ID NO: 9379 - DNA, 442 bp, Zea mays
  Clone ID: LIB148-020-Q1-E1-E12
gcataatccctaccgccatggccgcgggatacatggatatagctatttatttctatctactagaaaataaagtcatattttttcttaatttaatattggtcattgctaatcagaacacactattgccaggaacacagtagttattgttaaaatcagctgcactagatacaatttgaaaatatccagcaccaggttaattccaataacgaacccaatagattagttaatgctatgagaagactaaagagaaagagaaaagagacgcagacccaggcctggctccacatgctactaactaccagctctcagatgtgtcactgggaacaatacacactccatgcgttttgctacatctccagaagaggtaaggacttgagtccacacggggatgctcgcttgcaagtccttgaggcccacagcctggtgtgtttcacgcacagat

SEQ ID NO: 9380 - DNA, 199 bp, Zea mays
  Clone ID: LIB148-020-Q1-E1-E2
ccacgcgtccgcccacgcgtccgttttttttttttttttttttcttatattttttttcggttttttttttttttattgtttttttttttcccacgcgtccgcccacgcgtccgccgacgatggcgtcgaataagacagtcctcatcgtcgcggggatgcttctcatcaggctcgtgctggaggctgcccctccgggggg

SEQ ID NO: 9381 - DNA, 366 bp, Zea mays
  Clone ID: LIB148-020-Q1-E1-E3
cggacacgtgggcggacgcgtgggcgcgaggagagctcggagcggcgaggtacgggccgtcagatgctcgcagctgccagcgccgcctacggctattttaaccccgcgctcctgccgacgccgcactcgcccccggcctcctcccgcctcccagatctcgctcgctcggcgccagttgcctcgcagtttggatcatctcatacctcggcgaagatgagggagatcctgcacatccagggaaggcaatgtggcaaccagattggcgccaagttctgggaagtggtgtgcgatgaacatggcattgaccctaccgggcggtacactggcaattccgaccttcagttggagcgtgttaatgtccactac

SEQ ID NO: 9382 - DNA, 136 bp, Zea mays
  Clone ID: LIB148-020-Q1-E1-E4
agtgcctccagctaacgaggccctgacatgcatctgctgcattgctacacgttcgttcgtgttcacaactacgctttgttctttcgttcaaaatcaccgaccgcagcttgttcagctagtactttgttatttggcc

SEQ ID NO: 9383 - DNA, 423 bp, Zea mays
  unsure at all n locations
  Clone ID: LIB148-020-Q1-E1-C8
acccacgcgtccgcccacgcgtccgaatcaatcaagacacccttccaaatgcagatctcgagaagttgcagctccccacaatggaaggtctggctaaaaaactaaaaaagaactctgggagcaagatcgagtctgctattgttggtacgtacgtgctgtggaacagctaaccctttgtgtctgttgaaattctgaaacctgactgctatatgcttggcagcatatatcagtctgctattgttgcatgtcatccatcagaagcacctactatgactgccagctggtttaactccaagtcaggaaagaagattcctttgaaatcagtcacttcaatcgtcgatgggctaaagaaatcgtacattgagaagttgatgcccttggaaaaaacctatcagttccatgacttcgtgtctcncttgctga

SEQ ID NO: 9384 - DNA, 375 bp, Zea mays
  Clone ID: LIB148-020-Q1-E1-B12
gcatgatcccgaccgccatggccgcgggataccttactggtcgctgtgggtctgggcgggcctggagccaaaaggcgactactgttcctccccggagccattccaggtggggagggaggggggtttcagacttgtgttcctctccctcgtcctcctgtctccttaggctcagtagaagcggtggggaccctctaccagcttcctgagccctgcctgcagttggccacccagcactgattggggacaagggctgaactgctggccaccagccacacctaggaaggagctggggcctagaagctaggcagccttcggcctcaggggccgcttcgtgccctcccagctgggaggggtcgctgtttcgccttgtctgtc

SEQ ID NO: 9385 - DNA, 296 bp, Zea mays
  Clone ID: LIB148-020-Q1-E1-B2
cacacgcgtccggcgccatggcgacggcgctacgctggggagtagcatagtgctggtgatgatcgccgctagctccatcatcagctgctcctgcaccatcctcctggagctcccgagcgggtgaacatcacgagtaggggcatccatcgtcgcatgcgcatgatcttccttcgaagtcatcgccgccagcgccggcgcttttcactcggatgccggagcctaggtcggcacggatacggaagcgggcgtgggcaccaactgcatggtctgctgaacgacgttactcgtgaccgtgg

SEQ ID NO: 9386 - DNA, 323 bp, Zea mays
  Clone ID: LIB148-020-Q1-E1-B3
cccacacgtccggccgtacaaggactacaaggagtgggtgtggaagtcgcagggcgacgtcatgatgaacggcgccttcttcaacgagtccggcggccacaacgagcgcaagtacgacaggttcgacttcatcccggccaagcacggccgctacgtcggtcagctcacgcgcttcgccggaccactcaagtgcatcgtcggccagccgtgctagtagacagcggcccggtcgggcacatactcctcttcctatatacatcggatttggatgggcggcatatatgtacgtgtgtgtaatatattattactacatcttgtactat

SEQ ID NO: 9387 - DNA, 395 bp, Zea mays
  Clone ID: LIB148-020-Q1-E1-B4
aggccctggggctgggaacgcgcgcgcaggcattccgccggccttcaggaacggcggcggcgacggcgggtacaggcccgacttcggcgacggcaaccagtacacgccgcccaaacggaagtgggccttctgtggctgctgaatcgaagctcgctgtgctgctgtgctgactcgaaaggagaacggatcgtgcagcagctcaagtgatccaggatgatgggagcgccgagacacgatggaaggcattaattatttcagccatggtgtttcgccttgctttaaccttttgctcatctctaccgaggaacactagttccatcgggtaactgaacctgcaaatcttcatgatgaaactgtcgcatcaattggttccaaaaaaaaaaaaaaagggcggc

SEQ ID NO: 9388 - DNA, 428 bp, Zea mays
  Clone ID: LIB148-020-Q1-E1-B6
ctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaacgtggcctgcgagacctgcaccaagaccaacatggtgatggtgttcggcgagatcacgaccaacgcgaccgtggactacgagaagatcgtgcgcgacacctgccgcgagatcgggttcacctccgacgacgtgggcctcgacaccgaccgctgcaaagtgctggtgaacatcgagcagcattcccccgacatcgcgcatggcgtgcacgggcacttcacgaagcggcccgaggagatcggc

SEQ ID NO: 9389 - DNA, 334 bp, Zea mays
  Clone ID: LIB148-020-Q1-E1-B7
gacccactagtgcttgagacctgcgttgtcaaccacccatcaaggttggggccgccagcaggttcagccgttcgtgttcatgctaaaacgagagaaggattgcattgtctcagggagctgtcataatcttgtttctcatcttcgcaacacaggtgggaaccatcgatgccaacatgagagtagccatgccgatgcatgccataataatggagaaagcgaaatatcatgagactgagaataaagacgagaaaagcacagagaaagaagagagtcaatgcttatcgacgactctccagttatagggtttctgcttcaacagctacagatgcaccga

SEQ ID NO: 9390 - DNA, 277 bp, Zea mays
  Clone ID: LIB148-020-Q1-E1-B8
accagatgtcgattgagacccgccttgacaagcaatcatatacgtttgggccgcaaacacgtctcagcttacgatgatcttgctcaaacaatacaatgagccattgtcacacgaagctgtcataatcgtgagtctcctcatcacagcacacgtcgtaagcagacgatcaagcatgggagtactgcagctcatacatgcctttgtatcagacaaagttactgattatgagaccgagtcgacggacgataccaccactattaaagaagagactcaatgc

SEQ ID NO: 9391 - DNA, 460 bp, Zea mays
  Clone ID: LIB148-020-Q1-E1-C10
gcatgatcccgaccgccatggccgcgggataccaaaagaccttcctcctgatactgcgctgctggacctgcaaaacaacaaaataactgagatcaaagatggagactttaagaacctgaagaaccttcatacactgattctcatcaacaacaaaattagcaaaatcagccctggggcatttgctcctttggtgaaattggaacgactttatctttccaagaatcaactgaaggaattgccagagaaaatgcccaaaactcttcaggagctgcgtgtccatgagaacgagatcaccaaagtgcgaaagtctgtgttcaatggattgaaccagatgatcgtcgtagaacttggcaccaacccgctgaagagctcaggcattgaaaatggagcctttcagggaatgaagaagctctcctacatccgcattgctgacacaaatataactaccatccctcaaggt

SEQ ID NO: 9392 - DNA, 428 bp, Zea mays
  unsure at all n locations
  Clone ID: LIB148-020-Q1-E1-C2
gcacaacgatgcaccagcacgagatactagccatcatgcgcctgtcgtcnctcctcctcgtcgtggccgccctctcggcgcgcgccgcggcgcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagattaaccactcgctccccggggacgccttcgacgccgtggtgcgcgccaagctggccctggagctggagtgccccggggtggtgtcctgcgccgacatcctcgcg

SEQ ID NO: 9393 - DNA, 358 bp, Zea mays
  unsure at all n locations
  Clone ID: LIB148-020-Q1-E1-C3
cctcgaagccgaaggcctcgtgccttctcttcctccccgggcatgngaggaagtagctgtttccccctatgatcgttgccgccgtantgctggacaacaatggcgctgacgcggtctcctgcactgccatccctagcgtaacaataagcctagaggagaaagaaaatatcaatggggatgttcccacgatcacctcggccgcaagcaacgatgaagatgcgttgttcagtgtcggagaatccaccaaggacgatggccatcgcttgacgatggaatgctccactctcgtctcctccagtagcccttccactcgcaagaagcgcggggcgttcagcctcttcaaggcgatgttcctgtc

SEQ ID NO: 9394 - DNA, 347 bp, Zea mays
  Clone ID: LIB148-020-Q1-E1-C4
agccggggccgttcggcgggaagcatgggacgcacgggcaggcagcaaggacggctcaacccaacgggggttcccgtccttacggaacatggacagctatgcgatgtgggtggcgaccggcgtggcctcggccttcatcgcgtccctcgagcgctgctcctgcatccacctccacaccgcggaggacgacggctaaccaggaagaggacgacctccaagaggcccgccgctccttctcacgcccgatcctgagtactactacgaccggtccggctcctccgcctccgtcgccaagatgtgacctgaccgaaccgcgcctctctccgcccaagaaatgcgtggtgata

SEQ ID NO: 9395 - DNA, 351 bp, Zea mays
  Clone ID: LIB148-020-Q1-E1-C5
cggacgcgtgggcgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacgga

SEQ ID NO: 9396 - DNA, 342 bp, Zea mays
  Clone ID: LIB148-020-Q1-E1-C6
cccacgcgtccgtccatgtcgtgactgcatgtgccgcttgaacagaacagagcactctaaatccaaacacagtagatagtatctcatagttgcatttccagactaaccctattctttctgacatccactttagtctgttcatgcctcagttgctgtgcggcttttcacttcatcagcagtcatagtcgccagttgcgacagcattgagagcaacctattctccgtatataacggtttttccatgtatagcatatgccagaagaagcccaaattcgtccgtggagtactgaagcaattgtgatgctaagtatacatcatctgagtatgattctcaacaaccga

SEQ ID NO: 9397 - DNA, 228 bp, Zea mays
  Clone ID: LIB148-020-Q1-E1-C7
agctcaagcgtcagtccattacgcgggtggaagcagacgcttgagagacatagcgaatacgaagcgtgtacgacggtacagaggctcgcatgctggtagtcctgtaggaactcgagacgttctgacaggcagatgactcgttgcagtcctgcgattctaaggtgacttacaggacaagatcactgatgggcgtgacttacaaggtcatcctcagcaacggcgacttcg

SEQ ID NO: 9398 - DNA, 396 bp, Zea mays
  Clone ID: LIB148-020-Q1-E1-B10
gcatgatccctaccgccatgggcgcgggataccgcgtgatcagcgccctgcccatccagcaccaggactggactggaggaaaggagttcaagtgcaaggtcaacaacaaaggcctctcggcccccatcgtgaggatcatctccaggagcaaagggccggcccgggagccgcaggtgtatgtcctggacccacccaaggaagagctcagcaaaagcacgctcagcgtcacctgcatggtcaccggcttctacccagaagatgtagccgtggagtggcagagaaaccggcagactgagtcggaggacaagtacatttctaatttgtaacatacaaccatagtctgcaaaactattctgtgtatcactgacgcacatcccaaactgtttagttccagtc

SEQ ID NO: 9399 - DNA, 276 bp, Zea mays
  Clone ID: LIB148-019-Q1-E1-H12
tctacagtgacgattcctgacacacacggatgaagatcgcagtgggtgcagctagaggcatcgagtacttgcacgaggtaaccaacccgccagtgatctaccgcgatctcaagggatccaacatcctcttgggcgcaagcttcaacgcgaagctgtcagacttctgtctgggcaagcttggtccgagccgcgacagaacccatgtcatcacaaaggggattgggacctactggtactgcgctccagaattagccatgactgggaagctgaccaaga

SEQ ID NO: 9400 - DNA, 374 bp, Zea mays
  Clone ID: LIB148-019-Q1-E1-H4
actggaatgggatccactaaccacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctccacgaggccttcgggctcctcgacgccgccgcgcgcggcgacgtcgacgccttctgcgcgcgcctcga

SEQ ID NO: 9401 - DNA, 387 bp, Zea mays
  Clone ID: LIB148-019-Q1-E1-H5
ctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaagatttctcaagggaagaaagt

SEQ ID NO: 9402 - DNA, 409 bp, Zea mays
  unsure at all n locations
  Clone ID: LIB148-019-Q1-E1-H6
cactgacgagaactgccagaagagcaagatcttctttatctcttgggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcanaagccctgcattctgtatgagactgtatgccattttcaatctttttctctccccatatctctgccctagtcccgctacggctg

SEQ ID NO: 9403 - DNA, 387 bp, Zea mays
  Clone ID: LIB148-019-Q1-E1-H7
acccacgcgtccggcagtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgcca

SEQ ID NO: 9404 - DNA, 333 bp, Zea mays
  unsure at all n locations
  Clone ID: LIB148-020-Q1-E1-A1
agttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtcnccatcttcaaggacggcaagggctgtggctcatgctacgaggtgagatgcaaggaaaaacctg

SEQ ID NO: 9405 - DNA, 455 bp, Zea mays
  Clone ID: LIB148-020-Q1-E1-A10
catgatcccgaccgccatgggcccgggatacaagcatactgggttaccagatgagggattccttttgttcccacaaatatctttcttactttgcacaatttatacttggcctcctcaggtgtaatacgatgaacagcaaagcgacccttggtgtcatagatcaaacgaaagttctctccagtcttatcaatgctgatgacatccataaaaccagcagggtaggttatatctgtgcggactttgccatcgatcttaatgaaacgctgcatgcaaatcttctttacttcatctccagttagggcatacttaagtctattccttaggaaaatgattagggggagacactcccttagcttgtgggggccggtagatggacgaggggcaaacacgccggtcagtttatccagcatccaatgttttggacctgctactcgtctcaggtacaaaatggcatc

SEQ ID NO: 9406 - DNA, 420 bp, Zea mays
  Clone ID: LIB148-020-Q1-E1-A12
gccatgggcgcgggatactttaaccatggcaggctggtgatgaacttgaccccagtgtgttttatagaagctctgcgaccttgtcatgtgacatgtggaagcagtctgaactgttgcagtccatcagcttagctcatttcaggtgagccagcagccataccttggtccccctgagaaggtcagtcagagactttgggtcaaagttcctacccttctgaacattctttttctcccaaggacattcacaaatagctacttgaatgtatgatcatgttcacccagtccaggcagaaatggggacgccgttggcagggagtattctgactccctttccgtggctgcaagtggtctccagaaataaagggcatggcctggacagcgttcaatcaactcctgggggcaaaggacaaactgccccaa

SEQ ID NO: 9407 - DNA, 351 bp, Zea mays
  unsure at all n locations
  Clone ID: LIB148-020-Q1-E1-A2
cggacgcgtgggcggacgcgtgggcgcgagggccgccctttttttttttttttgcgcatgtatgtgcgtaggcagcctatatacatgttacatgtatgtataatacaactatatatacatgaagccttgaactacagtgtaccatgcaggaagtagaatgctatgatatgaggcatcctgtttccaaacatataaaaggaggatgaggaggacgaaactgaggctacttacacgtacgtacctacagcacacgcgcaaatcacattcacgaatcacgaatcgagctgagaacggcatttaatttgcttcntctcgatcgattcgacccctcgtttccatgcgcgcgctcga

SEQ ID NO: 9408 - DNA, 277 bp, Zea mays
  Clone ID: LIB148-020-Q1-E1-A4
ccaaggccgatcattttttttgactttgtgcatgtatatccgttcgcagcctatacacatgttacatctaagtttactacaggtagggatatatgaatccttgaaatacaatgtaccatacctcaagtagaatgccatgatatcaggcatcctgtttccacgcatataacatgaggattacgtggacgattctgatgctacatacacatacgtagctacacaagacgggctaatcaaattcacccatcatcaatcaacctaagaacggcatttcatt

SEQ ID NO: 9409 - DNA, 446 bp, Zea mays
  Clone ID: LIB148-020-Q1-E1-A5
cccaaacgtccgcttcaccgagccccagatcaagtgctacatgcgacagctgctggaggggctggcgcactgccatgcgcgcggggtgatgcaccgggacatcaagtgcgccaacctgctggtgaacaacagcggcgagctcaaggtggcggacttcgggctggcgaacctcttcgcgccggcgccggcggcgccgctcaccagccgggtggtcacgctctggtaccgcccgccggagctgctcctgggcgccacggcgtacgagccctccgtcgacctctggagcgccggctgcgtcttcgcggagatgcacgcgcgccggcccgtcctgcagggccgcaccgaggtcgagcagatcaaaagatcttcaagccccggtggcccaccgcccaaggacttctggggccgcttggggctctcccacggcgccgtcttccgcccgcagc

SEQ ID NO: 9410 - DNA, 202 bp, Zea mays
  Clone ID: LIB148-020-Q1-E1-A6
acggacgcgtgcggggagttagcgattagaaatatcgcatgaggtcagtagagccagaagaatgcgcaggcagaagatagaatcgggtaaagatatgagtaaatggacgaagggcaaggtgacgagcttttagagcaggtgaatcataccttgcttgacagatgtctcgagcaggaatcatagatcatggtagactacgaga

SEQ ID NO: 9411 - DNA, 354 bp, Zea mays
  Clone ID: LIB148-020-Q1-E1-A7
cggacgcgtggggccggccggggatcagcgacgtcgtctcggcgctctcgttcctcgccgatccgcaatactaccctccccaaggcacgggagccgagcagaaggccacagccacaggtcgagagagtaaacccaaggaggatactacagacaaggatagcagtcctcataaggccgaaatgatcagggcagacgacgaaacgaagcatagatgatgaccgtagggggaagctaaccacgggaaagggaggaacactgcagagctgtctgtctgctctcttgaatcttctttttgtaaagcgtacaccacgtaggcaggatgtaacaacaacattcaaggagttatcttgactg

SEQ ID NO: 9412 - DNA, 359 bp, Zea mays
  unsure at all n locations
  Clone ID: LIB148-020-Q1-E1-B1
gaccggacaaccaaagaatcaaaaccttcatgtgtctcaaagccgacgtagtagcatgagaatttctaatttttccatgaaaagaggcccttcaatggccatgagagctccttcagtagctatcagagctccttcaatatctctgagaggtccttcaatgtcttcaagagcatcttctgtgtctgtaaaggaagaccaaatttccccaaagaaatcagacgaggaaacggaatcagtgttggtgaagctgagcgcccgtcagatcacacttttgctatcatccatttgggctcaagcaacatcncctgaaaatactcctgtgaactatgaagccattgctcatacttacagtttgcttc

SEQ ID NO: 9413 - DNA, 365 bp, Zea mays
  Clone ID: LIB148-019-Q1-E1-H11
cgacaaagctacaatcttgagctttgaggctttcaccaggcaatgtgggtgctgcggcgatctggtcgaggacgaggagaggcgtgagcacctagaggccgcctgtgaccttgcaacccactacctctgccacccctgcgccctctgccaggagggtcgcgagctgcgccgcagggttccccaccctggattcaacaatgggcactccgtctttgtcatgatgccgcccatggagcagaccatggggcgtggcatgtgagctattccaccaccttccctgccctagttttatctgtgcttcccgtggtttatcatctgctgctgttggccttgatgtgtgatgtgtcctttgttcgtcagtaaat

SEQ ID NO: 9414 - DNA, 404 bp, Zea mays
  Clone ID: LIB148-019-Q1-E1-F7
agtggaattcgacgacgaaactccgtcacgtcattcctctgcgcctcccgtctggccgtcttccagacgtctccaatcggagctcccagcgtctcggagaagaggagcagcacggcacggcggctgtggcgaggaaggctcctgtcctgtcccatcccaatccagcagccgtccaaggaggaggagatccaatcggcgtgcaggcgtccaccgtccatccatcgatccaattccaatctgcaggcctctgcgtcgcggcttgttcgtggaggagaggttgctgtggaacccgccgccagttagccatgtcgtcctccgtgctgagggctgcggccgacagggctattcgcaagcaggccctcacgctgaccgacgccgcggcgtccaggattcggcagctcctc

SEQ ID NO: 9415 - DNA, 405 bp, Zea mays
  Clone ID: LIB148-019-Q1-E1-F8
aggcccccgggaagcccatgcccaagaccatcaagttgaccaaccccgtgggcttccggtgccccgcccccaaccacaaagacagcgtgatgtacgtgtgctgcgtcaaggaccgcaagttcaaggcgaagaaggctaacagcacgcggtaccagacacggcggaaagcggacctgacgttcgcctacgacgtgctgcaggccaacaccaacaactaccaggtgcaggtgaccatcgacaactggagccccatcagccggctggacaactggaacctcacctgggagtggaagcgcggcgagttcatctacagcatgaagggcgcctacacgctgctcaaggaaggccccgcctgcatctacagccccgcagcgggctactacaaggacatggaactcaaccccg

SEQ ID NO: 9416 - DNA, 401 bp, Zea mays
  Clone ID: LIB148-019-Q1-E1-F9
ttcacggggccacgcacgcgtccgcatcaggcttggttacaatagcttgggtgcgtttgccaccatcaatcacctccactttcaggcgtactacttgtcagtgcctttccctgttgagaaggcagctacccacaagatcccactctctgaggacacgaagaagaatggggtgaccgtgtccaagctgataaattatcctgtgagaggcctggtatttgagggagggaacaccctggacgacctggccactgtggtttctaatgcttgcatttggctgcaagacaacaatgtgccttacaatgtgctcatttctgactgtggcaagagggttttcctgttcccccagtgctacgcagagaagcaggctctgggtgaagtgagccaggagctgctggacactc

SEQ ID NO: 9417 - DNA, 236 bp, Zea mays
  Clone ID: LIB148-019-Q1-E1-G1
ttgagtcgtattagactcctctctacggtcatcatggtcgtgggtgtcgtccttgtagcgctcgtccacggcgggtcatgcggggcccccagggtgtcgcccggtcccaacagcagtaccagctacaatctggaaatggttcatcgggaccgccacctgctacggtcagcccaacggtgccggcgctcctgacaccggcggtgcgtgctgtctcaagaacgtcaacctgtcaccct

SEQ ID NO: 9418 - DNA, 380 bp, Zea mays
  Clone ID: LIB148-019-Q1-E1-G10
gaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatctgcgaagtgtttgtgccc

SEQ ID NO: 9419 - DNA, 335 bp, Zea mays
  Clone ID: LIB148-019-Q1-E1-G11
acaacaccctataatgacgtcgtactaccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaagaggaggaagccgtggagaagaccgtcgt

SEQ ID NO: 9420 - DNA, 341 bp, Zea mays
  Clone ID: LIB148-019-Q1-E1-G12
cagacgcacgggtcaacccgggcgtccgggacgggcacggagacgtggtgtggagcaagaaatagtgccagcattcatacaattgcaagatcctcccgaatagcttggtgctggattttgtgacgaacgtccagatccgcggcatcacggctgctcaacagcaagttcttccacctcaacatcgtcgagtgcaagaacgtgctgatcgacaaagtgaccgtcaaggcccccggggatagacccaacacggacgggatccacatcgggcgctccagcaacgtgaccatgagcagcaccaccatccggcgtccgagaagaatgcatctccatcgggcgccggg

SEQ ID NO: 9421 - DNA, 389 bp, Zea mays
  Clone ID: LIB148-019-Q1-E1-G2
cgtccggtcctatctccatcggccatctctggcgcatgatcgaaccgcacgaccgaggcagcaagtgagtctcagacaccaccatgcaggcgatgcgtccggccgcggagggggaggcacaggagcaggcggtgagggcggaggcggacgaggtgaagagggaggtggcgaaggcgcacgacgaggaggaggcggtgcctgaggagaaagacgtggcggttgtaggggaggaggtggaggcggaggcggagacggagacagagactgaaggcgaggcggaggcagaggtcgaggccgaggtggaggtcgaggtggaggcggaggccggtgcatcgtctgcgaagaagaaccgtatccaggtgtccaccaacaagaagccgctctatttc

SEQ ID NO: 9422 - DNA, 405 bp, Zea mays
  Clone ID: LIB148-019-Q1-E1-G4
gggccgcgtccagcgagatccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcaaaagccctgcattctgtatgagactgtatgccattttccatctttttctctccccatatctctgccctagtcctgctaccgctgtagactagaacttatttggtgtttgatctcgtggcattgtcgagtcttttatgtgtctatgcaatgcta

SEQ ID NO: 9423 - DNA, 391 bp, Zea mays
  Clone ID: LIB148-019-Q1-E1-G5
acgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaac

SEQ ID NO: 9424 - DNA, 394 bp, Zea mays
  Clone ID: LIB148-019-Q1-E1-G6
atgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgaccacaccaacatcaccgcggcgctggaggatatcccggtgagcaacaccaagcgcgtgatcctggatctcaagcccggcgctcagttccgcgagaagctgttcct

SEQ ID NO: 9425 - DNA, 395 bp, Zea mays
  Clone ID: LIB148-019-Q1-E1-G7
aataacccggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtg

SEQ ID NO: 9426 - DNA, 391 bp, Zea mays
  Clone ID: LIB148-019-Q1-E1-G8
agcgccatcgtcggcgggcccgacaagaacgacggcttcgtggacaagcgcggcaactcctcctacaccgagccctgcacctacatcaactccctcgccatcggcccgctcgccgcgctcgccgtccgaggcgtgcagctcgtcgccacgcagtgatctatccccatgcgtgcgtgtgtgtcccgctgtttcgtttcttccctgacatgatatgatttctactccgttactgatgattcattgattccggccgcccccgcattgttcattatattaggtgacgtctgcgggcgcgtgcggggatccatccaaatctctcactcgctattgtttctgtacgtacgtacgtgtacgtccaagattataatgatactcataataatctcgtcgc

SEQ ID NO: 9427 - DNA, 357 bp, Zea mays
  Clone ID: LIB148-019-Q1-E1-G9
catactacggcggcggcggcggcggtcttggtggcgcctacggaggcggtggctccgagtacggccacgagggccgaccgcaccacggcggcggcggatcccagtacggccacgagacacgcccgcaccacggcggcgggggcggcgccccgcctgtgaggcagcagacgtacaggatctactgcaaggctggggaggaccagtacagcctcgcctcccgcgacggcaaggtctgcctcgtgcgcacggaccgtgatgacgacgcgcagcactggatcaaggacatgaagtacagcaccagggtgaaggatgaggaaggctaccctgccatcgtcctcgtcaacaaagccactggag

SEQ ID NO: 9428 - DNA, 390 bp, Zea mays
  Clone ID: LIB148-019-Q1-E1-H1
cgaggttccccaaacacgcacagcacacgaacacacaccgcgcccagctccgaggtgatcttccggcggccggcgagatgagccgtggcacaggcgcgggctatgaccgccacatcaccatcttctccccggagggacgcctgtaccaagtcgagtacgcgttcaaggcggtgaagtcggcgggtgtcacgtcgatcggcgtccgcggcgcggactccgtctgcgttgttacgcagaagaaagtcccggataagttgctggatcagacgagcgtgacacacctgttcccgatcaccaagtacgtcggattgcttgccactggccttacagctgatgctaggtcattggtttcccaagcaaggaacgaagcagctgagtttcgtttcaaat

SEQ ID NO: 9429 - DNA, 387 bp, Zea mays
  Clone ID: LIB148-019-Q1-E1-H10
acgcgtccgcatcgagccccacccgacgcgacgattcctctcctccgcccgttcccaccgatctcacgctctctctctcttcctccgtcgcgtcgggtcggcgtcgccatcgccggccatgggttgcggtggctccaaggaggccgtggccaccggcaacaccagcgccggcagcaaggtcctccggaggaagccctcctccgtctccaccggcgcaagccacacatccaccacgtcgccgtcgtcctccggcgtcgtcgtcaaggacgtcgtgaaggatgcggcggcggccggcgaggtgatgacgcccgccgacgccgagaagcctatctctgtcgaccccaagggagacgccatcgtggtgatgggcgccaagaaagaaggggg

SEQ ID NO: 9430 - DNA, 379 bp, Zea mays
  Clone ID: LIB148-019-Q1-E1-F6
aacatgaaccacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatgggaatccaggacaagttgtcggctgactggaagcccatggagctcccttggggcgccatctggaggatggacactgccaaggcgctcacgggccccttcgtccatccgcctcaccagcgaatccggcaag

SEQ ID NO: 9431 - DNA, 396 bp, Zea mays
  Clone ID: LIB148-019-Q1-E1-E10
gaaagcaggaagaggaagaagaagctctaagacaactgaggaagaacttggtcgtccgagcgaaacccgtgccgagcttctaccaagaacccccaccaaaggttgaacttaagaaggtgcctccaactcgtgccaagtcaccaaagctgacgcggaggaagagctgcagcgacacccctcacacaccagagggaggaaacggcggcggcgcagtgtgctgccggctgcaccgccacagcgtcgggaactccaaagacatcggcggcaaggcacaatgctctccaaagactggaccagctgctaagtccagggcgcccccaaatccagggaagacccgagggcttccatgagaagaaagcgggacagcagccaagcgccgccgctgtacaaacctga

SEQ ID NO: 9432 - DNA, 406 bp, Zea mays
  Clone ID: LIB148-019-Q1-E1-E11
cacgcagctagcccacgtaaattgcaccgagacacagacacaggtaacaaaggcaacagccatggcgggaacccgtgccctgtacctcctcgtcgcggctgtcgcggcgctcttagccacgcctgcggccgtggacgcggccacgctggcggagatctgcaggggaaccgcgttccccgacatctgcaccagcacggtggggagcgaagcgcagagcgccggggtgttggacgccatggcggtgttgcggatgcaggtggacgcgttcaacaagcgcaccgaggcggcgagggcgcacgtcaaggaggccgccgtgacggcgtcccccaaggcgcggacggtgctggacctgtgcaacaacctgtacctggacgtggaggacaacctgggagcctgccgccgcgcc

SEQ ID NO: 9433 - DNA, 402 bp, Zea mays
  Clone ID: LIB148-019-Q1-E1-E12
tacaagactctatacagacgtcgtagtatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaaaggaaaccttgacgggcaaggccca

SEQ ID NO: 9434 - DNA, 381 bp, Zea mays
  Clone ID: LIB148-019-Q1-E1-E2
agctcctaccccacccgccacccgtcgacgccggcctctctcctcaaccgctcggagagtcggagcccggcggccggagggcgacgtcgtccctaataaatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccg

SEQ ID NO: 9435 - DNA, 398 bp, Zea mays
  Clone ID: LIB148-019-Q1-E1-E3
atatcaatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgttca

SEQ ID NO: 9436 - DNA, 380 bp, Zea mays
  Clone ID: LIB148-019-Q1-E1-E4
agccggagtcgtcggtggtcggaaaaatggggcaacaacgcacgttggggtaaaccttctggcgcgaggcaccatcgtcctagcggacaatgctgaggtctccggcaactttgcctccgttgctgcacaatgcctacagaaactccccgccaacaacaatcgcttcaactacaattgtgatgggcacacattcaactaccacatttatgatggattcacgtactgcgtcgttgctaccgagtcagctggtcgccagcttccagttggatttattgagagagtcaaagaagatttttccaagaaatatagcggagggaaagccaaaaatgctagtgccaatggcctcaagcgagaatacgggcctaaactcaaggagcaca

SEQ ID NO: 9437 - DNA, 404 bp, Zea mays
  Clone ID: LIB148-019-Q1-E1-E6
aggcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaacagcag

SEQ ID NO: 9438 - DNA, 403 bp, Zea mays
  Clone ID: LIB148-019-Q1-E1-E7
atactcactcaatctccgatgcatacaagaagcctagcggtcctcaagaggcagttgcttcgcaagaagatggtccaaactgccaaggagggcatgatgaataatgctaccagttccgaagtttatgtcaaaatgcaatatgttttcataaaaatggaccacggaggcgacactatttctgctcacaaagaactgaaagacctgaaggatgcaattattccagaagggaatggatcaggaacagtgcctgaagtatttgatcctgaaaagcatgtagatgcttacttgcctgtccgggtgaatgagcagagagtaagcaatctgttgcagtcactgttgattgctggttgtattggagttacaccgctcattcagaagataccaacatcagtcctctggggtt

SEQ ID NO: 9439 - DNA, 399 bp, Zea mays
  Clone ID: LIB148-019-Q1-E1-E8
tatagtgaggcctactactctaatttgatgggcattccgtttccttctcaacttcaacgccaacaacagttgatgctactatggttggaaatcgggcatggttcggagggcttttcagcggctcaggcaaaaggcgacaagtcagtgcagagaagatagtgcttgatctaacccctgtacaggaacagagactgcaaagtctgaaggaaaggctaaatgtaccttacgacgaaactcggacggatcatcaagattcgcttagggctctatggaatgcctcctttcccgatacagagctcactatcttagtttcggaacagtggaaagacatggggtggcagggcgtcaacccagcaactgatttcaggggctgtggatttgtttcgcttgaaaaccctt

SEQ ID NO: 9440 - DNA, 384 bp, Zea mays
  Clone ID: LIB148-019-Q1-E1-E9
agaattccgtctcttgtccctgtcgtcctcgcccggtttccccggtttttgagaggggaaagaggaggcggaggagagggatggggagggacgagaggttcccggtgtgggaggccgcgctcggcgccggaatcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctgtttgggcaactgc

SEQ ID NO: 9441 - DNA, 327 bp, Zea mays
  Clone ID: LIB148-019-Q1-E1-F1
ttcgtaaacagatcgattcgcatgcgggtggtcagcgtctcactatccaccaccgcgccgctccggtttaatttctcctcgaccggccagcgcaattctgtggctcgatagatcggtcggtcataaggcaaggtgagcaagctagagatatatataggagattcttcgagcgaactactagcgagatgggttccgccgtcctcttttactgcatctgcatcaccgtcgtcgtcgcattgtcgtcgtccatggtcgccgtcggggacgccgccccgggggaaacccccaagttcatcccggcgagcgcccttgagtgctccgctaacg

SEQ ID NO: 9442 - DNA, 403 bp, Zea mays
  Clone ID: LIB148-019-Q1-E1-F10
ttcacgggtgcacgcacgcgtccgcacgtctcaccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccgggacctacacg

SEQ ID NO: 9443 - DNA, 373 bp, Zea mays
  Clone ID: LIB148-019-Q1-E1-F11
gacgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggacgcatcaccgtgaagaagacagggc

SEQ ID NO: 9444 - DNA, 334 bp, Zea mays
  unsure at all n locations
  Clone ID: LIB148-019-Q1-E1-F3
ccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctanggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccat

SEQ ID NO: 9445 - DNA, 400 bp, Zea mays
  Clone ID: LIB148-019-Q1-E1-F4
gggtcgaggacgcgtccgatttttcaagcttttctctaacggaatgaaaaaaccggttaaaaaacatgcaaccctaaaaattacggacccaaaggaaacggccctcagggacctttaaaccttaaggtatagtggaaagtttggaactactgagcccactcttctgctggatatcttgatggctgccgacaaatttgaggttgtttcatgcatgaggtactgcagccagttgctcacaagcttgccgatgaccacagaatctgcacttctctacctagatctcccttgctcaatttcaatggcagcagcagttcaacctctgacagatgcagctaaggatttccttgctgtaaaatacaaggatttgactaagttccaagatgaagtgatgaacattcct

SEQ ID NO: 9446 - DNA, 397 bp, Zea mays
  Clone ID: LIB148-019-Q1-E1-F5
aacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacg

SEQ ID NO: 9447 - DNA, 403 bp, Zea mays
  Clone ID: LIB148-019-Q1-E1-E1
ggtcgagcccgcgtccggagatactggacgtcgcaaaatcacctcgttccgtcagcagcggaaaccaaagtcaggattccgttatgcttcgcgggagagagaagtcgtgattacagtcgagcatggagccacgggcattcccccacccaaccgcggcatctgccagtctgcgacactgccgccccagcagtggggcaaacactgtcgtcggcgccttggagctttggattggctgggcgcgcgaccggcctctgtctccaggctgcgaggcagcagcaacctccttcgctggctgatgaccgtcttcgccgcggatccaactcccaacgtggtcggcttgcttcccgtcgtcaccattgtgaggtcacgaggatttgaagaatcaccctggtaactgggatct

SEQ ID NO: 9448 - DNA, 225 bp, Zea mays
  Clone ID: LIB148-019-Q1-E1-C12
cagaatcactgatacatcatatatacatgcatgcatgggatgcgatgacgatttgatgcatgcatgcatgggtatacctaccaatttgatgaccgacgatgtatagtttcgtcgactgcttcatacacatatatagcagcccaattaatgtaacgtcacgcaaataagcatttgcggtaattttttgtctcgttgattcgatgaataaagggcatgcttgagagt

SEQ ID NO: 9449 - DNA, 375 bp, Zea mays
  Clone ID: LIB148-019-Q1-E1-C2
agaaacaatgacgggcagggccaacccttttggagcaaaaattccggcacaaaaaattacaacggcaaattccttccaaactccccgggtgatggacttcgtaaaaaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtccgtgacgactgcatctccatcggccccgggacctccaaggtgaacatcaccggcgtgacctgcggccctggccacggcatcagcat

SEQ ID NO: 9450 - DNA, 397 bp, Zea mays
  Clone ID: LIB148-019-Q1-E1-C3
gtccagcaccaggactttgctcgcataccctctccatccttgtgaatgattgtcctggtgttctcaacattgtaacaggagtctttgctcgcaggggctacaatatacagagccttgctgttggctcagctgagaaggaaggcatttcacgtattacaacagttgttcctggtactgttgaatccattgggaagttagttcagcagctttacaagcttattgatgtgcatgaagttcatgacattacccactcaccttttgctgaaagggagctgatgcttattaaagtttctgtaaacactgctgctcggagggaaattctagatattgctgaaatcttccgagcaaaacctattgacgtttctgaccatacagtaacccttcagcttactggaga

SEQ ID NO: 9451 - DNA, 408 bp, Zea mays
  Clone ID: LIB148-019-Q1-E1-C4
ctccgacccccaaccatggatgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccattcggagcagttgtcgtctgtaatgacgaagtagtagtcagctgccataacatggttctgaagcacactgaccctactgcgcatgctgaagtaactgcaattagagaggcttgcaaaaagcttgggaaaattgagctctcagactgcgaaatttacgcgtcctgcgagccatgcccaatgtgctttggtgcagttcatctctcccgaatcaagaggctggtttaagggggcaaa

SEQ ID NO: 9452 - DNA, 408 bp, Zea mays
  Clone ID: LIB148-019-Q1-E1-C5
atcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcg

SEQ ID NO: 9453 - DNA, 389 bp, Zea mays
  Clone ID: LIB148-019-Q1-E1-C6
acggacgcgtggggcgaccatggtcggcttgtctgaccagaccgtggacaccgcgaccagcagcctgcagaccatgtacaggctcaacgtcggcggctcttacattgccccgaccaacgactctgggctgtcgcgggactggtacgacgacaccccgtacctctacggagctgcggtcggcgtcacgtacaaacctgatgacaatgcccagatcaagttcccgagccctgaggcagagtacgcggcgccggccagcctctacctcagcagcaggtccatgggccctaacccaaaggtgaaccagaactacaacctgacgtgggtgttcgaggtggacagcaacttcacctacgttgtccgcctccacttctgcgagctgctgcttacca

SEQ ID NO: 9454 - DNA, 309 bp, Zea mays
  Clone ID: LIB148-019-Q1-E1-C9
ggtccacgcacgcgtccgaggacgagtgggcggcaaggtcgtggggctgccgctgccgccgtcctacgcccccgcgcgctaagacgacgaaggcctcgttttctcctcgtggtctgaccatccaatccaaactcaaaagaacaaatacgaaagaaacgtagtgaaggggaacaaatgaatgggtatatgtaatcttgagatgcatgccctctcaaaacactgtactggggttctcaaaaaaaacattgtgatgggagttatatatataactttatctcaccatttatttacaccaacaagtcattgggt

SEQ ID NO: 9455 - DNA, 388 bp, Zea mays
  Clone ID: LIB148-019-Q1-E1-D1
ccgacacaccatggacgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggc

SEQ ID NO: 9456 - DNA, 382 bp, Zea mays
  Clone ID: LIB148-019-Q1-E1-D10
acgcgtccgaacaccatcgccttcaaccacttcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtccgtgtggaagaactgggtgtggcactccgagaacgacctcttcatggagggcgcctacttcaccgtcaccggcggccagatcaacagacagttcaacaagaaggacctcatcaagcccaggaacgggtcctacgtcaccaagctcacgcgct

SEQ ID NO: 9457 - DNA, 385 bp, Zea mays
  Clone ID: LIB148-019-Q1-E1-D12
cacggggccatacacgcctctacaatgactcgctatagctatttcttctcgcctctcccaccggcccggtcgcccggagtagcaagcgtctccgatccgatccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctgcgcgcgctccaggcggacagcgactccaagaccccgcgggacctggcggaagcggcgctccgcgcggcgacgaccgcgggcggcgcggcgggcgact

SEQ ID NO: 9458 - DNA, 376 bp, Zea mays
  Clone ID: LIB148-019-Q1-E1-D2
gccctcagaacctgcgacacgatgtacatgaacacgcaggacgccatcggcgcggcgcagcgagccatcgcgttcaaggacacgggcaccgcgaagatcatgctgcagctcgccgtccaggacttcgactcgtgtgaccgtccgttcacccatgccggtgtccccaaccccatgggtaagttcgataaggagctcagccagatggccaacaactgcatggcgcttgcaaacatgatatgaatcatatatatgcggccggggacagtttggcatgtgcttacactccagcgtgaggtggcggcgcgccgcatgcagggaatgcttggacatgaggagcacttggttttcatttaagaattcattgaaattacgagtt

SEQ ID NO: 9459 - DNA, 375 bp, Zea mays
  Clone ID: LIB148-019-Q1-E1-D5
acagcgctcagttacgatttccatacggacacattccgtgcaaggtacccaccacacggtcgacgaaccgtggtgttggaggatggcgtgcaatgggacagggtgagggcaccgcctgttgacacccttgcgcatgacctgcacacctctgactgcctgcatgagctccggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcgttggtgaaacggaaggagcat

SEQ ID NO: 9460 - DNA, 394 bp, Zea mays
  Clone ID: LIB148-019-Q1-E1-D6
aggccgaggccgtcgtggagctcatggcacgctccacggactacctcatcgacgcgttcagcgtcgccacgtgcgactccatcagcgaggacggccgcgccggcgcaggcgggtgcacgccgctgccgcccacgacgcggaggtgggaccccgccgacccgaacaccatcctccgggtgctgtgccaccgcgacgacgaggccgccaaccagttcttgaagcgcacgttccagctggccaggaggcggtgaggccacggccatagcttgacttgaaggagcacgaaagatccttacgcgtcccgcgccccgcggcccgattgatgaaatgatgtgcgtggtgtttcgcatttttctcgctgaaaattgctcgcaagctgtgtcgctcgctcgca

SEQ ID NO: 9461 - DNA, 349 bp, Zea mays
  Clone ID: LIB148-019-Q1-E1-D7
tacacgcctctacactgagtctgataaaccgacttcatgcgcgcgttccgcgaacatttcgccgactacctcggtaacaccatcgtggacatccaagtcggcatgggccccgccggcaagctgctctacccgtcctacccggagagcaccggcacctgaaagttcccaggcatcggcgccttccagtgtaccgtcaggtagatgcgtagccgcctgcaagcagtacctgaagcggacgttcaacctgagtggggccacggtaggccaaccgacgctggtggctacaacaactggccgggatacatagtcttcttccgcggcgaaaaccgtgggtggagcaccgattact

SEQ ID NO: 9462 - DNA, 403 bp, Zea mays
  Clone ID: LIB148-019-Q1-E1-D8
ctcgcgggtcgacacacgcctctacacacacgcctggcaacgattcctctcctccgcccgttcccaccgatctcacgctctctctctcttcctccgtcgcgtcgggtcggcgtcgccatcgccggccatgggttgcggtggctccaaggaggccgtggccaccggcaacaccagcgccggcagcaaggtcctccggaggaagccctcctccgtctccaccggcgcaagccacacatccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaagaaggcaacaac

SEQ ID NO: 9463 - DNA, 409 bp, Zea mays
  Clone ID: LIB148-019-Q1-E1-D9
ggccgtacggcccagcagcgggaggtgcgcctgcgggtggacgcaggggcggcgccgtgtagctgccgaagatgccgggcttgtcgacgggctccgctcgacgttcccgctcgaagaacttgttgacgcgcaccacctccaacgccacgtcctcgatccgcttgattagatcggggcgccactgctcgatgtcggtgcgcatttcctccaaggcgataagacgctcctcgccacggagtgcagcaacatcgacttgatcttggatcttgtcgcagcgcgtcgtgaagtgggagttgagttcctcgcaccgctcctccacgcgccgctctacgctgtcgcaacgaccagcgaacttctcagacagccttgcttccatgagccgcaattcctcgagcacctggcggttcga

SEQ ID NO: 9464 - DNA, 381 bp, Zea mays
  unsure at all n locations
  Clone ID: LIB148-019-Q1-E1-C11
ggtccacgacgcgtccgcatcctattcccgcccgctaaaacccacccaaccgccgcgcgccgccggcggcgcaagggacccacgatggccatgcaggtggtgcgcaacctcgacctggaccggtacgcggggcggtggtggtgaacgagacgtgggccgacgggcgccgcggccacatcgaaggcacngcctggcgcgccgaccctgccagcgacgaggccaagctcaaggttcgcttctacgtgccgcccttcctccccctcatccccgtcaccggcgactactgggtgctccacatcgacgccgactaccagtacgcgctcgtcgggcagccctccaggaactacctccggatcctttgcangcagcctcacatggacg

SEQ ID NO: 9465 - DNA, 382 bp, Zea mays
  Clone ID: LIB148-019-Q1-E1-A5
cctccccttcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaa

SEQ ID NO: 9466 - DNA, 392 bp, Zea mays
  Clone ID: LIB148-019-Q1-E1-A6
aggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaatgacagccacgaggaggacatctgccaggtggtgc

SEQ ID NO: 9467 - DNA, 387 bp, Zea mays
  Clone ID: LIB148-019-Q1-E1-A8
acggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagtttttttatctgcttttttttgcagacaaatacaaaccacacacatatatatatttgtaaagattcgttcgtattttcattttcaccgggaaga

SEQ ID NO: 9468 - DNA, 386 bp, Zea mays
  Clone ID: LIB148-019-Q1-E1-A9
aacctcctctggcgcaatcccctccaccacctgctccagtcagctcactaccaccacctgtaaaatcacctcctccaccgggtccagttatctcaccaccgcctcctgtggaatactcttcaccacctaatccagtcaactcaccggcaccacctgtgaaaatatctcctccactaactccaatgggttcaccaacgtctcccatgaaatcccctccaccaacgggagccgtcagctcgccgccaccgcctgtaaaatcacctcctccaccggctcctgtgatttcaccatcaactccggtgaaaatcctcccaccaccggcaccagttagctcacctcccccgccaattcccgttagctcagcaaccccatttgcaaaatcccca

SEQ ID NO: 9469 - DNA, 362 bp, Zea mays
  Clone ID: LIB148-019-Q1-E1-B10
gagatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaaga

SEQ ID NO: 9470 - DNA, 411 bp, Zea mays
  Clone ID: LIB148-019-Q1-E1-B12
cacgcgtccgcacacgcgtccgcgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacga

SEQ ID NO: 9471 - DNA, 382 bp, Zea mays
  Clone ID: LIB148-019-Q1-E1-B3
tggtagggcttgctagctagcaaaaactgttggtatggtcccccgtcaatccgccggaaatggtgttcggcctcctcgcccacaatcgcggcgaaaggcagtccgccatgggcgtcgccgtcggctgtcaaattcaccggtccggtcatgatgccaaggctttcccgccttgctgctcctctcggaggcgcgtccacaggtcacggcggcggacgggtgggcgggcgtacggtgcgagtgcaacccgagtcagggtcgggtttcccagcgccgtcgccctctcgtctcgccgctccggtggatgatggagcgcgtcggcgtcggcgtcgttggatccctctctttgcgcggctgcggatgggttggagcgacagcgaccgaa

SEQ ID NO: 9472 - DNA, 375 bp, Zea mays
  unsure at all n locations
  Clone ID: LIB148-019-Q1-E1-B4
agatccatcttgggcgggcgccccccttcaagggcaacccaaaccttgcaatggaagccttccggtccgacagggtcaacaacaacaaccgccgctccaaggcgtcgtgcccggcaacctccgcggccgtggcggcggcgagggccgatgacgccctgcgccagcgcccgcgggggctcgtgcangtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcancgaggtggccggcggcaccg

SEQ ID NO: 9473 - DNA, 398 bp, Zea mays
  Clone ID: LIB148-019-Q1-E1-B5
gcgcccgtacagccaccactctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgc

SEQ ID NO: 9474 - DNA, 377 bp, Zea mays
  Clone ID: LIB148-019-Q1-E1-B6
acccacgcgtccggagaggccaggtgccaagcaaaggcggtgcagtgcaggcagggcgtgtggagaagcagagcagcgggcggcgcacctgcacttggcagctctggccatggcggatcaccagaggatccaccctgtagacctggaggccggcaaccggccgacgacgccgctggtgccgggagcctcgttccggtcggacaagggcgacccagcgcagcgcgcgaacaaccaccaccaccaacagcaacaacgaggctacgtctacgtccccgggccgctgcctccgccgccgcgtcacgccgcgccaccggcgccgcctctgccgccgccgaagcggcgcaggcggcgctgctgctgccggttcccctgctgcg

SEQ ID NO: 9475 - DNA, 409 bp, Zea mays
  unsure at all n locations
  Clone ID: LIB148-019-Q1-E1-B7
acccacgcgtccgctggatgctagcacagcagcccacgtggcaggtccctcaagtaacaggcgagctacagttgtgcctgaagaggtttcagatgaaggagtgttccgtcgctttgtcagactacttctggccttcattgtcaaagtctttgccttctttcacatagtacgtagtcagcaggaaacgagggtcaacaacctactacctcctgccgaaccagaactgatttctgacgatcatccggcagtagagactttcaatgtagaccacatcagtcctgtcatagagcgccttcagagacttgaagggaaggtcgatgagcttggcagcaagcctccagcgattcctgtggagaaagaacgatccctcttggagtcatgggatangataaaatgcatcgaatctgac

SEQ ID NO: 9476 - DNA, 370 bp, Zea mays
  Clone ID: LIB148-019-Q1-E1-B8
agcgcttcatggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtccatcctctctttct

SEQ ID NO: 9477 - DNA, 347 bp, Zea mays
  Clone ID: LIB148-019-Q1-E1-B9
acgcgtccgaaaagcattcggaacaacaagaccaagggtatatgcaccaacgcccaagggaagaacaaagggtggctccaaggggcttgaagggtttaaaaacccccctgaatgggaccaccccccccagtaaaaatttttccccgccctgtgaattgccccaaaaaggggtccactggggagccccacacattaacgccaaaaaacccccagccaaataagttctaccgggggagaacccccaatttttggggggaaaattaatttcccaaaaacaaccaaaatcaaggggtgaaaaaacaaaaaaaaaaagaaaaaaaaaaggggggcgccccaaaagattcaaa

SEQ ID NO: 9478 - DNA, 389 bp, Zea mays
  Clone ID: LIB148-019-Q1-E1-C1
acccacgagtccggtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagcca

SEQ ID NO: 9479 - DNA, 401 bp, Zea mays
  Clone ID: LIB148-019-Q1-E1-C10
gagccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatat

SEQ ID NO: 9480 - DNA, 386 bp, Zea mays
  Clone ID: LIB148-019-Q1-E1-A4
aaccacacgtccggcggcgctcaagagcgccggggtggagggcatcatggtggacgtctggtggggcatcgccgaggccgacgggcccgggcagtacaacttcaacgggtacatggagctcatggagatggccaggaagaccgggctcaaggtccaggccgtcatgtccttccaccagtgcggcggcaacgtcggcgattcagtcaccataccacttccgggatgggtcttggaggagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaac

SEQ ID NO: 9481 - DNA, 418 bp, Zea mays
  Clone ID: LIB148-018-Q1-E1-H1
gaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccg

SEQ ID NO: 9482 - DNA, 409 bp, Zea mays
  unsure at all n locations
  Clone ID: LIB148-018-Q1-E1-H10
taccggtacctggactccggacggacgcacgcgtacgcccacgcgtccgcaagccccgcaccgccccgcccgcccccgcctccgccccgccgcatgagacggggtcggcacggggcgatgaggagcagcgaggccatggagctcctgggcttccctcgctactccaggccctccccttccgaggtgaaggctgcgtatagaagaatggtgatggagtcccatcctgatcgtgtctcaacgcatctgaaatcgcacgctgagtcaacattcaaggagatagcagaagcatattcatgtttgaaggacggaagaagatcagggagtangatggaacttcatgttatgcgttctggtgttcaactagccacggaagatcaaatagaacgttgggtacagccccgtttctact

SEQ ID NO: 9483 - DNA, 216 bp, Zea mays
  Clone ID: LIB148-018-Q1-E1-H11
agcccacgcgtccggcgcctcaccgagctcttcagccagcgggggctctcccaggaggacctcgtcctgctctccggcgcgcactccatcggcggcgcgcactgcttcatgttctccaaccgcatctacaacttctcccaggacgccgacgtcgacccgacgctggacccggagtacgccaagtggctgcgccaaatgttcccgccgcgggaaccc

SEQ ID NO: 9484 - DNA, 281 bp, Zea mays
  Clone ID: LIB148-018-Q1-E1-H12
ctttggcaacaacgaatactgaaagaccttccaaactagcatgaagtgcgggcaccttgcttttcttttgccttctttttgtgaaaacgtgtgcttagcgacaatgctggcaaagtgttagaagcatctctggaatgcttcgtgtagtatcttttgactctcttttcttttgtcgtctcaatcatgttacatgagaaatgcctgatggactcaaataatgaaccggtgattcaaaaaccaaaagcctctgatgaatctatttgagggtttggatcttgatc

SEQ ID NO: 9485 - DNA, 398 bp, Zea mays
  Clone ID: LIB148-018-Q1-E1-H3
ctcttctacgcgcccgacgtcgtccaccaccaaccagcgacggcgctgctgcccgggtacgatgtcctcgacgtgctcgcggcgctgagcctcagctcccccagggccatccgccagcctcgctaggagaagcctgctcatggcgcctggcgggccaccacctccaccacggctgctgtgcctagtgtaaccccaagcaaggctagtctgtttctgtgtatacaatacgactgaaaaactaggagaggggggattcggccaaggcggccggtgctctctcctctcctcgtagctagtttttcctcctgttccagctcagttcttgttcatccagccgtgttaggaaaacaaacccagccccgtgcccatgttgttgaaaaatatattagtctggttat

SEQ ID NO: 9486 - DNA, 434 bp, Zea mays
  unsure at all n locations
  Clone ID: LIB148-018-Q1-E1-H4
gttcatcactgataccaaggccgctattgctgaaacttacaaccgcacagattcagaatttctgaaagctgatagcactcaaactcgagatgctggctcaactgcctcaacagctattattgtaggtgatcgtttgcttgttgcaaatgttggagattctagagctgttatttctaaaggaggacaggcgattgcggtttcaagggatcacaaacctgatcagacagatgagaggcaaagaattgaggatgcagggggctttgttatgtgggctgggacatggagagtgggtggcgttctcgctgtctctcgagcatttggtgataaactcttgaagccgtatgttgttgctgaccctgaaatcaaggangaggtggtcgacagctccctcgaatttctcatccttgctagcgacggactctgggatgttgtca

SEQ ID NO: 9487 - DNA, 424 bp, Zea mays
  Clone ID: LIB148-018-Q1-E1-H5
cctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaag

SEQ ID NO: 9488 - DNA, 418 bp, Zea mays
  Clone ID: LIB148-018-Q1-E1-H6
cgttgagccaaagttttcaatgccccactcagctaaagtggatgaagtggtggtggcaaatagcctaatcggaagtgtattatcagactacttctgggctctttctgttgtttggactactcccttggtggccactctaggcatgtctctcacaattccaatagcaatggttgctgatatgatcattcacggccgtcactattcagcagtatatattcttggttctgtccaggtattttcaggctttgttatcgcgaaccttgcagatcgcttttctcgttctctagggctatcatagtctcataaaacagaacaggcccttattagagcgtgcatcaggaagctccaaggtcgggttggttaggccaatacttcagaaaacctggatcgggagataccaggaattaatttccctttg

SEQ ID NO: 9489 - DNA, 428 bp, Zea mays
  unsure at all n locations
  Clone ID: LIB148-018-Q1-E1-H7
cccacgcgtccgcaggaattcaattgatactgagtttgtgtttggctgatgggtttgacatgttcccaacattactagttacagatggatcatgcatgatagacaggaggatgggaatacatgggcatcctcttgaaatccaagctttattctactctgctttacgatgctcacgagaaatgcttgtcgtgaatgatggatcgaaaaacctcatccgtgccattaataacaggctcagtgcattgtcctttcacatcagagaatattactgggttgacatgaagaagataaatgagatatacagatacaagacagaagaatactcacatgatgccactaacaaattcaacatttaccctgagcaaatcccttcctggcttgttgactggattcctgagaaaggaggttaccttatanggaatctgcag

SEQ ID NO: 9490 - DNA, 433 bp, Zea mays
  Clone ID: LIB148-018-Q1-E1-H8
agcaatggtacctgaatcagctacaaaccatgatccaatcctagcggctagcgatctctagtttatattacaattaggagcaagcgatccaattatcgatagagcgcgagatcgatcgatcatgccgggccgctcggtggtctccatcctcctcctcctcctccatggcctcctctgcctgcagctggctgccttggccgagatggacgacgacgacgtcatggaggacggcagctgcatgcatttcagtgtgtcaccgccgcctgctccgccggaggacgcggatgagcggcgcgactatttccgcgccatgcatgccaaggatctgttccggcacgagcagatgatcacgatgatgggcagcgaccggaaccgtagcatcatgacgcggcgggcgaaggagtcctccaagctgccgggggtcactgtcgcc

SEQ ID NO: 9491 - DNA, 326 bp, Zea mays
  unsure at all n locations
  Clone ID: LIB148-018-Q1-E1-H9
aggatggcgtcgaataagacggtcctcatcgtcgcggcgatgcttctcatcacgctcgtgctggaggccgcccctccggcgaccgccatggactgcaaggccgggtgtgacgaggtcacgggcccactcgacatgaacatggaggactgcatgaagaggtgcaaggagatcgctgctaagcaagggcctagggacccttacaaggataacaaacttgacatcccatgaactanttaatgctcctatatcatctgcctatccatgcatgcattgcattgcgtatgcacactgtgcgtgcctgcccacaaagttcgacaacacaccga

SEQ ID NO: 9492 - DNA, 375 bp, Zea mays
  Clone ID: LIB148-019-Q1-E1-A1
taaccctccctctctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacga

SEQ ID NO: 9493 - DNA, 380 bp, Zea mays
  Clone ID: LIB148-019-Q1-E1-A10
gaacggtagtttgtcacttgaagagctgaaggagggtttccggataaacgatcatcctgttccagaggaagagataaagatgttgttacaagcgggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggatggtcgcatcagttacccagagtttgaattgatgatgaaaagtggatcggact

SEQ ID NO: 9494 - DNA, 404 bp, Zea mays
  Clone ID: LIB148-019-Q1-E1-A2
taaccacgcgtccggcagcgctcaagagcgccggggtggagggcatcatggtggacgtctggtggggcatcgccgaggccgacgggcccgggcagtacaacttcaacgggtacatggagctcatggagatggccaggaagaccgggctcaaggtccaggccgtcatgtccttccaccagtgcggcggcaacgtcggcgattcagtcaccataccacttccgggatgggtcttggaggagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaccacttcgccaacctcaag

SEQ ID NO: 9495 - DNA, 367 bp, Zea mays
  unsure at all n locations
  Clone ID: LIB148-019-Q1-E1-A3
aacatggcgttcacaagcaatgcgatgaaagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattgga

SEQ ID NO: 9496 - DNA, 434 bp, Zea mays
  Clone ID: LIB148-018-Q1-E1-G8
cctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaagca

SEQ ID NO: 9497 - DNA, 188 bp, Zea mays
  unsure at all n locations
  Clone ID: LIB148-018-Q1-E1-F11
ctcaagagagcctcatagcaggggatcatatctactcctggagggcggcgtgggtctacgcgcatcacggaatatatgtgggcgatgataaggtgatccatttcacaagaggaagacgacaggaggtcngaacaggaactgtcctcgatattattcttgtgagttccaccccaaaacgaagcaacacg

SEQ ID NO: 9498 - DNA, 468 bp, Zea mays
  Clone ID: LIB148-018-Q1-E1-F12
acgcccacgcgtccggcaggtcggcgaggagggcaggaagaccgaagaccgagccgtgcgggggctcgggacgggaacgggacaggacctcaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgaagaggccatatgctggggaattgcatattgtgtcaagggtggtccagaaaaagagctaaaagcaatgcagtacttggagagaaga

SEQ ID NO: 9499 - DNA, 420 bp, Zea mays
  Clone ID: LIB148-018-Q1-E1-F2
acgcgcgggacgatgcaagcctctacactgagtcgcattaccatccctcaactcgcgcgcgcacggccgcatccgcggcacgccgcgccgcatcccgtgcccgcgcaaaaccggatccgccgccgccatggcggtggaccgcgtggacggcgaggaggcgttcgaggaggtggacccgacggggcggttcgggcggtacgcggacgtgctggggctcgggtccgtcaagaaggtgtaccgcgggttcgaccaggaggaggggatcgaggtggcgtggaaccgtgtccggctgcggtcgctggccgaccgcgaccccggcatggtggagcgcctccacgccgaggtgcgcctcctccgctcgctcagccacgaccacatcatcggcttccacaaggtgtggctggaccgcgacgccggggt

SEQ ID NO: 9500 - DNA, 433 bp, Zea mays
  Clone ID: LIB148-018-Q1-E1-F3
actcgcgggtcgatgcaagcctctagagtgagtcttactaggcgcgtccgagacgcacgccggcgtggcctacgaccactgcatggcgtcgctgggcgccgacccgcgcagcaaggacgccggcaacaagaacatgcacgggctggcggtgctggccaccaggatggccatctaccacgccgccagcaccgagtccaagatcgacgacctcacggagctggacgcggcgtcgtcggatccgcaggctcgcgcccgcttcaaccactgcctgtagcagtacggcggtgccgccgacctcctccgcgactcgctggacaacctcaaagcgaatatctactgcatagccatggagcatctgaccgccgcaatgggcgcctccgagagctgcgaagacgcgtcgaacggccaggaggaagatgtccccgtcgccgct

SEQ ID NO: 9501 - DNA, 447 bp, Zea mays
  Clone ID: LIB148-018-Q1-E1-F4
acgcgcgggacgatgcaagcctctacagtgagtcatgcgagagaaccgacttgccaccggctgctcgccgtctctctctctctccctcggggcgcgcgcgcgcgggagacaggccaaccgatcgccaggccggcagccatgggcaagcacggcaagtgcagccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatccgggtcatcgtcgcgcccatcctcgtgatgatcccgatgatcagttaccggaagcggcaaccc

SEQ ID NO: 9502 - DNA, 422 bp, Zea mays
  Clone ID: LIB148-018-Q1-E1-F7
ccaggtatgcccgccccttcgattccattctgctgtgcgaaacggagcaccccaaccccaacctaagctatttggtttcggatctgaccccaaaaacgtggagctcagagcattggtgcctctttcctctttcaccaaggattccggtgccttatttcacaagacaaaaaaagtctcaagggtcttgattcttgtatgaactcaagatttatggtggatcttggagctgtgggatgctaagcctggtctagctactagattatgaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatct

SEQ ID NO: 9503 - DNA, 429 bp, Zea mays
  unsure at all n locations
  Clone ID: LIB148-018-Q1-E1-F8
ctccgccatggctgtatacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgccggcaaaatcgagtctggttcggttgaccagtcggatgggtccttccttgatgacgggcagcaggaggaaggttatgtgctgacatgcgtctcctacccaaagtccgactgcgtcatccacacccacaaggaaggcgacctgtactanggctagggctttccaatttggcgagggacaaaaaatgctctcgagtggtgtgttgtcaagcaaagctcctccatctgcgccctaccccgttgtgcgaactgtttggcatcaaacttgtgtgggtg

SEQ ID NO: 9504 - DNA, 429 bp, Zea mays
  Clone ID: LIB148-018-Q1-E1-F9
agggcacaggtggaggaagccgggaagcacgcggtgatggcgcgtacagggcttcccgcgcgcgatctcagggtactcgacccgttactctcgtacccgtccacgatcctgggccgcgagcgcgccatcgtcgtcaacctggagcgcgtcaaagccctgatcacagccacagaggtgctgcttccaaacaccaaggatcccgcctttgcgcgcttcgtccgcgacctccagacccgtgtcctcgcatcttcgtctgacgaggcagctgagttcactgacatggaacgtgaatcatctaatgttgcttcaccatttcccctaccaagtgcatccagaggacatgaaatggagatgactaagaagactactgctgttgtgcctgagatgactagtagcagcagtatgcccaatttagctattgcaaaagat

SEQ ID NO: 9505 - DNA, 198 bp, Zea mays
  Clone ID: LIB148-018-Q1-E1-G1
cccacgcgtccggctatagctccagagtttatctacctggtagcaccatgacacgatggcccgttcgtattttctggcttgctcgtacttttcagttccatgggtttacaacaccttttactcccagcagaaaatacataatatgcatgtactcgactttttttctatagtaatataaacaaagtttcacatgtgttt

SEQ ID NO: 9506 - DNA, 74 bp, Zea mays
  Clone ID: LIB148-018-Q1-E1-G10
aagttttaagtgacaccaatttagaagggaattagagtggattaaattcgctcccggtaaaaaatgactcgaag

SEQ ID NO: 9507 - DNA, 60 bp, Zea mays
  Clone ID: LIB148-018-Q1-E1-G11
atgccaagcgtcccgttcctgggtttttcccaactttgaaaaaaggcggggttcccccaa

SEQ ID NO: 9508 - DNA, 90 bp, Zea mays
  Clone ID: LIB148-018-Q1-E1-G12
agcccacacgtccgcgacaagatggcgtgcacaaacaatgcgatgagagccttgttcctcctggtcctcttctgcatcgtgcatggtgag

SEQ ID NO: 9509 - DNA, 272 bp, Zea mays
  Clone ID: LIB148-018-Q1-E1-G2
taggatgagtcgcagcatccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgatgccgccgccgcgggcgccccaactgcctccgagtcgtccgccgagggctccgc

SEQ ID NO: 9510 - DNA, 435 bp, Zea mays
  Clone ID: LIB148-018-Q1-E1-G3
ctccaagccaagcaggtccagagatctcgatcggtcctcttgcagaaacgaggaaagaaaacatgtcttctcgctgggttagggcggaggtgtacccgctgttcgcgacgacaggggtggcggtggggatctgcgtgatgcagctggtgcgcaacatcaccaccaacccggaggtgcgggtgaccaaggagaagcgggcggccggggtgctggacaaccacgacgaggggcggcgctactcgcagcacggcgtgcgcaggttctggctctccaagcgccgcgactacatgcaggccatggacaaggtgcccacggaccctaataagtagacgacgacgatataccccaatgcatggcaagaagatatatatatcagcacaacgcaactgcatgcgatgctgcttgttgctgcaattaatccactatactatatac

SEQ ID NO: 9511 - DNA, 387 bp, Zea mays
  Clone ID: LIB148-018-Q1-E1-G4
ctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctc

SEQ ID NO: 9512 - DNA, 415 bp, Zea mays
  Clone ID: LIB148-018-Q1-E1-G5
aagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagcaaggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttct

SEQ ID NO: 9513 - DNA, 267 bp, Zea mays
  Clone ID: LIB148-018-Q1-E1-G6
agctggttcgtggatggcggcgccacaggctctcctgactatcgctgctggtcgtcgtgctagctgtggtcgccgttgtcgcaaacgtcagtcacaccaagcctctgactcctgacgggcgcatggtacactacatccacagcaacttcatggacgggccgtgggatccctctcacacgatcttctactgcggtcgggacaggtcctgcaccacggattgctcatacgggtaccatggcactcacgcgcatgggtacgagctgcata

SEQ ID NO: 9514 - DNA, 417 bp, Zea mays
  Clone ID: LIB148-018-Q1-E1-G7
ctgctctcaaagctggaaatgcaccacaaatgatgattccagggactgccaatcagctaaatgctaacggaaccttgcctttccaaaactggacaaatctttatcaaaatcctgggtcgactccagcagcagcacagaatggtgccaccaaggttgctaacaacaatcaggacttctcttctggtaccttcggttttggcacacctggggtgtacaacattagcccagctgtcccagcaaatggggccacgacagcaggtgctatcaacaacggcactgcatcaactgcctcttctactctcccctcacaatctggcaaagactatgatttttcgtcgttaactcaaggatttttcaccaaacgatgagcgcctagtgagcttgaaaaccaagcagaccacaggatcatgttggacg

SEQ ID NO: 9515 - DNA, 472 bp, Zea mays
  unsure at all n locations
  Clone ID: LIB148-018-Q1-E1-F10
aggcgtactccgcgtcattcggtangtacattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaatgagcccctggacaagaagctgtcggaggcggagaagaagaaggtcacgtacgtggtggaccccatcggcacgggcgactacaccaacatcaccgcggggctggaggatatcccggtgagcaacaccaaacgcgtgatcctggatctcaaggccggcgctcatttccgcgagaagctgttcctgaacatcagcaagccgttcaacacgtgccggttcggctccaagaaagccgccg

SEQ ID NO: 9516 - DNA, 426 bp, Zea mays
  Clone ID: LIB148-018-Q1-E1-D1
agtcacgctgtgacgtcgacgcgcgccttggtgacgccggcgcaggcgtcgacgaagtcgccgtcgatgaagtcggtggagaagacctggagcttgtcgccgaggcccttggcgaagacctcggcgatgaacatccgcgcgtagccgtggatccgcctcgtcacgggccacacgcacaccaccgggttgtcgggcctgggcgtcaccgtgttctccacccggtacaagaacccgcggcccgccaccggcggctgctgccccaggaacttgaggttgctctcgaacttggtctccggcaggtccgtgtcgatccagttgtccctgaggtacccggcgctccacaggggctccccgggcccgggcgccggcgacctgcgcggcttccacacgcagatgacccggcgcgggagcagctccgcgacggtc

SEQ ID NO: 9517 - DNA, 239 bp, Zea mays
  Clone ID: LIB148-018-Q1-E1-D12
agcggacgcgtgggaattggccgtccgtttactcctcacaatgtgtaatgataataacggatgctactacgtaccgtacggataatgggtacgtagctacatgaagctgtctacggataatgccgtccgtttactcctctcacatgtttaaaattttagtttcgtttctttcgatttcgaacgctgttgcatattcccagacccaataataaagaacccgacagacaatgcaacaacct

SEQ ID NO: 9518 - DNA, 237 bp, Zea mays
  unsure at all n locations
  Clone ID: LIB148-018-Q1-E1-D3
agactttgacttgccatcgattcatccggcgcggcgggctatggacctgcagcagcaagctaattaanagggtgtttggtttctagggactaatgtttaatcccttcaatttaatctttttcagcatataaattgctacatacataaactataccttattttagtttctacatttaataattttctcactatattctactacactttcatgactaattattactccctaaaaaccaa

SEQ ID NO: 9519 - DNA, 393 bp, Zea mays
  Clone ID: LIB148-018-Q1-E1-D5
gaaaaagctgagtgctccctcacctacggtaactaagaagagcggaactgaaggaaagaaaactccaaatggaaaaacaggagccaagaagtaagcaactcagttgaaacttcgttttgttgggaccaacttcaccatggccggggacagataaacatgttgatcctatctactgggtgatacattggtgttttgacacacggatatgtcagtcctattggttgagagagcatgctggatcttcggccatatgctgtaaatcgcttgttaatttttgttctactagtacacgaagaaatcaaggaaaaaaaaccttgactacgggaagaaaatcacggccacaggggtattttaacctccttcctaatgcgcatatatctatcgaagttgagt

SEQ ID NO: 9520 - DNA, 430 bp, Zea mays
  Clone ID: LIB148-018-Q1-E1-D6
agcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgatgactgctgggccgacacccgcgtcatctgcaccaagacgcacaactgccgggacgacacttgcgcggggcgcggcatgcctgaccgccgctgccactgggagttccccaacctggtgcccttctgccagtgcctgcgcctcaactgccactagtccgggcgcctcggattggctcacttcgccggcgatgatggatggtgcccaactgcgactgcccagtctgctccattcgttgttgtttaaagcaaaattgataaactgccaaattca

SEQ ID NO: 9521 - DNA, 348 bp, Zea mays
  Clone ID: LIB148-018-Q1-E1-D7
agaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcaagaaagagatcgaccactaattggcatacatgtttaagtcgggagagagactcggtcaccttgtaaacaaaacaaacctttgatgtctcccgttttccctccatggggttctgataatacaacatcctggggcttattg

SEQ ID NO: 9522 - DNA, 382 bp, Zea mays
  unsure at all n locations
  Clone ID: LIB148-018-Q1-E1-D9
agcangaagcaggtgttcatccagtccgatgactcgtctgtgctcgcggcgttcaagaagttcgccaggttcaggagggtgctcaacatcgaggccaagatcagcggcgcctccaaaccgtcggtggatgacatcaagaagtacgcggacacggtgagggtcaaccggaactccgtggcgcagatcaatggctacttcctgacgcacttcaccgacacggtcagcaacctacaggacgccaacatcaccgtgtttgtcggcgtactcaagaacgagttcatgaacctcggcttcgactacttcgctgacccgacggtcgagatcgctacctacacgttggcagtgctggctgatgggctcgtcacggacaaacctggcactg

SEQ ID NO: 9523 - DNA, 409 bp, Zea mays
  unsure at all n locations
  Clone ID: LIB148-018-Q1-E1-E10
acggcgaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggangtggacgtggcgccactgat

SEQ ID NO: 9524 - DNA, 410 bp, Zea mays
  Clone ID: LIB148-018-Q1-E1-E11
aggaccgacgcccgctgcctctgcatggtcctggacggcaccgccacgtccttcggcatcgccatcaaccagaccagggcactggagctccccggcgtctgcaaggtcaaggcgccgccgctcagccagtgcacaggcgtccctgcggcacctgcaccgacgcctcccgacgaaccagcagcggcagcggaggaagaagccgacacagctgcagatgccccttcagcaaatggagcctcaagctccacaaactcaaagaatgcagcgagcttactgcttctcatctgcgcattgctgtatgccttctaataagtggtgatacaacttcgctggccatgtcaccgtgcaggaattaggtctttccctgagtcctgacaatgtacttacccatgattctccggcaaattttt

SEQ ID NO: 9525 - DNA, 208 bp, Zea mays
  Clone ID: LIB148-018-Q1-E1-E12
aggccagcccgagatccaacggcgtctgatctgagcaagctgcagcaacacctcggcacctgacctggccatgcatgcacacgtatactataatctaacaacgtagctgacctgggcaaattgccagcctgacaggggccagggtgctcgaatgtctcactctcaccgccgactaactttccatcaaaattgattcttgttcatactc

SEQ ID NO: 9526 - DNA, 378 bp, Zea mays
  Clone ID: LIB148-018-Q1-E1-E2
aacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgc

SEQ ID NO: 9527 - DNA, 416 bp, Zea mays
  Clone ID: LIB148-018-Q1-E1-E4
gcagaacgtgatcctgcacaacctgcacatccacgactccaaggcgcactcgggcggcatgatccgcgactcgaagcggcactacgggctgcgcacgcggagcgacggcgacggcgtctccgtgctgtcgtccagcaacgtgtggatcgaccacgtgtccatgtccagctgctccgacgggctgatcgacgtggtgaacgggtcgacggccatcaccgtgtccaacagccacttcaccgaccacgaccacgtgatgctgttcggcgccagcaacgacagcccgcaggacgcggtgatgcaggtcacggtggcgttcaaccacttcggccgcgggctggtgcagcggatgccgcgctgccgctacggcttcttccacgtggtgaacaacgactacacgcactggatcatgtacgcca

SEQ ID NO: 9528 - DNA, 421 bp, Zea mays
  Clone ID: LIB148-018-Q1-E1-E5
ccacgcgtccgaaaataactattcttggtactagactggatagcttggagtcattgtttggcagaattcctccaaagtcaatcactgacaaggagatgcataaacgccaagacatgctttccagtttgaagtctaaagccaagcagatggcgacaagtttcaacatgtcaaacttcgctaacagggaggatctgcttggtcaaagtaaaatgccagatgacatgagcagagttgctgggttagataaccaaggaattgttggccttcagaggcaaattatgaaagagcaagatgagggtctcgagaagctggaagagacagtgctgagcacgaagcatattgcattagcagtcaatgaagaacttaccctgcacacaagattgatagatgaccttgaagatcatgttgatgttacaaattc

SEQ ID NO: 9529 - DNA, 121 bp, Zea mays
  Clone ID: LIB148-018-Q1-E1-E6
acggacgcgtggggctagaatggacagggatatcgtcgatctgcaacgcccaaattctggatggatgctccgttgaactgaaaccttttgctgtaaaaaagttctctgggggttggagtgc

SEQ ID NO: 9530 - DNA, 209 bp, Zea mays
  Clone ID: LIB148-018-Q1-E1-E7
cccacgcgtccggcaagatgcatgtttgttttagggactaatttttagtccctttttagttcctaaactaccaaacatgccctaagatcacgtgcaagtattttagcaatccccttaaccccttccttttcttttctctctgatcttcctctgatgcagaggttgaagatacaaatttgtcagggagttctcagaccttcctttgtgtt

SEQ ID NO: 9531 - DNA, 391 bp, Zea mays
  Clone ID: LIB148-018-Q1-E1-E8
acgcggtccgtgcaccggcagcgctaccgcatgggggtcggctacaaggtcgcgcccgacggcacgaccacggagaagtactgggagcccgtggaggaggacggcgagcagcaggcaggaagggcaggcaggacgaggaagccgtaccgcgtcgagctcgtcggcatcatctgcgacgcctacctcgccgtcgtcaggggcatcatgcgagctatcatatccgggagagccgtgcgggtgaactcgcagctcaagtcgcacaagcgcttcgccggcgcgttccgcaagtactgcgacctcgtggacaacgccaggctctacagcaccaataccatcgccggcgcaaagctgatcgggttgaaggacaatgacaaccggctactggtggacg

SEQ ID NO: 9532 - DNA, 229 bp, Zea mays
  Clone ID: LIB148-018-Q1-E1-E9
aggcgcattccgccgcagcaggtcacgcagcggtgtcgtcaggacggtcaaggacctcgccgaggaacgggcggcggtgctccgcgccagcagcaaggtctccgacgcggcgttcggggtgccgccgctggctcctggtgtcgagaccgccaacagcaacggtgcccgccgcggcagcgttgaagtggaagatatcaaccgcgggccactaacaatgccaacccgaagt

SEQ ID NO: 9533 - DNA, 302 bp, Zea mays
  Clone ID: LIB148-018-Q1-E1-C9
aggcagcgctcagttacgatttccatacggacacattccgtgcaaggtacccaccacacggtcgacgaaccgtggtgttggaggatggcgtgcaatgggacagggtgagggcaccgcctgttgacacccttgcgcatgacctgcacacctctgactgcctgcatgagctccggcccggcgaccacatcgagattcagtggagaaggaacaaagaattcccatacggctggtggtatggaattgttgggcacttggagtcatgtgatgggagcgaacacttttgtcggtgccatcctagtgat

SEQ ID NO: 9534 - DNA, 284 bp, Zea mays
  Clone ID: LIB148-018-Q1-E1-F1
cccacgcgtccgcccacgcgtccgagcatcgaggcactggcttgcctggtctgatgatgaccttccttttgcatgcatgcatggtatctcatccttgatgatgatctagctcactagttctttttaatttccgcttcattcgcttttccaaattcgattgtgtttcagccaagttgtttagcgggacatctcttgtctgatcttcctgctaaatagagttggactcctatatatagaggccttccggcacatataatatacgtcggaccaatattattgtgatc

SEQ ID NO: 9535 - DNA, 455 bp, Zea mays
  Clone ID: LIB148-018-Q1-E1-B12
agcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaaccgcgcctcagcgagaactgcaagaggtcctgcacccctcctccttcttgaagcgaaaccccttgaaatgaatgaaccatgcatgcatgc

SEQ ID NO: 9536 - DNA, 414 bp, Zea mays
  Clone ID: LIB148-018-Q1-E1-B3
cactaatccaagacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctat

SEQ ID NO: 9537 - DNA, 242 bp, Zea mays
  Clone ID: LIB148-018-Q1-E1-B5
cccacgcgtccggttctctcgctcgctttttttttaaaaaaaaatcccatatacatatagcacatttgtttcggtttgttgatgcgcgcatgcatgctagcagacatctttcctaaaaaaatttaaataatttccatctcgcattattttagtagctaccattcatgttttctgagtagttgtataaatgctaccaccgtcatcttttgtacccggccggaacaaacgaaaaacacactatc

SEQ ID NO: 9538 - DNA, 414 bp, Zea mays
  Clone ID: LIB148-018-Q1-E1-B6
caagttcttccacatgaacatgtaccggtgcaaggacatgctaatcaaggacgtgaccgtgacggcgcccggggacagccccaacacggatggcatccacatgggcgactcatccgggatcacgatcaccaacaccgtcattggcgtcggcgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatccagatggaagactcaaccaaccccat

SEQ ID NO: 9539 - DNA, 408 bp, Zea mays
  Clone ID: LIB148-018-Q1-E1-B7
agcacctgtacccggcggacttctacttcgaggccgggaacaagggcacgctgtccttctcgtgggtggacgagtcgcgcctgcggttcgcgcccgaggaccgcatccgccccttcttcgagaccctcaactactggggcatccagcggaagcgcacgcgcatcagctgcgacgcctgcggccacctgcttggccacgtctacgacgacggtccgccggccatgcagggcaccggccagttcgggatggggcccagccaggtcatcccgcgccgccccaggtaccgcttcaagatcaaggccatcgccgccagctcctcggcacctgccgccgccgcctatgaaaagtgatgctccatagatttcttcatctggttgcgtgtcctgtgtgctgtcagtgctgtggttc

SEQ ID NO: 9540 - DNA, 356 bp, Zea mays
  Clone ID: LIB148-018-Q1-E1-B8
acggacgcgtggggcggtcactccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaggacatcgaggaagccgtggcgcacctcagcgccctctctcgcgacttctccgacgccaggttcctcgaggtcaagtcctggctcacctccacgctcggcggcaccgccacctgcgaggacgcctgcaatgacgcacccgtcagcgacatcaagaacgtctgcagaaccaagagcttcgagtttgagaagctgctgcgcg

SEQ ID NO: 9541 - DNA, 426 bp, Zea mays
  unsure at all n locations
  Clone ID: LIB148-018-Q1-E1-C1
gccgtctcttgtgtctcggaaccggaaagcaaacaagtccagtacgccaagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctaaggctcctangcggtgcggtcggggggatgatgctcggagaggcgatcggtgactatgagaccgacgccgcttatgatgccgggttcaacgatgcattggcattt

SEQ ID NO: 9542 - DNA, 464 bp, Zea mays
  Clone ID: LIB148-018-Q1-E1-C10
gcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagc

SEQ ID NO: 9543 - DNA, 112 bp, Zea mays
  Clone ID: LIB148-018-Q1-E1-C11
ctaagacataaggaactacgtatgtttatggaactttctttaagccatatatttctcagcatgagaatgacatcgaccgaaatcgtcttgagctcagaactcgaaccaacga

SEQ ID NO: 9544 - DNA, 427 bp, Zea mays
  Clone ID: LIB148-018-Q1-E1-C12
gcgatggatcacccatccacgtgatggatccgacagctccttccccggccccccctgcgggcgatggggcacagccatcggaccagaaccggcagcgaccaaggtctgcactccgtggcgccctcggggtggccttccccatcgtggtatcgttcctcttctccttcctcgttgggctcgctgggctcgcgcttggtggcctctcgtccactgcatcggtctccatgccctccacctgccgcatcctctccagtggcgttgaccttaggtcatcaaaagtttgcgagcttgggttattgaactatagagctaagcatgtcttctacccatcgagtaagaggagattccgctgccatgatgactactactgggcttcagttttacaggttgaatatacagaatatttttctggccaattatcttatgc

SEQ ID NO: 9545 - DNA, 197 bp, Zea mays
  Clone ID: LIB148-018-Q1-E1-C2
cgacgacggcgtgttgatcgagggcctcggctcctccagctgcgacggtcacgatggtgttaagatttcgtgccgaaatgtgatatgtttcatgctcgatcaagtaatttattcctaatctgtgtgctgcgcaaaagaaagaaaaacttcgaagtgttgcgctactcgctagtatgaattaattcgtttttcccttt

SEQ ID NO: 9546 - DNA, 419 bp, Zea mays
  unsure at all n locations
  Clone ID: LIB148-018-Q1-E1-C3
ggaagctaaccacgggaaagggaggaacactgcagagctgtctgtctgctctcttgaatcttctttttgtaaagcgtacaccacgtaggcaggatgtaacaacaacattcaaggagttatcttgactgagatgcagattttcagcagcaatgcagcatgaagtcgagctaactgttccacacaaactactcagcaaaaggtcatgggagaggtctcaagcagggtgaccctcctcctcctcctcccctcctttttgttctggcgattgacccactacaaaaaaaatctaaagattgctacagagaccggagtactgagcanatcggggagctgttcgcccactataaggatctcgatgtatacacatgatgcgaccttgtttgttaagcccaaaaaagaagaaattgagagaattgtnt

SEQ ID NO: 9547 - DNA, 58 bp, Zea mays
  Clone ID: LIB148-018-Q1-E1-C4
aaaaaaaaaaaaaaaaaaaaaaaaaaaaaaaaaaaaaaaaaaaagttctagatcacga

SEQ ID NO: 9548 - DNA, 338 bp, Zea mays
  unsure at all n locations
  Clone ID: LIB148-018-Q1-E1-C5
aagccgtgccacccaccctcctctcgcggtcgcgggggtanggccgggtgagcacgagcgctgcccgctcgctgaaccatggcgggctccgcggtggccgtcgtcctcctgtcggccgtcgcgctgctctgcctgtacaacctccttttcgtctccctgtccgtctcggacccggcagcagcaccagccgtcccccgccgcgccggtggccaccatggcagcaacgttccgtccgggtcaggaaccgccaacgtcgtcctccgcttcggcctgtccgggcagccgctcggcttcaagaaccccgcttccgccgcgggcctcccggagatcgacacctt

SEQ ID NO: 9549 - DNA, 423 bp, Zea mays
  Clone ID: LIB148-018-Q1-E1-C6
agggtgcccctcccactctcgcgtcggtcccgcgatgggcctgttctcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgacgagatcctacggggctgcaaccagaacatgcccagcagggcgctgacgttcagccagctgggcgccgcgaccga

SEQ ID NO: 9550 - DNA, 423 bp, Zea mays
  unsure at all n locations
  Clone ID: LIB148-018-Q1-E1-C8
cgaagattgccacttccctaacagcatcgagaaggcaatcagaagcgcttttgtaaaggccgacaatgcaattgcggattcccattctcttgaccggaattctgggaccacagcattgacggtccttatatttggcaggacactgcttgttgcgaatgccggtgactgtcgagctgtattaggaaagcgaggccgagctgttgaactctctagagaccacaaacccagctgcatagttgaaaggctcagaatcgaaaacctgggtggtaccgtctttgatggctacctcaacggtcagctggctgtagcaagggcaatcggtgattggcacatgaaaggctccaagggctctgtatgccctcttacaccagaacctgagtttagggaggttaggcttactgangaaaatgagttcttgataat

SEQ ID NO: 9551 - DNA, 423 bp, Zea mays
  Clone ID: LIB148-018-Q1-E1-B11
agggaaaatggtacaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttacgaacgtgtctttggtgaaggttttgtgagcactggtggaatccagacaacaaaagaaattgtgggcatgctcgatcttaaacc

SEQ ID NO: 9552 - DNA, 401 bp, Zea mays
  Clone ID: LIB148-017-Q1-E1-H6
aaataaagcaggttgactgccctgtgttggtcatacatggcacagccgatgagatcgtggacttcacgcatggcaagcggctgtgggagctagccaaggagaagtacgagccgctgtggatcaaaggcggtgggcattgcaacctggagacgtacccggagtacatcaggcacctgcgcaagttcataaacgccatggagaagctggcaaaggacagcaaggcggccagggcgccgccgccgtcgagcatggccgacgaagtaagacgcaccaagtgcttgagattcgggaagagatgaggctggcggcgaggccatgcgggtctcggccgtctttagctgcgtacgccagtcactaaccccctgctgcattgcattgcattgctttgctgctgcacgtgc

SEQ ID NO: 9553 - DNA, 405 bp, Zea mays
  unsure at all n locations
  Clone ID: LIB148-017-Q1-E1-H7
ctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgangaacggcgccatcatcaggtccgagcggccgagcgccaggaactgcctcg

SEQ ID NO: 9554 - DNA, 98 bp, Zea mays
  Clone ID: LIB148-017-Q1-E1-H9
cggtccgatactcacgggtggcacacgcgtccgaaataaaacaaaaaaaaaaaaaaaaaaaaaaaaaaaagggaggaagcacaaaagagaaaaaaaca

SEQ ID NO: 9555 - DNA, 387 bp, Zea mays
  Clone ID: LIB148-018-Q1-E1-A1
ctgctcctcgtcggccagcccatgctcctacgattaccggtacaaggaaggatcggctggggcgctcggcgtcgtgggcaccgactcggcgaccatcgcgctgcccggcggcaaggtggcgcagctgcaagacgtggtcctgggttgctcctccacgcatgatggccagagcttcaagtcagtagacggcgtgctgagcctgggcaacgccaagatctcgttcgcgtcccgcgccgccgcgcgcttcggtggtagcttctcctactgcctcgtcgaccacctcgccccgcgcaacgccaccgggtaccttgccttcggcccagggcaggtgccccggaccccggcgacgcagacgaagctgttcctggaccccgcgatgcccttcta

SEQ ID NO: 9556 - DNA, 334 bp, Zea mays
  Clone ID: LIB148-018-Q1-E1-A10
agcggataccccttcggcctccacctatcaccacccgggacgtcttccatggcctcctcgtagtagaatagttctatctcaccgcaacatctcctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctgtcgcgggccgaggacccgtacctgttcttcgagtggaaggtgacgtacgggaacaagtccctgctgggcgtgccccagaaggtcatcctcatcaacg

SEQ ID NO: 9557 - DNA, 456 bp, Zea mays
  Clone ID: LIB148-018-Q1-E1-A11
taccgagtccggaagtcacaggtgacgcaccctacagtaaaaggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacgttttaaaatatgttgctgcccagtccccttctcggaaatcaaggctgcaccctcatcaggaaccacagcagcagcaaccacaagtgcaggtggagctgcagcagcaaccacaagtgcatgtggagctgcagcagccgcaaccacaaaaacaagcagcacctgttatgcgcagaggagcatctattgctggtcggcaagcagcaatgggacagcagtctctggagactatacccgttccatcttcacccaagata

SEQ ID NO: 9558 - DNA, 436 bp, Zea mays
  Clone ID: LIB148-018-Q1-E1-A12
agcccaagcgtcccgccgatgcgggtgtttccggtggaggatccggtggcgtcgatgctggtgtctccggaggcgccaaagttgacggcaacattggaggaaaagcgggagggagtggaaatgcatatactggagctgatgcaggtacaagtgtttcaggtggaggatccggtggcgccagtgcaggtaccagtgctaccgtgggtgctggtgtctccggaggtgccaaagttggtggtggcgtaggaggaaatgcaggaggaagtggcaacgtctatactggaaccggtgccgatgcaggcgtttctggtggaggatccggtggcgccgacggtggtattggacctaacataggtgctggtgtcttcggaggcgtcaaatttggtggcggccccggaggaattgtaggaggaattggcagtgctgctgcaggtgc

SEQ ID NO: 9559 - DNA, 382 bp, Zea mays
  Clone ID: LIB148-018-Q1-E1-A2
aagacgtacgtggacgatcacctgatgtgcgagatcgagggccaccacctcacgtcggcaggcatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacagggga

SEQ ID NO: 9560 - DNA, 409 bp, Zea mays
  Clone ID: LIB148-018-Q1-E1-A3
cgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactg

SEQ ID NO: 9561 - DNA, 382 bp, Zea mays
  Clone ID: LIB148-018-Q1-E1-A4
agtcgctgcagcagaacgcgcggtgccagcccacgctggtggtcgagctggcgctcccgacgcacgcgctgctccgcgagctcggcgcccacgcgggcgcgcgcatcgtgctggaggtcgagaagcgcgccgagcagggcaccaccgacggcaacgaggccatcgccaccaccgaccacgacgggtgggtgctggaggagctcatgtggaccatgttctgcaacggcaagagggtgggctacgcggtgcggcgggaccccaccgaggaggacatcgccgtgctggagacgctgtgggccgtctccatgggcggcggcgtgctccccggtacgtcggacatggacggccccgacggcgagatggggtacatgcgccggagctt

SEQ ID NO: 9562 - DNA, 409 bp, Zea mays
  Clone ID: LIB148-018-Q1-E1-A5
aggcgctcaccgccgtcctaccttcatatacctagcagtgtctctgcatagaaagataaaaggtaggaggaggcgcagtgcgtggtgggattatttgtgaggagatattggagttattatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgaggccacgtacaagcatgacccggtcgaggtcgccaaccaacttaaccgtgcagtccacagatccgtcgagaaggatgacattggcaccagg

SEQ ID NO: 9563 - DNA, 399 bp, Zea mays
  Clone ID: LIB148-018-Q1-E1-A6
cccacgcgtccgcacacacatccgtgaaagaaacaagcacatagaaacaaatacatcgctagctcgccaccaacaatggcctcaaggtactctatcctgcttgccacaacggcactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttc

SEQ ID NO: 9564 - DNA, 413 bp, Zea mays
  Clone ID: LIB148-018-Q1-E1-A7
aatcccacaccaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaagtacaacgccgccaagatcttcagcagccctg

SEQ ID NO: 9565 - DNA, 416 bp, Zea mays
  Clone ID: LIB148-018-Q1-E1-A8
cccacgcgtccgcccacgcgtccgcccacgcgtccgcccacgcgtccgttttatcaacgcttctcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccggccaaaccggaaaaagtgg

SEQ ID NO: 9566 - DNA, 420 bp, Zea mays
  unsure at all n locations
  Clone ID: LIB148-018-Q1-E1-A9
ggaggaggccatcttcctgaaggaagactatgctgatgcgcactgtgaccttgggtcggccctgcatgcagtangggaggatgaccgtgctatccaggagtttcagacagcaattgatctcaaacctggccatgttgatgccttgtacaatcttggtggattgaacatggatgctggccgcttcgtacgggctgcagagatgtatactcgtgtgctgagcatccgaccaaaccattggcgtgcgcagctaaacaaggcagtggctttgcttgggcagggtgaatccgaggaggctaagaaggcactcaaggaggcgtttaagatgacacagagggtggaagtgtatgatgctatctcacatttgaagacattgcaaaagaagaagctaaagccttccaaaggaaaaaatgatggtcaagg

SEQ ID NO: 9567 - DNA, 425 bp, Zea mays
  Clone ID: LIB148-018-Q1-E1-B1
ataaataaagcagctcctccgggggcggcgaactactcctcgtcgccaaaaccctagccctgcttctttgccatggcgagcagcgctagccaggcgagcctcctgctccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctattcttcatccacctggtgaagatcccaatggttatgagcttgcaagcgaacgatgggacacagtgcacac

SEQ ID NO: 9568 - DNA, 403 bp, Zea mays
  Clone ID: LIB148-017-Q1-E1-H5
ccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaagacagccacgaggaggacatc

SEQ ID NO: 9569 - DNA, 483 bp, Zea mays
  Clone ID: LIB148-017-Q1-E1-G11
ggtcgccgcacgcgtccgcatacaaaccatccttaaaacccaaaacatcacctccatctcgctaaggtcgaggttctcaaagagcagctgctgtagctgctctatcctctgttgctgactgctgagcaatctggatcttcagaatttctacgatccaaagctagcaacacagcatataagactgatgtcgaccggattgtcataactccagctggcccatcaggcccatcttctcctcagtctgaagctggggagtccaatgtgtttcaccaggaaaaagatgctgcagcagatggggcaccgcctgacactgatggagcagtggctgaggccggagaggaagaaacaacggaaaatgttggtgaagcgacatttagctatgaccgcttgatatccaaatccaccgattcagttcgtgggatagattacaaacgcagagaggcatacttatcagatagtgaattccaaactgtttttggcatg

SEQ ID NO: 9570 - DNA, 352 bp, Zea mays
  Clone ID: LIB148-017-Q1-E1-G12
cccagtcaggatcctcctaatcccggtcccgttccaccaacccccgcccggagaacaaacaacttgggccccaccggagaacgggtcaacaaaggccaaccaaggttgcaagcccgcaagtatcgacgccggcaaggccttgggccgccccgcgggcgtgctcatcaacggcaagggcggcaaggacctgtaggccgcgcctgccttcaccttcgaggccggcaagacgtaccgcctccgcgtctgcaacaccgggatcaacgcgtcgctcaaacttccgcatccaaggccactacattaaactggtccaactggaaggctcccacaacctgcagaacacgttcgactccct

SEQ ID NO: 9571 - DNA, 405 bp, Zea mays
  Clone ID: LIB148-017-Q1-E1-G2
aggttttgaacaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacgacatcgcgccctgcagatttatcgggaagcagctcaccttcaacagactcatccgacaacaacatatagagaagaaaccattgacagagccaatatgattgaagaaccgaaggaggaaatattgtttcggggcgtgcgtgcttgccaaacttgaagactcccagccg

SEQ ID NO: 9572 - DNA, 392 bp, Zea mays
  Clone ID: LIB148-017-Q1-E1-G4
cgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacga

SEQ ID NO: 9573 - DNA, 403 bp, Zea mays
  unsure at all n locations
  Clone ID: LIB148-017-Q1-E1-G6
gtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgtatgccagtggccgtaccacaggtatcgtgctcgactcgggagatggtgtgagccacaccgtccccatctacgagggatacgccctcncccacgccatccttcgccttgatctggccggtcgcgacctcaccgact

SEQ ID NO: 9574 - DNA, 388 bp, Zea mays
  Clone ID: LIB148-017-Q1-E1-G7
gcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttcc

SEQ ID NO: 9575 - DNA, 397 bp, Zea mays
  Clone ID: LIB148-017-Q1-E1-G8
gccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcctcctcccgagccttgcctacctcaacaagcagcccgtgaagccgcagcgcatcgcgcgggaggtggccacggacagcatcgcgcgcgccgcgctcagcggctcggacagccggagcatccggaagaggacgtcgcggcggctcacgcagagcccccgctcgtcgtcgttga

SEQ ID NO: 9576 - DNA, 372 bp, Zea mays
  unsure at all n locations
  Clone ID: LIB148-017-Q1-E1-G9
ccatcgtggagccctacaacgcgaccctgtccgtgcaccagctggtggagaacgccgacgagtgcatggtccttgacaacgaggcgctctatgatatttgcttccgcaccctcaagctcaccaacccttcatttggcgacctgaaccatctgatctcggcgaccatgagcggcgtgacgtgctgcctgcggttcccgggccagctgaactcggacctccgcaagctggcggtgaacctgatcncgttcncgcggctgcacttcttcatggtggggttcgcgccgctgacgtcgcgcgggtcgcagcagtaccgcgcgctgacggtgccggagctgacgcagcagatgtgggatgccaagaacatgatgtgcg

SEQ ID NO: 9577 - DNA, 401 bp, Zea mays
  unsure at all n locations
  Clone ID: LIB148-017-Q1-E1-H1
atcggttacgctctcggtgacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgngcctgtccacggtggtgaccatgatcttcgcccgcgaggtgccgctggaaccggcggc

SEQ ID NO: 9578 - DNA, 236 bp, Zea mays
  Clone ID: LIB148-017-Q1-E1-H10
aaacactgtcaaaccaaaataattttaccaaggaaaacggaaacggaaccaagaaggacaacaacaacaataacatcttaaccgttgaattgccccaaaggttctctccaaccccaaacctgtcttcatcaataaagggtcccgcttcattgggaaaccaaacccctaccgtacgtgccttcggaagggtaaagcgacaggcagaactaactacaccggcaaaaccaacgagcatc

SEQ ID NO: 9579 - DNA, 425 bp, Zea mays
  unsure at all n locations
  Clone ID: LIB148-017-Q1-E1-H12
tcgcccaagccttcgccgacgccttggcccgggcctcccctttccgcaacaacaaattcaaccaagcaaccaaaatgttcccccttaaaactgccggggccctttaaaatccccgcctttgcggccctaaccccggccaaggccccggaaaattcaccgaaggaaggcagtgctgcaaaggcacctgaggctgcaaagagaactgctgcccccgctgaagcacccggagccgcgtccacccccgtcgccgccgctggcccatcatcgtcgtctaggaagtctggtccagctaccgcgccagccaccgcctctacacccccttcttccacngacgaggagttgagcccttccccgccagcatccaccgccgcggcgttccctgcggctganggaacggctgctgatgactccgcggtgctgctgcc

SEQ ID NO: 9580 - DNA, 399 bp, Zea mays
  Clone ID: LIB148-017-Q1-E1-H2
aacgcgaccacagacagagcgcgcttcaaggcctttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgaatggggctggtgcaaacag

SEQ ID NO: 9581 - DNA, 406 bp, Zea mays
  Clone ID: LIB148-017-Q1-E1-H3
gtcagccgcctcctcatcccggtcccgttcgaccagcccccgccggagaacgaccacgtggtgctcatcggagactggtacaccaaggaccacgaggtgctagcccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccggtatcaaggcgtcgctcaacttccgcatccagggccactacatgaagctggtcgagctggagggctcccacaccctgcagaacacgtacgactcgctcgacgtccacgtcggccactgcctctccgtgctcgtcgacgccgaccagaagcccggcgactact

SEQ ID NO: 9582 - DNA, 410 bp, Zea mays
  Clone ID: LIB148-017-Q1-E1-H4
gcaactgaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacg

SEQ ID NO: 9583 - DNA, 402 bp, Zea mays
  Clone ID: LIB148-017-Q1-E1-G10
gggtccaccacgcgtccgacagcgcacggggacagccccaacacggacggcatccacatgggcgactcgtccggggtcaccatcaccaacaccgtcatcggcgtcggcgacgactgcatctccatcggccccgggacctccaaggtgaacatcaccggcgtgacctgcggccccggccacggcatcagcatcggcagcctaaggcggtacaaggacgagaaggacgtcacggatatcaacgtcaaggactgcacgcttaagaagacggccaatggcgtccgcatcaaggcatatgaggacgctgcctccgtgctcaccgcctccaagatccactatgagaatatcaagatggaggactccgggctacccatcatcatcgacatgaagtactgccccaacaag

SEQ ID NO: 9584 - DNA, 401 bp, Zea mays
  Clone ID: LIB148-017-Q1-E1-E8
ggacgctcgtctcgtctcgtcacgtgccgccgccatggctgctctgggccgtggcctgcccctcctcctcctgctcctcctcctcgccgtatcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcgccgacctcaccaacgacgagttccgcgccgccg

SEQ ID NO: 9585 - DNA, 286 bp, Zea mays
  Clone ID: LIB148-017-Q1-E1-E9
cctcttcacccgccgggcaacaactcagccgccgcaaccgccacatcagccatgggcgcctgcgcaaccaagcccaagacgcttgaggggcaagccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaagcggccgtcgccgagcccgaccaca

SEQ ID NO: 9586 - DNA, 311 bp, Zea mays
  Clone ID: LIB148-017-Q1-E1-F1
aggcttgctcctcgatccatcaattgcaagaggagcaagataccaccaccgtagcaccacacgcaggtacgaagaaggcgacgaacatggcgaggctggccttggtaccggcggtggttctgtgcctcctgttagcgacagggccgcagggggccatcaccgtcgaggggatggtgtcatttgactacttgatcagctgcaaggtactgggcaactgcgagtcgaacctgtgccccgaggccctccgcccagggaataccgccaccgactacacgacgcagctgcacgcgtataccggctgtcacggctga

SEQ ID NO: 9587 - DNA, 385 bp, Zea mays
  Clone ID: LIB148-017-Q1-E1-F10
ggcatgcagatcttcgtgaagaccctgaccggcaagactatcacccttgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcgggatacattgacaatgtccaaggcaaaaattcatgaacaaggaggcatcccaccggaacagcaacgcctcatcttcgcccgcaagcaactggaa

SEQ ID NO: 9588 - DNA, 461 bp, Zea mays
  Clone ID: LIB148-017-Q1-E1-F11
aaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcgcacgccatccaaggcgcgacggtggagatggagtgccgccacttcgagtcgcagcaggtccacgacaaggcggaggcgacgacgggccccggcagctggtacatgatggagatcagcggcgaccaccagggacagatttgcgacatgcccctgctcaagagccccgaaggcgactgcgccgagattgaccactcccgcgaacgctgccgcgtcccgctcacccgcaacgacggcatcaagcagagcggcgtccgctacgccaaccccatcgccttcctccgcaaggagccgctccccaac

SEQ ID NO: 9589 - DNA, 381 bp, Zea mays
  Clone ID: LIB148-017-Q1-E1-F12
ctggaagagaaggttctggaatacatgagagcaccaatttatgtttattatgaacttgagaatttctatcagaatcaccgcaggtatgtcaaaagtagaagcgataaacagctgcgttttggggcaaaatacacggccgactcgtgcagtcctgttgagtgggataataatggttccccaattgttccctgcggcttgattgcctggagcttattcaatgatacatatggttttactcgtgggtccaaggaaataaaggtcaacaggaaaaacatttcatggaagagcgaccgggagcataatttggcaaacatgtgtttccctccaactttcagaacggaaccttgattggaggggggaaactccgacctactgtcccgc

SEQ ID NO: 9590 - DNA, 400 bp, Zea mays
  Clone ID: LIB148-017-Q1-E1-F2
gtgttcaccgccaacgactcgccgcccgatcagaagatccccttccaccacgagatggctcaggttccaacatttccgtccaaattgttcttcttctgcgaagtggagccaaagagtggcggagagacgccggttgtaccgagccattatgtctacaagaggatgaaggagaaattccctggattcgtggagaaactggagaaggacatgattgtatatacaagggttttaggagagggcgataacccgtcctcgtcaatcggtcgtggatggcaatcgacatttctcactaaagataaagttgttgctgaggaaagggccgcaaagctcgggataaagctagaatggaccgacgacagcgtgaagacggtcatgggccccatccccgcggtgaagtggg

SEQ ID NO: 9591 - DNA, 402 bp, Zea mays
  Clone ID: LIB148-017-Q1-E1-F3
cgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagattcccgtcatgcgcctcgtccgcaacccaacg

SEQ ID NO: 9592 - DNA, 396 bp, Zea mays
  Clone ID: LIB148-017-Q1-E1-F4
cagaatccggggccggcggcgggcaacaccgacctggtgaccgtcgtggggtcgacgccggatggctagtggctgaacaccgtggtggaccgggacctgcggggcgaggaggaggaggacacagaggagatggtgaagctgatcagggtccgcatggcgtgctgcgagagcaacgtggacaaccggtgggagctcaagaccgccatcgacaggatcgaggagctcaaggcgaaggagcgccccgacgaggagcacgcgacggtgatcgaccacgactacagcgatgttgccctcaactgatcatcgacacgaaacggccgggaatcgatcgatacggagggttgtgcgcaagctgatgatatgagcccaaaatgtgatgacctgcatgcatgccga

SEQ ID NO: 9593 - DNA, 393 bp, Zea mays
  Clone ID: LIB148-017-Q1-E1-F5
cccacgcgtccgcctggttcaagaaggggtacaggccggccgtcatgctggcacagccgcacggctccagcagcctcaaggatgtccaggtcgccttcagcaacgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaagccggcgtcggcgatagtgtcaaagctggagcagatcgctgagacagagcgcttcatggtgaaaaaacaggacgggctggtgaagctgcaagggtccaagcaagggaggaaggggc

SEQ ID NO: 9594 - DNA, 394 bp, Zea mays
  Clone ID: LIB148-017-Q1-E1-F6
cgaggcggacatctggagcatcggcgtcatcgtcgacatcctcctctgcggagttccgcccttctgggccgaatccgaagacggcatcttcaactccatcctgaggggacaggtcgacttcacaagcgacgcgtggccgcgcatttcgccgagcgcaaaggacctcgtcaggaagatgctcacctctgaccccaagacgaggatctctgcctacgacgtcctcaaccatccttggatcaaggaagacggtgaagcgcctgacacgccactggacaacgctgtcatgaacaggctcaagcagttcacggcaatgaaccagttcaagaacgccgcgctgagggtcattgccgggtgcctgtcacaggaggagatcaggggcctgaaggagatgttc

SEQ ID NO: 9595 - DNA, 393 bp, Zea mays
  Clone ID: LIB148-017-Q1-E1-F7
gttggctccgacgcttccctaacgatgtgatccataggaaggggggcagctcgggccggaggacctcctcctccacctcctggaggaacaagagcagcagcagcttcaccgcgcggatcatccgttgtgcgtcctccgtcgtcgacacacaccaccagcaccgtggtgatgatgatgatgacgatggcgatgaagacgacgagtacgacgactgtcgtctaccgtcgtcgcctcctaacaaccacgctagaagaaacaccaccaccactgctgtcatctcggcccgagccttctccttccgcgagctagccgatgccgcaggaaacttccgccaggacaacctcatcggagagggaggcttcggtcgcgtctacaaagcccgcctgccaactc

SEQ ID NO: 9596 - DNA, 391 bp, Zea mays
  Clone ID: LIB148-017-Q1-E1-F8
agcgatggatcagaccgggctctttcgtcctgtacttggtcttcttcttcctgtccgcagccctgtcggaggccaatatcggcgacttcgatgaatactggcagcagctcaagctcatggccgacgccgcggctgatgccacgtacaagcatgacccggtcgaggtcgccaaccaacttaaccgtgcagtccacagatccgtcgagaaggaggacattggcacgaggcgggagatgatggggacgacgactaggaagtctaagttcagcgggccgtgcagggcgacgaacccgatcgaccggtgctggcggtgccggcaggactgggcgacggaccggaagcgcctggcgcggtgcgccaaggggttcgggcgcatcaccaccggcgggct

SEQ ID NO: 9597 - DNA, 400 bp, Zea mays
  Clone ID: LIB148-017-Q1-E1-F9
cccacgcgtccgcccggccctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaatcacccggagccgcgtccacccccgtcgccgccgctagcccatcatcgtcgtctaggaagtctggtccagctaacgcgccaagcaacggcctctaaatcccccttttttcatgggacgagggagtttagccctttcccgccaacatccaacggcgcggtgtcccctgcggctgaaggaaccgctgctgatgactccg

SEQ ID NO: 9598 - DNA, 350 bp, Zea mays
  Clone ID: LIB148-017-Q1-E1-G1
gcgggtcgacacaagcctctagagtgagtcgcactaagcaaccagcttgctcgaccgcgcccgtcattctgcgacaccgccgttccattccgtcgcgccctccaacggcactcgggcagtcagggatggagatgaagaagatcaccggccccgtcctcgtgcccaccgcggaggtcaccggtacccacgccgccagaagcgccaatccgagcctcatgacctggaccgccatcgtcacgatcgtcgtctgcgcctccctctcgaccgacgtctgctacatctgcttctagtacatgcagtcaacggcatgctgcgacgcgtggcccaagctcaaagcagcgtgacagata

SEQ ID NO: 9599 - DNA, 376 bp, Zea mays
  Clone ID: LIB148-017-Q1-E1-E5
cgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatat

SEQ ID NO: 9600 - DNA, 401 bp, Zea mays
  Clone ID: LIB148-017-Q1-E1-D1
ccatgactaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatctcccacgagtccgcctcttccgacaacgccgagtccgccgcg

SEQ ID NO: 9601 - DNA, 464 bp, Zea mays
  unsure at all n locations
  Clone ID: LIB148-017-Q1-E1-D10
cagacgcatgggcgctcagcgcgcctgggtcaccaggaacttgaaggttctgctgcatgcttccggttattgcactgcatgcctctctgctgcacgagagtgcaaaaatctaacagagcctcgttccctttaatttgcttcctctccagggtttgcaggacaagatggagctggtggccatcgatctgcaggacanaccggcttggtacaaggacaaggtttacgcacaagggcacggtgccttccctggagcacgacagcgaggtcaggggcgagagcttggacctgatcaggtacatcgacagcaactttgacgggcccgcgctgctcccagaggatgctgcgaaaaggcagtttgctgacgaactgttcccgtctgccaacgcgttcaccaaagccctctactcgccgttgctgtcccacgcggccgtgttagacgaagttgttgccgctctggataaact

SEQ ID NO: 9602 - DNA, 267 bp, Zea mays
  Clone ID: LIB148-017-Q1-E1-D11
ccaacgcatccgcccacgcgtccggttctagatcgcacggccgccctttttttttttttttttttttttttttttttttttttttttttttttttttttttttttttttttttttttttacaaaatgcagggcttttgcttccaagaaaacaagggcaccataacacaaaaccgttcccaacacacaagcaaggattctacgacccacgggcatgcacgagccgatgcgcccctgcaactttcaagtgcaaccgccggggctgtttc

SEQ ID NO: 9603 - DNA, 441 bp, Zea mays
  unsure at all n locations
  Clone ID: LIB148-017-Q1-E1-D12
cccacgcatccgctatggggcaagcctacccacggcttgtcctcctcgccctcgtggcgttgttgtctgccggcctcttcccgcangcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgacaatttggccgtgctgaacatgcaggtggccgcgttcgccaagcgcacagcgcaggcgcggaagcacgtcgcggtggcggcccgcactattccaccgccgcaggcacaggccctcaggacctgcgacacgatgttcatgaacacgcaagacgccatccgggccgcgcagcgagccatcgcgttcaaggacacgggcaccgcgaagatcatgctgc

SEQ ID NO: 9604 - DNA, 404 bp, Zea mays
  Clone ID: LIB148-017-Q1-E1-D2
acgataagacggcgtacacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaatgctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatc

SEQ ID NO: 9605 - DNA, 409 bp, Zea mays
  unsure at all n locations
  Clone ID: LIB148-017-Q1-E1-D3
ctcggaggtgggcagcgaggagctcgacggaggcggcggcagcggcagccccgaggcggccggcagcaacgccagcggcgcggcgcgtgggtacagcggcatcccggggtacccgatgggcggcctcgcgtccggcgcctggccggacgaggcgtcgccgtcgccgacgtccggcgcgaagcgcccccgcgactccggccccgcgctgcagcagccgctggcgccgcagctcagcctgcccagcggaaagaacaagggcggcagggcggcctcggcggagatggcggcgatcgagaagttcctccagttccaggacgccgtcncctgcaagatccgcgccaagcgcgggtgcgccacccacncgcgcagcatcgccgagcgggtgaggaggacgaagatcagcgagcgg

SEQ ID NO: 9606 - DNA, 406 bp, Zea mays
  Clone ID: LIB148-017-Q1-E1-D4
ggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagaccgcaataactgtcgctacctatgcttctcacttgtgatttttggacacaatatgttaaggtccattcaattctaatgagacgcctgatgaggctacttcggattgtcattggttattgatgtcttatgaatgaataatataaatttttttt

SEQ ID NO: 9607 - DNA, 400 bp, Zea mays
  Clone ID: LIB148-017-Q1-E1-D7
agccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcg

SEQ ID NO: 9608 - DNA, 242 bp, Zea mays
  Clone ID: LIB148-017-Q1-E1-D9
gtccggcggccagaacgagcgcaagtacgacaggctcgacctcatccaggccaagggcggccagtacgccgagtcgctcaccaggtacgccggcgcgctcaactgcgcgtcggaggaaatgctagtgcctgtgcagctctaggctgcagctttcatcattggcgatcgatcgtaacaatgcaaggttgtgttgtatataactcttgtgtttggaatgccgcccgtaattaatggtcaactct

SEQ ID NO: 9609 - DNA, 408 bp, Zea mays
  Clone ID: LIB148-017-Q1-E1-E1
aggtcagttcaggtacggtggcgatgaggtcgtccgtggcccgcctgattcgctcctcctctgcctcgccctcccgtctcagtggaaatgcattcttcggcaatgccacacccagtgatcagaggcacattgagaagccttttaaagtgaaggaggcagaacctgtgaatgtgacaaaaccttcaccacacaagctgctggttctaggaggaagtggtttcgttggatcacacgtttgcaaagaggctttggacaaaggtttagttgtctctagtcttaatagatcgggaaagccatccttaaatgaaccttgggctgacaaagttatatggaaccaaggcaacctccttgaaccagcttcattgaaggatgctatggataatgtttctgcagtggtatcttgtgtcg

SEQ ID NO: 9610 - DNA, 428 bp, Zea mays
  unsure at all n locations
  Clone ID: LIB148-017-Q1-E1-E10
aggacgcgtcgcggagcatgggaaaatatcacattgaattaaattgtggaggcttctgggaaaaaaatttcggcagcatccttcgaactccatcttctcttggccggtctttctcncaccgccgcattaatagtttaccttccttcgatcggtcattctttcaagaccgtactggtagtttcacggagtgttctatagcagattcagagccacagttcgaaaacttgcagcttgaggacgaggactggttagtcaagccaccactgtccgcaggagcatatgctggcaatttcaatgaagaagaatggctggtcacaccactgaagcgctcccgtgtcatgaatggtattgaccatgaggatgaagagtggttagttaaggcgacgaaactgtctggtgccaaggatgctgatcttgaagctgaagag

SEQ ID NO: 9611 - DNA, 457 bp, Zea mays
  Clone ID: LIB148-017-Q1-E1-E11
cggccaagcatccgggttaacaactaatcccctaaatggacgttttaaacggagatgttaacaagggcgtctgcaatttgtgattctaaaaccaatcctgggcgttaacactttcatactttacgcaaaagggaaatatgaagatggaaacttcagtgtcaaccagtcctatctatacataactatcatctatacaatctcatactctacggcattgtttgctcttgcactgttctatgcggcatgcagagatctacttcagccatataaccctgtcccgaagtttatcataatcaaatcagttgtgtttccaacgtattggcaaggtgtgctggttttccctgctgcaaaatctgggttcataaaaaatgccgagaaagctgcatatctccagaacttcgtgctatgtgttgagatgctcatagcagccattgggcaccgattttccttctcctac

SEQ ID NO: 9612 - DNA, 137 bp, Zea mays
  Clone ID: LIB148-017-Q1-E1-E12
gtttcacaatttatccttccccacaggtgtcaacagctgttgtaaagccatacaacagtgtcctctcgacccactccttgctcgagcacactgatgttgcagtcctcctggacaacgaggctatctatgacatatgc

SEQ ID NO: 9613 - DNA, 347 bp, Zea mays
  Clone ID: LIB148-017-Q1-E1-E2
caacacccaagagtgagtcggattagtggcgatgaggtcgtccgtggcccgcctgattcgctcctcctctgcctcgccctcacgtctcagtggaaatgcattcttcggcaatgccagacccagtgatcagaggcacattgagaagccttttaaagtgaaggaggcagaacctgtgaatgtgacaaaaccttcaccacacaagctgctggttctaggaggaagtggtttcgttggatcacacgtttgcaaagaggctttggacaaaggtctaggtgtctctagtcgtaatagatcgggaaagccatccttaaatgaaccttgggctgacaaagttatatggaaccaag

SEQ ID NO: 9614 - DNA, 406 bp, Zea mays
  Clone ID: LIB148-017-Q1-E1-E4
ggacgctcgtctcgtctcgtcacgtgccgccgccatggctgctctgggccgtggcctgcccctcctcctcctgctcctcctcctcgccgtatcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcgccgacctcaccaacgacgagttccgcgccgcgtacctc

SEQ ID NO: 9615 - DNA, 434 bp, Zea mays
  Clone ID: LIB148-017-Q1-E1-C9
gcgttgtaacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttc

SEQ ID NO: 9616 - DNA, 396 bp, Zea mays
  Clone ID: LIB148-017-Q1-E1-B6
agctttcgcgctgtccggagaggaggggcaggatgaggcagcaccaaatctatctggggatctgagcgcgggcgacaagatgacacgcggaggcaagcccgcggcttcgtcaaagccgaacccgttcgactcggactcggacacggagtcaagcaataagccggcgaacaagtccggggcgtcgtcgtaccaggcccccgccgactccaagaagcggtacaaagactggttcagggactcgggcaggctggagaaccaatcggtgcaagagctggagcactacgcggcgtagaacgccgaggagacgacggacgcattcgcctgctgcctgcgcatcgccgaggacatcaggcacgacgccagcgacacgctgatcacactgcacaagcaggggga

SEQ ID NO: 9617 - DNA, 402 bp, Zea mays
  Clone ID: LIB148-017-Q1-E1-B7
agtgaacatctacactatgataagttctctagttttttgaaacaattgcatgatgagattgtccgcttggagttcagtcactacgatttgaaatcatcgaacacaatatctgcaaaggactttgcgttatctatggttgcttctgctgatatgaatcacatagacaagttattggatagagttgatgatttggatgacaatcttgacctcaaggatctgcgcattacctttgaggagttcaaggcatttgctgatcttcgaagaaggttggaaccatttgcaatggctatcttcagctatggcaaagtaaatggtttgttgacgaagcaggatctaaaacgtgctgcatcacatgtttgtggagtggacttgactgacaaagtagtggacataattttccat

SEQ ID NO: 9618 - DNA, 401 bp, Zea mays
  Clone ID: LIB148-017-Q1-E1-B8
cggacgcgtgggcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtcggtgtggaagaactgggtgtggcactccgagaacgacctcttcatggaaggcgcctacttcaccgtcaccggcggccagattaacaggcagttcaacaagaaggacctcatcaagcccaggaacgggtcctacgtcaccaggctcacgcgctacgccggctccctcgcctgcacgcccggcaagccctgct

SEQ ID NO: 9619 - DNA, 461 bp, Zea mays
  unsure at all n locations
  Clone ID: LIB148-017-Q1-E1-B9
catccatcaatctcnccccagcggcgaagagagccggcggccacaggaaggagaaatggcttccgcacacaacgctctccgggtgtttttcatcctagccgtggtatgtgccgtatgcacagcgaaaaggacaggagccaagaaggaagaatcggcggcagcccctggtggtgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaagggcagcagcatcgccatccagctggatggcaacctgctgggatcaaacgacctgaacaagtacacngcgagctggatcgaattgtctcacgttaacaaca

SEQ ID NO: 9620 - DNA, 395 bp, Zea mays
  Clone ID: LIB148-017-Q1-E1-C1
ccacgcgtccgcggacgcgtgggtgggagccgagaaggcgcaggtgatgctgctcaaggagatcgcgcagaagctctgcaaggacacgacaccaccagttccagcggcagcagtggctcagcacagcttttacaaagggggcaacacacagccggccatgaccatcactgtgcgaccaccacggcacccggctttgcttatgcaaaggaaactggtgaagaagaagccatcactccttgctgcagtggtcaagtgggttacatcaatcatgtggtggcgaaggaaatcatcccgcgtcaagttccctattgggcagtgcggcaacaacgtggggctgcttctgctgctcgacaaggctcccagggcaggccacgggcaccagaggccctcccaag

SEQ ID NO: 9621 - DNA, 467 bp, Zea mays
  unsure at all n locations
  Clone ID: LIB148-017-Q1-E1-C10
gcgtctgctcaaccacccgccgccgatggatgtggatttggacgaggccaccgccaccccggcctcggcctctgcaaagcccgcttccaacggcgaggccccctccggcgcccgcgaggtggatgtcggcgaggagtacacgctcgccggcgttctgcgcagcttcgtcgacggcgtctggtacccggacgagccgctgctccggcggctccgggcggcgtcctgcgaaggcgcgccgcggctgaagggggcgtctcggaactcagcgcgggatctgctcgagtgggcaaggcaaggcagcggcctccgcgccatcctcgtcatctcggtccggacaatcatgcctatancattgactggccttttaatcttcatgttctttctgctaattgccactgccaatgcgatcatcgtctcagccctgatgtcactggccgctgctggcggattcttggctatcttctttg

SEQ ID NO: 9622 - DNA, 313 bp, Zea mays
  Clone ID: LIB148-017-Q1-E1-C11
gaagagagcggcggagagcggcgaagcggccgaggcgaagaagattcaggacgacttctgctcgacgctgtgcgaaggcaagaaggggacggacctggtcgtgtgcaaagagtcctgcgcgctctcccagcagtccaacctggtgctgtacggcaggattcagtgcaagggcaaatgcaccgagcagaagggcatcacggcgccgggcatgaaggtctgccaagaggagtgcgacaaggcgtacgtggtgaaggcggccgaagtcaccaaggcctgcagcgtcacctgcgccaaggagaagaacccgcgcctc

SEQ ID NO: 9623 - DNA, 465 bp, Zea mays
  Clone ID: LIB148-017-Q1-E1-C12
gaaacaggcacacaagaacaaatacctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcccttacgctcaaggagggcccaacgggaacttggacgctcaaaacaaaggcccgctcaagtaccccctttgcaaccgctttgctgtcaagtccggttgctaccgcatcgctgacgacgtcatccccgctgatttcaaagccggcaccacctattagaccacactcagcatctaatcagcctctgatgatgaattatatttcaaaagagctcaactggtgctcatgttagcaagacaata

SEQ ID NO: 9624 - DNA, 407 bp, Zea mays
  Clone ID: LIB148-017-Q1-E1-C2
gctagttcgtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaa

SEQ ID NO: 9625 - DNA, 400 bp, Zea mays
  unsure at all n locations
  Clone ID: LIB148-017-Q1-E1-C3
gcaacattggaggaaaagcgggagggagtggaaatgcatatactggagctgatgcaggtacaagtgtttcaggtggaggatccggtggcgccagtgcaggtaccagtgctaccgtgggtgctggtgtctccggaggtgccaaagttggtggtggcgtaggaggaaatgcaggaggaagtggcaacgtctatactggaaccggtgccgatgcaggcgtttctggtggaggatccggtggcgccgacggtggtattggagctaacatangtgctggtgtcttcggaggcgtcaaatttggtggcggcgccggaggaagtgtangaggaagtggcagtgctgctgcangtgcttctgganggagtanatcatcggggggtggctcagattttggatatggttc

SEQ ID NO: 9626 - DNA, 403 bp, Zea mays
  unsure at all n locations
  Clone ID: LIB148-017-Q1-E1-C4
gacaaatccctctccttcttctcgcacggcgggtgcgcgtcgccggcgtcggtctcgaaccgccaactggcgccgtccggccgtttcgaccgtgcgcgcgccgcggcgcagtcggccatcgtccacgtcgccgaggtcgccgcgtaccgcctcgtcttcctggactcgcaccactccttctacggcgggctctacgtcgggggcgtcgccgacgcccgcatccgccccgcgctccgcgcgctgaagcagaacctgtcgctgctcgtctccatcctcgtggaccgcgcgcagccggtggccgtccgggaggtgatgaaggcctcgttccaggggttcctcatcgtcctgctcgccggcggcagcgacaggagcttcacggtgganggacacgcgatggtcgaag

SEQ ID NO: 9627 - DNA, 400 bp, Zea mays
  Clone ID: LIB148-017-Q1-E1-C5
gtcctcttcgatcccgtccaatcccccgcgccccggcgcccctctccgccggcggctttgctgggtcccgcgctcctcctcctcctaggctgttctggttggggctgcggcggagggaactaggtaagggggaaggaaaggggaggtttgagggagagcgcagcggcagcggcagcagcgatgccatcgcacgcggatctggaccgccagatctcgcagctgcgggattgcaagttcctgcctgaggcggatgtcaaaacgctatgcgagcaggccaaggcgatcctcatggaggagtggaacgtgcagcccgtgcgttgccccgtcactgtctgcggcgacatccacggccagttctacgacctcatcgagctctttcgcatcggtggcgacgcgcccg

SEQ ID NO: 9628 - DNA, 404 bp, Zea mays
  Clone ID: LIB148-017-Q1-E1-C6
catgaacaggatggacagggaagaacacctctacaccgcgttccagtacttcgacaaggacggcagcgggtgcatctccaaggaggagctggagcaggcgctcaaggagaaggggctcctggacggcagggacatcaaggacatcatctcggaggtcgacgccgacaacgacgggaggatcgactacagcgagttcgtggcgatgatgaggatagggaccgccgagccgaaccccaagaagcggcgcgacgtcgtgttgtagcctgtgtaggagcatgcgtagatgtagctgctgatatatggtatggtatatcggatggtaaaatggaacggcgtccagcagttgatgccattgccacgacagtggttgcttgcacgctggtcgagcagcacaaggcgcgcgc

SEQ ID NO: 9629 - DNA, 400 bp, Zea mays
  Clone ID: LIB148-017-Q1-E1-C7
ctaaacccctcgacgcagccgccgccggcgtaggggagaggggcacgggcacggcacggggacggaaatggcggaggggaacggcggcagtcgcgccgaggctggcgtccgcgagtcctccgagccctcgccgaagcgctcctcgatccccgccatgccgcacgaagaatgcgtcgagggcatccgctccgcgctcaaacatcccacggtgcggttcctgagggagcggatggagagtgccgggtgcctggtgtggccgcgcctcatccgggcggcgacctgctcctccgccggcggctacgctagccagcaagggatacaagtttgctgcaatcacatgacctgtcaagatgagataactcaggtcatgattcatgaactgatacatgcttatgatgac

SEQ ID NO: 9630 - DNA, 406 bp, Zea mays
  Clone ID: LIB148-017-Q1-E1-C8
cggcctttccctcccatatactcgccgtcggccagcggatctaatcggggcgggcgcgatggctgggcagaaccagcggctcaacgtcgtgccgacggtgacgatgctcggcgtcatgaaggcccggctcgtcggcgcgacccgcggccacgcgctgctgaagaagaagtccgacgcgctgacggtccagttccgcgccatcctcaagaagatcgtcgccgccaaggagtcgatgggcgagacgatgcgcgcctcctccttctccctcgccgaggccaagtacgtcgctggcgacggcgtccgccacgtcatcctccagtccgtccgcgcggcatccgtccgcgtccgctcccaccaggagaacgtggccggggtcaagctccccaagttcacccacttcgtcgac

SEQ ID NO: 9631 - DNA, 403 bp, Zea mays
  Clone ID: LIB148-017-Q1-E1-B5
ccacgcgtccggctggcgctgccgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcc

SEQ ID NO: 9632 - DNA, 246 bp, Zea mays
  unsure at all n locations
  Clone ID: LIB148-017-Q1-E1-A12
ccggttgcatccaccaaatggtggatattggatattgaaaagttggggtcacaatttttgttcccatagtcgtcacgattagccatctgtcaaagtactccctctcttcgttgaataaggtctattgtcatttttatcacacactgcggtatttagatgaataatacacaagcatttgaggattcaaatagaccaatcctgtgcaaatgttcgtactctgagaatatagcaccagagtgntacatc

SEQ ID NO: 9633 - DNA, 404 bp, Zea mays
  Clone ID: LIB148-017-Q1-E1-A2
cgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgtggccctggccacggcatcagcat

SEQ ID NO: 9634 - DNA, 379 bp, Zea mays
  unsure at all n locations
  Clone ID: LIB148-017-Q1-E1-A3
tgatctccctacaccttgagacctgcgttgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcncggtggcgagtgcaag

SEQ ID NO: 9635 - DNA, 400 bp, Zea mays
  Clone ID: LIB148-017-Q1-E1-A4
caagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatc

SEQ ID NO: 9636 - DNA, 397 bp, Zea mays
  Clone ID: LIB148-017-Q1-E1-A5
ggaccctatgggcagatcttccgccctgacaactttgtgtttgggcaatctggtgctggtaacaattgggctaagggccactacaccgagggtgctgagctcattgactctgttctggatgttgtgaggaaggaagctgagaactgtgactgcttgcaaggattccaagtatgccactcccttggtggtggtactggatctggtatgggtacgctgttgatctcaaagatcagggaagagtaccctgaccgcatgatgcttacattctcagttttcccctcaccgaaagtatctgataccgtggttgagccatacaatgccactctttctgtccaccagttggtcgagaatgctgatgagtgcatggttctcgataacgaagccctctatgacatct

SEQ ID NO: 9637 - DNA, 404 bp, Zea mays
  Clone ID: LIB148-017-Q1-E1-A6
cccacgcgtccggacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaac

SEQ ID NO: 9638 - DNA, 400 bp, Zea mays
  Clone ID: LIB148-017-Q1-E1-A7
gtggacttcatcttcggcaactcggcggcgctgttccagaactgcctcatgacggtgcgcaagcccggggacagccagtccaacatggtgacggcgcaagggcggacggaccccaacatgcccacgggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccaggctaccacgtcatcggac

SEQ ID NO: 9639 - DNA, 398 bp, Zea mays
  Clone ID: LIB148-017-Q1-E1-A8
aggttctagatcgcgagcggctgccctttttttttttttttggctgtgttcctcgtgctgttgctatgcccttcatttccccatccctgcggaacgttctgatccttatgttttgattgcgaaatgtgttcggctcgactgaaacggacatgcgatcttacattcccaatgcaatgctgtggctgagatgggttcatctggcctccgcaaataagccaggattgccgttgttccttgcatgaatatcagtcgattcagcaacaactctgacaaataattttcaaagagaatgaatgatcatctcatatatgagttagacaacagggatatgcaaacgagaagaatgacaacttggggactagccaaagaaataaatggcgcctcaaataacttataag

SEQ ID NO: 9640 - DNA, 401 bp, Zea mays
  Clone ID: LIB148-017-Q1-E1-B1
ctctacacacacgttcctctaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttctataacgtaacctcaatgaccacaagcagtgtaagggacgggaagccatggaagagcaccaccatcaagaagaggcatgtcaccggtcttcctccgagaatcacattagttagcttcctgaggatgaggaagaattagtcgtcccagtaacatgtggatgtgagggtcctacact

SEQ ID NO: 9641 - DNA, 412 bp, Zea mays
  Clone ID: LIB148-017-Q1-E1-B10
ggagggcaatgacgagggcccaggagaggcggccattgaagaaccagttggttctcttggctcaatgtcgcgtctgtcgcatctattcatgtataatccagaaatggaggatggcaatgacgaggactcaggagaggaggcggccattgaagaaccagttggttctcttggcgcaatggcgcctctattcatgtatgatcaagaaatggaggacaacgaggaggatcaggcacactagatgcagattgcaccagcttcaccgaaccctttgttttgtgtgcgggggggctctacttatgtaatgtggaatggaaggattgcgcaagcttaaaagtatggctggatcggccttgttttttaactggttccctagttactgccatctaatagccaacatttttcccgcttttgt

SEQ ID NO: 9642 - DNA, 445 bp, Zea mays
  Clone ID: LIB148-017-Q1-E1-B11
cccgccctttcactgccctcccctcaacaacattaaggtccccccctttccgacattcacacgtgggacaggaaatcaccggccatggcctcaattccggcgacgaccttcgccgtcatcttatccgtcctcttctgtgccgcggctggcaccgccgtcgacaacgacctccccgactacgtcatctactgccgcgtctattgcgacacctgtcgcgccgggttcgtgaccaatgtcaccgagtacatcgcgggcgccaaggtgacgctgcactgcaaacacttcggcatccggaacctcgagcgctccatcatacgggtgaccgactggaactgcacgtacacgatcgagctcaaggacagccacgatgacgacatctgcgacgtggtcttggaggacagcccgcgcaaggactgcgaccaggtgcatgcagacacggaccgca

SEQ ID NO: 9643 - DNA, 185 bp, Zea mays
  Clone ID: LIB148-017-Q1-E1-B12
gcgtccgcccacgcatccgcccacccttcggccaagccttcgggggcaaaatgcctccgtaacttcggaggctcacaacattggaaaatctgacatggaccggtcttagcctcgcggaaaaaaattgtaacttttgtaagcaagagccacttctttgaatatatgatcctaacaacgctgccctt

SEQ ID NO: 9644 - DNA, 391 bp, Zea mays
  unsure at all n locations
  Clone ID: LIB148-017-Q1-E1-B2
acctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccangaggagtgcgac

SEQ ID NO: 9645 - DNA, 400 bp, Zea mays
  Clone ID: LIB148-017-Q1-E1-B3
gtgagaagttgggtcctaagtatgcttcatttccaactgacaagctgatggagaaccctgatttctatagtgatcttctcagagaaaaccttgatataagggtcaggttggtggttaactacaatggccttagcgttggtgcagtgcgagatgtgtttgagaagtcccttggcctgcggctgcagaagatgaatcctaacacagactttcactgcttgaagacctttggttctcacttcacagaagatatcgctataccttcgggtacgaagattgacttctgtcaaacatcagatgggaagcttataacagaaattgatgggaaacaaattggtgctgttcggagcaaagatctttgcaaggctttcttcgacatgtatattggtgattcaccggtttc

SEQ ID NO: 9646 - DNA, 407 bp, Zea mays
  Clone ID: LIB148-017-Q1-E1-B4
cccacgcgtccgcccacgcgtccgtgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttctgcaagaagccttgctagttcatcggtcttgctaattgttgatgggtgcttcattaatttga

SEQ ID NO: 9647 - DNA, 385 bp, Zea mays
  unsure at all n locations
  Clone ID: LIB148-017-Q1-E1-A11
cttaattacaggccaaacctaaccaggcctgacaggatttcttggaaaacatacttcaataaccacctcatgtgcgaaatcaagggccaccacctgacctccgctgccatagtcggccacaacggcgccttttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggangcataactgtgaagaagacaaggcaagcgatggtggtcggcatctacgacgagcccatgacccccggccagtgcaaca

SEQ ID NO: 9648 - DNA, 378 bp, Zea mays
  Clone ID: LIB148-016-Q1-E1-G6
agccgcgacctggctgtacctggcgacgaggcggcaggtgtacgcggacttcatcgcccacgaggccatctcgtcgagcgtggccgagttcagctgggacctcaagttcccgggcgcgcaggtgctgctggccgagttcaacatgacctcggcgggcggcgcgcagaacttcaagtcgcaggcggacaacttcgtgtgcgcggtgctggcggacacggggttccaccaggtgttcatcaccccgggcggcgtgatccaactccgggacggggccaactcgcaatacgttgacagcaacgcgttcctgctggtggtgtacgccggactgctgctgccgccggggcaaaccgtgctgtgcgggaaccaagcgctggcccc

SEQ ID NO: 9649 - DNA, 428 bp, Zea mays
  unsure at all n locations
  Clone ID: LIB148-016-Q1-E1-G7
agcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccanggcgtgcagctcgtcaa

SEQ ID NO: 9650 - DNA, 403 bp, Zea mays
  Clone ID: LIB148-016-Q1-E1-G8
agtggacgtcagcgtgcggagcgatgggagacgcaacgatgctcatccccaagggcgactacctggtgggccctctctacttcagtggcccgtgcatgggggacatcaccatccagctcgatggcatcctgctgggatccaacgacctggccaagtacacggcgagttggatccaggtgtcgcacgttaacaacatcgtcatcaacggctccggcacgctcgatggccagggcaccgcagtatataccaagagcaagaccgacgtcgtcaaggcgatgcccaacacactagtgttgttctacgtgaccaacggcactgtttccggaattaaactactcaactccaaattcttccacatcaacatcgacacttctaaggacatcaccgtgaaggatgtgaacat

SEQ ID NO: 9651 - DNA, 383 bp, Zea mays
  Clone ID: LIB148-016-Q1-E1-G9
aggacgcgtgggatacccccacaccttgagacctgcgttgtcacccacccatcaaggttggggccgccagcaggttcagccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgc

SEQ ID NO: 9652 - DNA, 347 bp, Zea mays
  Clone ID: LIB148-016-Q1-E1-H1
actggagtgcaacgtccaaattgcatacattgcctggatcgcacacatgttgctcagtatgcatatggacttgctgctttggggaggcaacttcatgcaatgggactgacagatgttttaaaaatccaccctgatagcagcattgcttctgctttgatggaaatgtaccagagcatgggtgatgcacttgctcatcagtatggaggatctgcgggacataacacggttttccctgagaggcaagggaaatggaaagctactactcaatctcgggagttcctgaaatcaattaaacggtattacagtcatgcctacactgatggtgagaaccaagatgctataaatct

SEQ ID NO: 9653 - DNA, 278 bp, Zea mays
  Clone ID: LIB148-016-Q1-E1-H10
gcacacgttgagatggttgtggctttggtgttcttggtcctatgcttcatggtgcggtcctccgactctcgccccatgcatgtccatcactgtcacttagtgcacagggggtgctggtcgctaatctgatatctgtatggcgggcctaccggctgcctgtcgcgactatattcgtgtgctgctgcgggtacaccgacgttaacaatccccccttcaagagcatgggcgcatgtggcaatatccgcaatcttcaaggattgtctgggttgtgggtcctg

SEQ ID NO: 9654 - DNA, 417 bp, Zea mays
  Clone ID: LIB148-016-Q1-E1-H11
ggatcgcgagcggcgcacctttttttttttttttgacagcgccatttttggcgttttagaacctggctctgagtaagtgccatttcagcttcagctcataacgtcagacggtacgcgacgcaacctacccaccaatttcttcttcttcttcttcagtgttaatttattagaatcatcatggtggaatgaacacaagaaagaacgggacggactagcagtaactaaagaagcagcagggattgaatcgatccttctccttgttcttgtttccgtccgccgggcggtctaggcctatttacaaaaatattacagcagcagcagccgaatagctgaccatccaatccaattcataggtcctttgtgctggcggcgccgctgccttcgtcgacgccgcgcttgccgtagcaatgaaagaag

SEQ ID NO: 9655 - DNA, 408 bp, Zea mays
  Clone ID: LIB148-016-Q1-E1-H12
actcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgc

SEQ ID NO: 9656 - DNA, 416 bp, Zea mays
  unsure at all n locations
  Clone ID: LIB148-016-Q1-E1-H2
acccacgcgtccgatcagctcagttgaatcgccacgcccaaggcacacgtatgtctcgcgcgctcgcgcttgcgatcctcctcctggccgccgccgccgcggtggcgccgctggcctccgccggcaccgangagttcaccagcgtcgggtccagcggcggcaagatgttcgacagggcggtcggagccgatcccgacccgtccccggccggcggactgccggccgacccggcgcccgacgcacgcccctaaggccacgcacgcaccgtcgtacggccccgtttccgtgtacgcttcacgcgctggtactctcgccgcccgtttccgtcgcccctaagacgtagtatgttcatgaacacgacgcgccttgtacatgtctctggaatgtgcagcctgcatgtgttntgcttgcgagcg

SEQ ID NO: 9657 - DNA, 396 bp, Zea mays
  Clone ID: LIB148-016-Q1-E1-H3
cccacgcgtccgagacgcgccgccctcccctcgcgttcattgatttctgttataattactaccgagctactatctccacattattattggtaaagaaagaaagggcgcctcctctaatttgatgggcattccgtttccttctcaacttcaacgccaacaacagttgatgctactatggttggaaatcgggcatggttcggagggcttttcagcggctcaggcaaaaggcgacaagtcagtgcagagaagatagtgcttgatctaacccctgtacaggaacagagactgcaaagtctgaaggaaaggctaaatgtaccttacgacgaaactcggacggatcatcaagattcgcttaaggctctatggaatgcctcctttcccgatacagagctcact

SEQ ID NO: 9658 - DNA, 382 bp, Zea mays
  Clone ID: LIB148-016-Q1-E1-H4
caagtatgccacatgttttgactgcgccgatcagctgaaatcgagcggcatgagctgcccaatctgtcaatctcctattgatgatgttgttctggcgcggttgaatttttgagcttagaatttaggaaaggccaagagaaaaagagccggcactcccagatttagacgtggagtttgcgaagccctggttttgaggcggcttcttacctttttgcttaaccaccactaaagaaatacgagctagttcttggagaaaatgtaaatatgtttttttggcgcaagagcggtgtgcttgtatcgcactaaaggaaaacagagttcaaataaaatgccggttgtaatccccgtaagttccacatcacttgttcacggagagaatgta

SEQ ID NO: 9659 - DNA, 411 bp, Zea mays
  Clone ID: LIB148-016-Q1-E1-H5
acgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggaccaggtccctgctgggagtgccccagaaggtcatcctcatcaacggcgagttccctggccccaggatcaactgctcctccaacaacaacatcgtcgtcaacgtcttcaaccagctcgaccatccgctccttttcacctggaacgggatgcagcacaggaagaactcgtggatggacgggatgccaggcacgcagtgccccatcgcgcccaacaccaacttcacgtaca

SEQ ID NO: 9660 - DNA, 411 bp, Zea mays
  Clone ID: LIB148-016-Q1-E1-H6
acgcgtccaggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtac

SEQ ID NO: 9661 - DNA, 429 bp, Zea mays
  unsure at all n locations
  Clone ID: LIB148-016-Q1-E1-H8
aggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcagggggagcagatcagccggacgcacgagaaggccgtcgagatcgnacaggacctcgcaaagagcgagaccc

SEQ ID NO: 9662 - DNA, 407 bp, Zea mays
  Clone ID: LIB148-016-Q1-E1-H9
caagggcaacaggagagagggatggctaggctgatgtcgctggttgacgaggggttcgccgtcaggcgccagacccaggaagcgttgtactgcatgcagatgatgacgaggatccagactcagctgtacacgagacggctcaagaccgagaaggacaagaaggttctcaagagtcagaccaaggccgttaataaacatagcctggacaaagcaaagattggtgaaggctgggatcatagcctgcagtccaaggagcagatggaaacggtgcagaagatgaagcaggaagctgctacaaggcggcaaagggccttgtcatacgcattctctcaacagtggaggaacaggaacacctcttctgcgcgagctgcgcatgggcctgctcccatgtacatgggacctggcaa

SEQ ID NO: 9663 - DNA, 393 bp, Zea mays
  Clone ID: LIB148-017-Q1-E1-A1
ggcaagctcgccatggtgctcgtgggctccagcgtggggcgcaacgacggcggcgtcgtcgccggcctcgtggcctgtgggatcgtgatggggaccatgtccaacgccaacaacctgatgcaggacctcaagacggggtacctgacgctgacctcgccgcacaccgtgttcatcagccaggccatcggcacggcgctcgggtgcgtcgtcaacccggtcatgttctgggccttctacagggtggtgcagaacggcgacaccgacgtcttcgacgcgccctacgcccgagtgtaccgcagcatcgccatgctgagcgccgggcaggacgggataccaatgcacagcctctggctctgcaagctcttcttcgcgctggcgctcgcgctcaacgtg

SEQ ID NO: 9664 - DNA, 407 bp, Zea mays
  Clone ID: LIB148-016-Q1-E1-G4
acgcggccaacccgccccccaagcccacccagcgcgacgaagctggggggcgatcgctccagcgccgccggcgacatcgccccgggagccgccggcggtaacccgctctctgtcccgcctcaacgaaccctcaggtccaagtagttcgtttcgtgagttatccacagttgcgccgcaatgatgagtactgctaatcgctaccaacacatcaggtcaactaagcctgttgtaggcaacgcaataaaattgaaggatctcatgataaacagtgacaatacgatatgtgctgactgtggtgcacctgatcccatatgggcatctgctaatattggagtgtttctttgcttaaaatgtggagatgttcatacgggacttggacctgacatctcaaacgttttatctgtaac

SEQ ID NO: 9665 - DNA, 205 bp, Zea mays
  Clone ID: LIB148-016-Q1-E1-E7
cgcgtccagtggaggcggtgtccaatgcctgtggaacgctgtgtactaaacggacatcagccccaggtgttcatccactccgttcactcctctgtgctctccgcggtcaggaacttcggcaacttcatgaaggtgctcatcatccaggacaagatcagcagagctctgagtccgtcggtggatgacatcaccaagtaggcagaca

SEQ ID NO: 9666 - DNA, 395 bp, Zea mays
  Clone ID: LIB148-016-Q1-E1-E9
acgccctttttttattttttttctcacaatgggaaaaaaacattctgaagtaaacaactttttggaccacagttccaccgtccagtgactactctcttatgtactctgatgaatgtctgactaatgatagatggtgcaatgctgcatagggcacaaatccaagaacacctcgtatacaacaacctaataacgaatcagccaaaaaaaaattaaccagaagaccttattagtcaatcttgaggtcgttgcacgatcaaagattgggcgactctctctttgattcttaactctttcttgttagtcaatctttaggttgcaccatccaatgaatgctgacgatgtatatgtacgtggcggttaatggatgcccttgggccgtcttcgcatgcatgggg

SEQ ID NO: 9667 - DNA, 352 bp, Zea mays
  Clone ID: LIB148-016-Q1-E1-F1
agaggaacgcgaaaaaccaacgatcgcctcatcgccatggcacgctctgtccccatcgcgcctctgctcctgctccccctcctcctcctcctcgtctccactgcgtccgctgcacggaccgtgggcgacaccgtgcaggacgcgtgcagcaagacacaattccccaagatctgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacg

SEQ ID NO: 9668 - DNA, 310 bp, Zea mays
  Clone ID: LIB148-016-Q1-E1-F10
acgcgtccgggatgcccagtcggtctgacatgctcactgacacttttgggtttggccgggtcatacatgatggcctcatgttcaagcatgacttctccattaggtccggtgatattggggctgataggacggcatctagggagacactgatgaaccatttgcaggaaacggcacttaatcatgtgaagaccgctgggctgctatgtgatggattcggctccacaccagagatgagtatacgggacttattctgggtggttagccagatccaggctatcgtccagcgttatccatgctggggtgatactgt

SEQ ID NO: 9669 - DNA, 404 bp, Zea mays
  Clone ID: LIB148-016-Q1-E1-F11
aacagaccacaaaggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaagacat

SEQ ID NO: 9670 - DNA, 400 bp, Zea mays
  Clone ID: LIB148-016-Q1-E1-F12
agcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactg

SEQ ID NO: 9671 - DNA, 398 bp, Zea mays
  Clone ID: LIB148-016-Q1-E1-F2
ccacgcggccaattcgcttcttcatctttctatatacatatatagacctaataagaacaaagacgtacgataacctgcttattttgcgacccatcccgttcccacgcaaaggcgccgagcgtgatctccgtccgtgccgccatggcctcgcaccgggcgctgctgctgctgctcctcgccgccgcgctcgtcgctgcgctggcctctgtcgcatccgccgacgacgccaacgccatgcccaccatcctgacccccgtggcgcataccccgctggggtccttcgacggcgacaagccggcctctgacgacgacgccgtcgacgacgacgaggacgccgcccctgtcggcgcgcccaacggggccaccatgactgaacccaagggacgacgtcctcgccc

SEQ ID NO: 9672 - DNA, 356 bp, Zea mays
  Clone ID: LIB148-016-Q1-E1-F3
accacgcgtccgggctgctgaggcagtgggcaagccggagtggggcaacgcgggtccgggcgactccggcagctacaaggactggccggaggacacgggcttcttccggcgcgagggcggctggagcacggagtacggggagttcttcatgagctggtactcgcagatgctcctggagcacggcgagcgcatcctgtcggcggcgacgggcgtgttcacggggtcccccggcgtgaagatctcggtgaaggtggccgggatccactggcactacggcacccggtcccacgcggcggagctgacggcggggtactacaacacccggtcgcacgacgggtacgcgcccatcgcgcgca

SEQ ID NO: 9673 - DNA, 189 bp, Zea mays
  Clone ID: LIB148-016-Q1-E1-F4
ggcactgcggcgtccgggcgatctccggtcacctacactgcattggccgcgacgacaccggtcttcctccggggcgatcggcgggtggtagcacgtgcgtactgggagttcttcatgagctggtattcccatatgctcctgtcgcacggcgaccgcatcctgtcggtggtcacggtcgtcttcaccggg

SEQ ID NO: 9674 - DNA, 397 bp, Zea mays
  unsure at all n locations
  Clone ID: LIB148-016-Q1-E1-F5
aaacgagagggcaggagcagccgcagtcccggcgatcccgccgccggtcgccctcacacctcctcgtcactgccttcgtttctctttccaacaatcaagatgagccgtggcggtagcgcgggtggtggtcaaagttctctgggttacctctttggaagcggtgagccccccaaaccagcagtggcaccaccagctgtaagtgctccacctgctgctgcaggtgctccacctgctgagaaaccacctgctgcaaagcctgatggcaccagtcagattgctgctggggttaccagccaaaccaataactatcacagggctgacggtcagaacaccggcaacttccttacggaccgncccttcgacaaggtccacgctgctcctgncggtggctcttccc

SEQ ID NO: 9675 - DNA, 213 bp, Zea mays
  Clone ID: LIB148-016-Q1-E1-F6
tggctctctgtggcctccgccgctgtggtccgtgccgtcgccgggcgccttgtggggttgttcttcctgctggtcgctcgcttttgctccttctcgggggtgctcggggccggcgccgcctcgttcctcgctttggtgggcgtcctctccgtgtgcgcctctttcctgtctgtctctggcggtccgttctctgtgcgggtctgccctcccgtg

SEQ ID NO: 9676 - DNA, 396 bp, Zea mays
  Clone ID: LIB148-016-Q1-E1-F7
agttgctctcaccggtggaaggaagtggaagtagaaggctggaagcggaagcattcgatttccatcgtggggcatggcggcggaggggaagaggaagggcgtcccggcgctagggtggtggctgatgctagtcggctccctccgcctcgcctccgtctggttcggcttcttcgacatctgggcgctccgcgtcgccgtcttctcgcagacggagatgactgatgttcatggccgtacatttggtgtctggactcttttgacctgcaccctgtgcttcctttgcgcactgaacctggaaaataggcctttgtacctggccaccttcctatcattcatctacgctcttggtcatttcctcacggaatacttgatataccacaccatgcctgcagcaaa

SEQ ID NO: 9677 - DNA, 421 bp, Zea mays
  Clone ID: LIB148-016-Q1-E1-F8
agtcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaacggcaaaggaa

SEQ ID NO: 9678 - DNA, 379 bp, Zea mays
  Clone ID: LIB148-016-Q1-E1-F9
atcctaccccacccaccacccgtcgacgccggcctctctcctcacccgctcggagagtcggagcccggcggccggagggcgacgtcgtccctaataaatactaataatttatcactatacataaccaatatataagccatgggcaagcgcagcgtccctcggtaccctgaggacgaggacaaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaacgcctccg

SEQ ID NO: 9679 - DNA, 188 bp, Zea mays
  Clone ID: LIB148-016-Q1-E1-G11
atttaaattctcgacaaaatttgtttgaccacggtgatctgtcatatatgtcgtccattgatttgtgttaatttgacaaaagacgttgaaaagaagctgcactactctactgtgcatcaaaaaaaaaaaaaaaaaaaaaaaaaaaaaaaaaaaggaagaggcacaagaagaataagactttaagtaaa

SEQ ID NO: 9680 - DNA, 204 bp, Zea mays
  Clone ID: LIB148-016-Q1-E1-G12
agacccgttttccctccatggggttctgataatacaacatcctggggcttattgaatgaatgttatctcggttactaaatgattgccatggattattcgtcaaaaaaaaaaaaaaaaaaaaaaaaaaaaaaaaaaaaaaaaaaaaaaaaaaaaaaaaaaaaaaaaaggaagaaaaacaaaaggaataaaaacttaaaataaaca

SEQ ID NO: 9681 - DNA, 388 bp, Zea mays
  Clone ID: LIB148-016-Q1-E1-G2
aatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaacaggatggccatcgaccacgccggcagca

SEQ ID NO: 9682 - DNA, 381 bp, Zea mays
  Clone ID: LIB148-016-Q1-E1-G3
acccacgcgtccgggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgtatgccag

SEQ ID NO: 9683 - DNA, 391 bp, Zea mays
  Clone ID: LIB148-016-Q1-E1-E6
acccacgcgtccgcccacgcgtccgcccacgcgtccgggatccccccacaccttgagacctgcgttgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaaga

SEQ ID NO: 9684 - DNA, 375 bp, Zea mays
  unsure at all n locations
  Clone ID: LIB148-016-Q1-E1-D1
atgaacatgtacaagtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctanggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatc

SEQ ID NO: 9685 - DNA, 274 bp, Zea mays
  Clone ID: LIB148-016-Q1-E1-D11
aatatatactttcggtgtaagacgagccgccgcatctaggcggctactgcacagtcagcagaatgaacccatttctgaaagccttgggacgacacaggtttgttttgggtcagccacacgtttcacttgtcgctgtccctactttgatcccggagtactgatagcttgtgttctgttcacgattgattcaggtgtcattcctttgttttgcgtgttttttttcgtcctccttttaacgctgagccgatatatatgtactgggtctcctccgaat

SEQ ID NO: 9686 - DNA, 414 bp, Zea mays
  Clone ID: LIB148-016-Q1-E1-D12
accacgcgtccgatgggcatgagcgttgaaggtggaatgcgtggatattttggtgcaagttctggtttcgtcaatagctccaatgggcggcaaataggttcttactttaatggtagttcaaaccgattaggtagtccaattgggtatgttggccttaacgatgattcaggatcaatactgagttcaatgtctagaaatgtctggggtaatggaaatctgaactacataggcaaccatacaaacatgaattcttttcctcaacctggaagtggtgggggtatttctggtgatgaaattagttggggaagccttacttctgctcatgggatgggcaacatttcaagccttggatcaggaaaccttggccgtggaaccggagataacaactttggcttgccttctggaaactatgtt

SEQ ID NO: 9687 - DNA, 420 bp, Zea mays
  unsure at all n locations
  Clone ID: LIB148-016-Q1-E1-D2
aaacagagcctggacaaagagagttcaacatgactggaaacttctggagaaggatctaccagcgtatatttttgttcgggttgctgaagatagaatggaccttcttagggctgcaattattgggcccaagggaacaccttaccatgatgggcttttcttctttgatattcacattccctctgcttatccttgtgctcccccgctggtatattaccactctggaggacttcggattaatccaaacttgtataacaatgggaaagtgtgtcttagcctgttgggtacctgngatggtagaggttgtgagaagtggaatccagctcaatcgacaatgctgcaagttcttgtctccattcaagctctgattttgantgacaagccatattacaacgagccaagatatgagtcctatgccaacac

SEQ ID NO: 9688 - DNA, 381 bp, Zea mays
  Clone ID: LIB148-016-Q1-E1-D3
gccatttttattccactgaacatctagatctgtaattgagcttgcgcgcgtgtttcatgatttcgttataatatgtggtcgagcgagcagcaacatttgagttgagaagaatacatgacacccgtgtcaactaaccgcatcattttttagttgatggttcttatgccatggaaattcaacggatgttacagccttttcgtaatagatcatgttaaaaagcacgtgacttttatcgactttacaccgacccaagattggtataagcacatgccatacaagaggttcgcagaagcgattatcatggccttaaagaaatataagattacctacagcaagaaatgttctggatgggaaagaggatattttaagtgaaaacataca

SEQ ID NO: 9689 - DNA, 438 bp, Zea mays
  Clone ID: LIB148-016-Q1-E1-D4
cacgcggtcaacagaacatccaaccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggacgcgtgccgcggcgcgtccgagacgcacgccggcgtggcctaacaccactgcatggcgtcgctgggcgccgatacgcgcatcaatgaagccggcaacattaacaatgcacggctggcagttctgggcaccaggatggccatcgaccatgccttcagcatcaagtcaaagattaaacacctcctccgag

SEQ ID NO: 9690 - DNA, 413 bp, Zea mays
  Clone ID: LIB148-016-Q1-E1-D5
actctcctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagtctcaccccaaaacgaagcaacacgccttgcacggtgtgcaccgacgaaaccagcgacagcagcacagagacgaacggcgtggtatcctcctgtctcagctgcttcctagctgggggtgctctctaccgtttcgagtacg

SEQ ID NO: 9691 - DNA, 395 bp, Zea mays
  Clone ID: LIB148-016-Q1-E1-D6
agcgtctccgatccgatccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgttgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgttgtgaaggacaacgacatgtggcagtgcctgaacgagtgcgccggggagatcgacgaggggctggaccacct

SEQ ID NO: 9692 - DNA, 420 bp, Zea mays
  Clone ID: LIB148-016-Q1-E1-D7
actcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaac

SEQ ID NO: 9693 - DNA, 389 bp, Zea mays
  Clone ID: LIB148-016-Q1-E1-D9
ggctcctcctcgccctcatcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggccgatggagtccatcctcggagcctgcagcaacgggtacgacaacgttgtgcagacgctcgaggaggcgcggaagatcgtcgccacgcggccggcggcgggcacccaggcccaggccgacgacatgaac

SEQ ID NO: 9694 - DNA, 371 bp, Zea mays
  Clone ID: LIB148-016-Q1-E1-E1
actctcttcctcagctcttctctgcctgcctgagctcaccgcacctcgcctcctcaccgcgtttcctccgttaatccggtagaaaatggccgatgccgaggatatccagcccctcgtctgcgacaacggaactggcatggtcaaggctgggttcgctggcgacgacgccccgagggccgtcttccccagcatcgtggggcgcccgcgccacactggtgtcatggtcgggatggggcagaaggacgcctacgtcggtgacgaagcgcagtccaagaggggtatcctgaccctcaagtaccccatcgagcacgggatcgtcagcaactgggacgacatggagaagatctggcatcacaccttctacaacgagc

SEQ ID NO: 9695 - DNA, 383 bp, Zea mays
  Clone ID: LIB148-016-Q1-E1-E11
aatcaaggtcatggtctcccgcggccacatcgacggcaagctccgctacggcttcaacggcatctcccacagggaccccgagacccccgtgaagctcgctgaatacttcaacgtcaccgacggggtgttcagctacaaccagatgggcgacgtgccccccgccgtgaacggtcccctccatgtcatccccaatgtcatcaccgccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaaagtgtac

SEQ ID NO: 9696 - DNA, 414 bp, Zea mays
  Clone ID: LIB148-016-Q1-E1-E12
cccacgcgtccgcccacgcgtccggcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcaaag

SEQ ID NO: 9697 - DNA, 434 bp, Zea mays
  unsure at all n locations
  Clone ID: LIB148-016-Q1-E1-E2
agccacgtcagcaccagagtcatgggcacctacggctactgcgcccccgagtacgccatgaccggcaagctcaccaagatgtcggacatctacagcttcggcgtcgtgctgctcgagctcatcaccggccgccgcgccatcgacatggccaggccgtccgaggagcaggtcctacttaactgggcttcgcctctgctgagagacaagaggaggttcgtgaagctggccgacccgttgctgggcaacaggtacccagtgaaggcgctgtaccaggcgctcgccgtcgcgtccatgtgcctgcaggaggacgctgccagccggccggggatcagcgacgtcgtcgcggcgctctccttcctcgcccgaccgcantactaccctcccggaggcacngnagctgaacacaagagcacgcatagcgggacagacaatga

SEQ ID NO: 9698 - DNA, 364 bp, Zea mays
  Clone ID: LIB148-016-Q1-E1-E3
ttccgggaagacccacgcgtccaagggatgccagacacgcagtgccccatcgcgcccaacaccaacttcacgtacaagtggcagcccaaggaccagatcggcagcttcttctacttcccgtccatcggcatgcagcgggcggcgggcgggtacggcgccatcagcgtggtgagccgcctcctcatcccggtccccttcgaccagccgccgccggagagcgaccacgcggtgctcatcggcgactggtacaccaaggaccacgaggtgctggcgcgccagctcgacgccggcaagagcgtgggccgccccgcgggcgtgctcatcaacggcaagggacgcaacgaccctgaagccgccgcgccca

SEQ ID NO: 9699 - DNA, 403 bp, Zea mays
  Clone ID: LIB148-016-Q1-E1-E5
acagccaagagctatccatacgcacagcgatgcaccagcacgagatactagccatcatgcgcctgtcgtccctcctcctcgtcgtggccgccctctcggcgcgcgccgcggggcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatctcgtccacccagttccagaagtcggagcactacgcggagattaactactcgctccccggggacgccttcgacgccgtggtgcgcgccaagctggccct

SEQ ID NO: 9700 - DNA, 389 bp, Zea mays
  Clone ID: LIB148-016-Q1-E1-C9
ggaccgcggcagcagcaccacgatgactatcaccaccccgagatcgtccccgagaagatcatacacgaggacgcgttgccggtcgttgctgcggagaaggagactgccgccgccgccgcaacctcgaaggaggaggaggaggtggagtcgcccaagaaaggagcggctctgtcgccggtgccggaggctatcgtcatcgccacagccgcaacctcgaaggaggaggaggaggaggtggagtcgcccaagaaagaagcggctctgtcgccggcgccggagcctatcgtcatcgccgccgccttaacctcgaaggacgaggaggaggtggaatcgcccaagaaagaagcggctctgtcgccggcgccggcgccggaggccatcgttgccgt

SEQ ID NO: 9701 - DNA, 395 bp, Zea mays
  Clone ID: LIB148-016-Q1-E1-B2
gccagcggggctccctctgacgactccgcgcttcctctggtgcacggccgcctctattgccgtcgcctggggcttctgctgcgttaccatgggccaaacagcgaggaaaatgccgagagagaggtagagacagtttggtcgtcgagtcacatggagggtgccctggtggccggggaatccttcacctgcggggtgctacatcgccgggctgctgcatcgtggtctgcctctactaccagggctgactccattgccggacagccaaaactctcggtcgagtctctgaaggccgtctgtccctgttccttccgaacgttggtgattatgatactggggcgcctaatcgctgtcgccggtgagattcggccgccagattccaaggcgccgccgggctg

SEQ ID NO: 9702 - DNA, 308 bp, Zea mays
  Clone ID: LIB148-016-Q1-E1-B4
cacgcgtcgatcctccgtgaaagccgacgtcgacgtggacgccaacaacgaggccgagcaatggatgcgctcggagccggggacctccatgtcgccgtcatcggaagccggcgacaacacggtcatcagtacactcaacgatgtccccggcgcgcgccttcgcggggcacacgctcgaggatgccgcctcggcggcaggcgccgtcccggcggtctcgtctcgttcggatgctccatagcgtatgaaggtcgctcccgctgctggaccctcggtgctggcggtcgatgaagcaggccgcggcgtgccg

SEQ ID NO: 9703 - DNA, 395 bp, Zea mays
  Clone ID: LIB148-016-Q1-E1-B5
agagagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccacgtccggcaagcctctgtggtacaaagggtcgacgttccacaggatcatcccggggttcatgatc

SEQ ID NO: 9704 - DNA, 409 bp, Zea mays
  Clone ID: LIB148-016-Q1-E1-B6
agcactagcagtagcgattgggttgcaagatggctttaactgctccctctttgcaacagcaactatatttgcaagtgtggtaatgtacgatgcttctggtatcagattgcatgctggaaagcaagcagcggtactgaaccaaatagtttgtgaacttccttctgaacatcccttgtctgaaacaagaccactgcgagaacttttaggccatacaccaacccaggttgttgctggcgcattgcttgggtgtacgatagccacagcaggacaattattcgtttgaactccgaaggtgcaggagaaatgttgtagcatttgcatcgcggggacttgagaagaagtttctctagtgttctgctactttaggtattggtaagattttcaacttggtgctgtagtgttgtccaat

SEQ ID NO: 9705 - DNA, 403 bp, Zea mays
  Clone ID: LIB148-016-Q1-E1-B7
aggatgccgcgctgccgctacggcttcttccacgtggtgaacaacgactacacgcactggatcatgtacgccatcggcggcaacatgaaccccaccatcatcagccagggcaaccgcttcatcgcccccgacgaccccaacgccaaggaggtgaccaagcgggagtacacgccgtacaaggactacaaggagtgggtgtggaagtcgcagggcgacgtcatgatgaacggcgccttcttcaacgagtccggcggccagaacgagcgcaagtacgacaggttcgacttcatcccggccaagcacggccgctacgtcggtcagctcacgcgcttcgccggaccactcaagtgcatcgtcggccagccgtgctagtagacagcggcccggtcgggcacatactcct

SEQ ID NO: 9706 - DNA, 407 bp, Zea mays
  Clone ID: LIB148-016-Q1-E1-B8
acccacgcgtccgattcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtccccaccggcgccgagaaca

SEQ ID NO: 9707 - DNA, 387 bp, Zea mays
  Clone ID: LIB148-016-Q1-E1-B9
gaattagccggcacttaggccaagaatggcacgcctcgccggcgtggcagtggccctagcagccatcgccgcggtggtcggcgcccacgagacgtactacgcgtccgtggagaaccgccttccggcgctgggcatgaagctggcgtgccacgcgatgggcgggttcctgacggagctcagcgtggtgccgcgcggccgtgtgccccacggcagggccgggcgccgcgtcgccgagctgctggtggagcgcggccagcacggctgggttcgctgcaactgggcgtacgcgggcaactacgtggccgggatcacggtgctggactcgcggtggcccgaggctgggcggtgccaggaccccgccggcgaaagcctgtgccgcgtcgtcct

SEQ ID NO: 9708 - DNA, 381 bp, Zea mays
  Clone ID: LIB148-016-Q1-E1-C1
cttcggcctccaactatcaccacccgggacgtcttccatggcctcctcgtagtagaatagttctatctcaccgcaacaactcctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctcctccaacaacaacatcgtcgtcaacgt

SEQ ID NO: 9709 - DNA, 83 bp, Zea mays
  Clone ID: LIB148-016-Q1-E1-C11
cacatgcatgtatacacatcttgtaacgctgaattttgattcatggcacactgtactggacgaggatcatttttttcttgcct

SEQ ID NO: 9710 - DNA, 416 bp, Zea mays
  Clone ID: LIB148-016-Q1-E1-C12
agcttgcatatgtggctcttgaatacgaccaggagctcgagaatgccaagagcagctcatctgtggagaagagctacgagctgcctgatggtcaggtgatcaccattggggcagagaggttcagatgccctgaggtcctcttccagccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccgtatgagcaaggagatcactgcccttgcgccgagcagcatgaaaatcaaggtggtggcaccgcctgagaggaaatacagtgtctggataggaggatccatccttgcctccctgagcaccttccaa

SEQ ID NO: 9711 - DNA, 314 bp, Zea mays
  Clone ID: LIB148-016-Q1-E1-C2
ccacgcgtccgacttatcttgttactgtactcaaggttcattattttattcatgtatgcagtatattcacattaaaaaaaaaaaaaaaaaaaaaaaaaaaaaaaaaaaaaaaaaaaaaagataaaaaaaaagataagggaggcagctcaaacagataaaatactagattgagcgaaaatgcaacttaaatggcgctcccctctaggcacgtactgtcaagtccagtcgccgtcgtttaacctggtacggccctgagaatcccttgctgttcttcaactgactcgtcttgttagaaaccccctttccgctggccg

SEQ ID NO: 9712 - DNA, 405 bp, Zea mays
  Clone ID: LIB148-016-Q1-E1-C3
ttccgggtaaacccacgcggtcgaaaaacatagagagtcgacttttctattggtgtgattgggggcactaaatacctaccacattgcactcagactacatatactgtgtttgtgtgttgtatgccgtatgcgtgtgtgagcttgcgcaaattggacatctaggccgtgcgtaccctgcgatgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtaaagtccatcaagtccttctgccagcccgtggactacagggagacgtgcgagaaggcgctggaggcggccgccgggaacgccaccagccccacggagc

SEQ ID NO: 9713 - DNA, 310 bp, Zea mays
  Clone ID: LIB148-016-Q1-E1-C4
ttccgggcaaaccacgcggtcaaagaaccaagaaagcagggtgtgggcgaagagaccccagccagtcgatcgttcaagaacattaccagcttaccaacatcagcagcatcagtctcacccgttcgatgacatggtccgcctcggcgccggcgccgtgttggcgctcctagtggcggtcgctgcggtggccgcgttcctcgcggtgccggcctcgtgcgacgtccggggagctgaacgcgatggggttgctggctgagaagggcggcagcatggcgggcccgcagaagtgctcgggctctgtgggcgagtg

SEQ ID NO: 9714 - DNA, 319 bp, Zea mays
  Clone ID: LIB148-016-Q1-E1-C5
agcgccactccttgtaccagggcctgtacgcccgcagcgtggcggacgcccgcatccgccccgcgctccgcctgctgaagcagaatctgtcgttcctggtgtccgtgctcgcggaccgcgcgcatcccgtggcggtgcgggaggtgatgcgcgcctccttcgaggcgttcctgatggtgctcctgtcgggcggcaacgatcggagcttcgtgcgcgccgaccacgccacggtggatgaggacttctggagcctgaggcgcgccttctccacatgtggcgaatggctggtccccaaagacgtagtggcatcggaggcaaa

SEQ ID NO: 9715 - DNA, 414 bp, Zea mays
  unsure at all n locations
  Clone ID: LIB148-016-Q1-E1-C7
atgataaaccgagtggaatacatgcattccaagggatttattcatcgtgacatcaagccagacaacttccttatgggcttaggtcggaaagctaatcaggtctatatcattgattatggacttgctaagaaatacaaggaccttcatactcataaacacatcccgtacagggagaacaaaaatctgactggaacagcacgttatgctagtgtgaatactcatcttggaatagaacaaagtaggagagatgatctggagtctgctggctatcttctgctatattttttaagacgaagcctcccatggcacggtcttaaagctggcactaagaaacagaagtatgacaatattagtgaaaagaaaatgcttacgtcagcagaggttctttgcanatcttacccgtcggagttcgtc

SEQ ID NO: 9716 - DNA, 415 bp, Zea mays
  Clone ID: LIB148-016-Q1-E1-C8
agcaccaccacctccatccgtgcgcctctcgctctcgctggtggtgctcctcctcctccacctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaacagagcatcgatggaggacttctatgaggcacgaatagacgacgttgatggagagaaaattggaatgttcggtgtatatgatggtcatggaggagtccgagcagctgagtatgttaagcagcaccttttcagcaatttaatcaaacacccaaagttcatcactgataccaatgctgctatc

SEQ ID NO: 9717 - DNA, 418 bp, Zea mays
  unsure at all n locations
  Clone ID: LIB148-016-Q1-E1-B12
acccacngcgtccgcgggacgcgtgtggtctgagatcgcgaggcggccccccttgttttttttttgtttcctactacgtttttcaactagcgattcctcaatgcatttgcggttttttcagtcgacattgcttcaataggacatagcatttcattaaagtttgcagggcatcgtagaacgagaatggttctcccttcaaaaagcaaaacacgggaaactcgtatagtcgatcgacgaccatgcatcacatttccttttcctcgatcatcgcttatttccgcggaaaacaacgaaggaaacccaaccaaggaaacgcatgctattgcttaagcatcgccggaggagctggtcgatcgctcgctcactcaggggcctgattgttccggtcacctgtcgtcgtcgtcgagctgagacacgc

SEQ ID NO: 9718 - DNA, 430 bp, Zea mays
  Clone ID: LIB148-015-Q1-E1-H6
agcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaccagcagtccgcggacagcggcgggtggtgcaac

SEQ ID NO: 9719 - DNA, 347 bp, Zea mays
  Clone ID: LIB148-015-Q1-E1-H7
cggacgcgtggcggacgcgtgggtctacgacgatgtcatccctgccaactggaaggccaacaccgcctacaccgccaaataattaactttagtgctgacaatactttaagccgacctatgctagctatactagattgggttggatcccaagcaatgcattacacatgcatgcattggaccgtgatatctatttgctaccactaccctattacgacagtgatgctggcgccaacaatgatggtgtcatcctccttctccatcttcttcatctccatatatagctagagtgagacttcgctgttgtttaaaagagaagagttaagaaatggattgacaagttatataat

SEQ ID NO: 9720 - DNA, 409 bp, Zea mays
  Clone ID: LIB148-015-Q1-E1-H8
cgcagcaccactggggcgtgcgcggggagagcgacggcgacggcgtctccgtgatggggtccagcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgctttcgcgccgtcgacgacag

SEQ ID NO: 9721 - DNA, 415 bp, Zea mays
  Clone ID: LIB148-015-Q1-E1-H9
agcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggctggagtcgtgcagaccgacccccgctgcctctgcatggtcctggacggcaccgccacgtccttcggcatcgccatcaaccagaccagggcactggagctccccggcgtctgcaaggtcaaggcgccgccgctcagccagtgcacaggcatgtcatgtgtcaggtcatcgttcaaatgcaaaccattgccagtttctgttgccgcttagaatcctagtacgtacctggtctcaggcgtccctgcggcacctgcaccga

SEQ ID NO: 9722 - DNA, 362 bp, Zea mays
  Clone ID: LIB148-016-Q1-E1-A1
agaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctg

SEQ ID NO: 9723 - DNA, 307 bp, Zea mays
  Clone ID: LIB148-016-Q1-E1-A10
acgcgtgccagtcttcgtctcaagctccgtcgttatttgtaatctgaagcttacatgaagatttccgtggatcatggccgggttggcatgcctcttgactgctctgggtggctttggggatcatccttgcgtagcgcgatctccagacgcgtcgattcgtcggtcgtcctacgacttggcgcggggattcttaggacgatcgtgggtagcagatttgtgacccccatctggcactatgagctaactctctgcgttacagatgccagcgtatcgctcgagctgggtgtgtccgacatcagacacgttc

SEQ ID NO: 9724 - DNA, 425 bp, Zea mays
  Clone ID: LIB148-016-Q1-E1-A12
atcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggttgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcct

SEQ ID NO: 9725 - DNA, 420 bp, Zea mays
  unsure at all n locations
  Clone ID: LIB148-016-Q1-E1-A2
attcccgggccaaaccacgcggtcgatccattgcgcccggagccggccgatcgggggagcgcagcaggcgggccgcgccggccgccgcaccaccgggtagcccaggccgcgcgcgcgcgccgtccagctcgtctgctgtcgctcctccgtgatggccgacgtcgacgtggacgccaacaacgaggccgagcaaaggacgcgctcggagccggggacctccatgtcgccgtcatcggaggccgacgacgacacggccagcagtacacccaacgagtccccggcgcgcgccttcgcggggcacacgctcgaggagccgcctcggcggcgggcgccgtcncggcggtcncgtcncgttcggatgctccagagcgtgtgccggtcgctcccgctgctgaacccgccgtgcgggcggccgatgat

SEQ ID NO: 9726 - DNA, 373 bp, Zea mays
  Clone ID: LIB148-016-Q1-E1-A3
aaccacgcgtccgatctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcgtcgcccccatcctcgtgatgatcccgatgatcatttaccg

SEQ ID NO: 9727 - DNA, 431 bp, Zea mays
  Clone ID: LIB148-016-Q1-E1-A4
attcccgggccacacccacgcggtcgaacaggcatacaagcacacatacctcgcgagcaacaatgggatccaggtcatccattctacatgcaaccacgaagctggatgcactgtctgcggatgtgttgtgaactagacggctcatattcgacgttggcaacggatggaagcatgtacacgtgcatgacagacaaaccgcagctgccatgggccatcatccgcatcagtgtacatgatcgtgtacctgtagctgcttgctgacagtggccgtcgccgcgacagtgaacctggtgcgcgccatcggggacttcttcctctcacgcaccatgggccccatgttcgccatcatcggcgtcatcgtcgcccccatcctcgtgatgatcccgatgatcatttaccggaagcgggaccccgtgaaacctcgcgctcct

SEQ ID NO: 9728 - DNA, 409 bp, Zea mays
  Clone ID: LIB148-016-Q1-E1-A5
gggccaacccacgcgtccacggagatctacgagctcccggtggacaacgccggcgtcgtcgtcaaggtggacgccagcgccgtcgaggcggtggcgctgccggtgaagcccgccttgcagctggaggagacgggggagcttgagaaggaggtgtgggccaggttctacggcacgggcttctggaggagcgtgtctcagctcgacgacgacgacaggtgaccggaacaatcaggcccgtgagtgagcgagcgatcgaccagctcctccggcgatgcttaagcaatagcatgcgtttccttggttgggtttccttcgttgtttttctgcggaaataagagaagatcgaggaaaaggaaatgtgatgcatggtcgtcgatcgactatacgagtttcttttgttttgcctttt

SEQ ID NO: 9729 - DNA, 423 bp, Zea mays
  Clone ID: LIB148-016-Q1-E1-A6
agagagccttaccctcgaagccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagcccca

SEQ ID NO: 9730 - DNA, 214 bp, Zea mays
  Clone ID: LIB148-016-Q1-E1-A7
acgcgtccactctacctgaactacacaacaatgttgttgctgctgctgttgtacaagatctttttttgtgctcgcttgtgatgataatatgcatggcaagctccaaaatgtggtttccaatttatgtatagcaaggggttacaaaagttggtaatcataatgcttgtgccctgtagtatcatactattaccacgccaacttaatttcttgtttt

SEQ ID NO: 9731 - DNA, 92 bp, Zea mays
  Clone ID: LIB148-016-Q1-E1-A8
accggcgggggcatccgctgcctcctccttcggcccgtcggctccttctttgcttttgtgagctccctgtgtcgctgggtgtgtgtgctgcc

SEQ ID NO: 9732 - DNA, 401 bp, Zea mays
  Clone ID: LIB148-016-Q1-E1-A9
attcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgt

SEQ ID NO: 9733 - DNA, 382 bp, Zea mays
  Clone ID: LIB148-016-Q1-E1-B1
acacgcgtccggagcgaggaagttcgccatcatcaacgtggggctggtggggtgcgtgccggtggtgcgggtgctggacgcggacggcgggtgcgccgaggggctcaacaagctggctgaagccttcgacgtcgcgctggggccgctcctcgccggcctcgccgacaagctgccggggctgacctactcgctggccaactccttccgcctgacgcaggacgccttcgcggacccgaaggcgtcagggtacagcgacgtggccagcgcctgctgcgggagcgggcggctgctggcggaggcggactgcctgcccaactccaccgtgtgcagcgaccacgacagccacgtgttctgggaccgctaccacccggcccagcgcgcg

SEQ ID NO: 9734 - DNA, 412 bp, Zea mays
  Clone ID: LIB148-016-Q1-E1-B11
cattttattccactgaacatctagatctgtaattgagcttgcgcgcgtgtttcatgatttcgttataatatgtggtcgagcgagcagcaacatttgagttgagaagaatacatgacacccgtgtcaactaaccgcatcattttttagttgatggttcttatgccatggaaattcaacggatgttacagccttttcgtaatagatcatgttaaaaagcacgtgacttttatcgactttacaccgacccaagattggtataagcacatgccatacaagaggttcgcagaagcgattatcatggccttaaagaaatataagattacctacagcaagaaatgttctggatgggaagaggatatttttaagtgaaaacatacaatttggaatggtgttccaagtgacttaagagagt

SEQ ID NO: 9735 - DNA, 357 bp, Zea mays
  Clone ID: LIB148-015-Q1-E1-H5
cagacgaccagcaggaggtacgagcaagaccacctaggaggcctctctctctctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactga

SEQ ID NO: 9736 - DNA, 250 bp, Zea mays
  Clone ID: LIB148-015-Q1-E1-G11
cacgcgtctaactctcttccctctatcgggtttcgtcacgtgtgttctctcgttgtctaatgccgccatctacacttctctacttaatcatcgacatggctgtctcgcggcacgagaccggtgtacagcatggggagctcgatgaccatcgtggcgtcctccctgctccgccgctccctcctcctcctggctttcgcggcgaccgccgatgcttgcgttttcctttagctgtttggcgaggaccaattct

SEQ ID NO: 9737 - DNA, 422 bp, Zea mays
  Clone ID: LIB148-015-Q1-E1-G12
gcccgggccacggcatcagcgtcggcagcctggggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccctgccagggcgtgcagctcatcaacgtcgacatcaagtacaacaggtccgacaacaagaccatgtccgtctgc

SEQ ID NO: 9738 - DNA, 406 bp, Zea mays
  Clone ID: LIB148-015-Q1-E1-G3
agcagcacagcaaggaggagagcgcctgggccagatcgccgccatcgccatactcgcactcaccggagtggtgcgtgcgaaaattggccgccgggcaattacgcggtgactccagacgggtgagcggatcgtcgtttgggcgattagaccttcgtgccaccgaaatcgcgagctgcaagaagaatccgcggtcagttcgtcgagctctgcgggcgccatcatctcgggttcctcaccggcgagcggtgaggtcacgaggatctgaagaatcactctggtaactggaatctcaagtgccaggtcaagaacaggtaccacaagatgaggcacatggaggatgctgtgatgagttcgtgagtggtctaggtcgtcgtctccagtcaactttgggttgccggaccgttgt

SEQ ID NO: 9739 - DNA, 367 bp, Zea mays
  unsure at all n locations
  Clone ID: LIB148-015-Q1-E1-G4
gctgctactacacgctcctcggcatccgcaagaacgcctccgccaccgacatacgcgccgcttaccggaggctcgcgatgaagtggcacccggaccggtgggccagcgaccccggcgcggccggcgaggccaatcagcggttccagcggatccaggaggcatactccgttctgtcggacaaggggaagaaggccatgtacgacgccgggctcttcgaccccctcgacgacgacgaccaggatttctccgacttcatgcaggagatgctggtgatgatggatagcgtgaaaaacgagaagccggacacgctggaggacctgcagaagatgctggaggacatcgtgaagggcgacggcggnggcgggag

SEQ ID NO: 9740 - DNA, 346 bp, Zea mays
  Clone ID: LIB148-015-Q1-E1-G5
aagcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgag

SEQ ID NO: 9741 - DNA, 359 bp, Zea mays
  Clone ID: LIB148-015-Q1-E1-G6
agtgctttgagaaattgatgcgtagattgcgaggaaatttcaaatgcacagatcaatctgtgggagtatccaaccaacttcaacatcttgcatctattattcaggttcttgacccaaagctacatgaccacctagaaactcttggcggaggtgactacctttttgcgttccgaatgttcatggtgctatttaggcgtgaagtatcatttggagactccttatacctctgggagatgatgtgggctctagaatacgaccctgacattttcttcgcaacatgcgaagaacaaggtgcagtacataaaaataaagtttctaaatccaaactgaaaggactgcgccattttggcaagtgggat

SEQ ID NO: 9742 - DNA, 372 bp, Zea mays
  Clone ID: LIB148-015-Q1-E1-G7
agaacatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccagga

SEQ ID NO: 9743 - DNA, 139 bp, Zea mays
  Clone ID: LIB148-015-Q1-E1-G8
gcacacgatgtgttcccctgctaatgctcggtctcagtatgctggttctgggtgctatggcacacgtcgtattgaaattgttgagtgctgatgattatttctctgcgtccattgcaggcacggcatttagcaatcgtga

SEQ ID NO: 9744 - DNA, 411 bp, Zea mays
  Clone ID: LIB148-015-Q1-E1-G9
accacgcgtccgatagatcttctcatggagtcagcttcatgcttgcgtgtattagatttgagcaagacagcagtggaggccatcccgaaatccattggtaacttggtacatttaaggtacctcaatcttgatggggctcaggtcagagacataccttcttccattggatttctcataaacttgcagaccttgagccttcaaggttgccaaagcttgcagagacttcctcggtccatcagggcattgctagagcttagatgcctttgtctctatggaacttccctaagctatgtaccaaagggtgttggtaaattgaagcatctcaatcatctagatggtctaatcattggtcatgacaacaatgcgcctgagggttgtgacttagatgaccttaaagcattgtcagaacta

SEQ ID NO: 9745 - DNA, 392 bp, Zea mays
  Clone ID: LIB148-015-Q1-E1-H1
acaagaaacaatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgttgccgctgccccatcgtcgtcgtcgtctaggaagtctggtccagctgccgcgccgaccaccgccgcctctacaccgtcttcttccacggacgaggagttgagccctt

SEQ ID NO: 9746 - DNA, 404 bp, Zea mays
  Clone ID: LIB148-015-Q1-E1-H10
gcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgcca

SEQ ID NO: 9747 - DNA, 417 bp, Zea mays
  Clone ID: LIB148-015-Q1-E1-H11
ctccaacggtgaaatctccttcaccaccatcacctccaccgatgattaaatcaccgccaccaccggtgccggtgaggtcacctccatcgtcagtgaaatcaccgcctccttcaccactgttaagttcgccgccgccaccagcgcccgtgaggtcacctccaccgctaacgaaattatcacctcctccaccaccgataaggtcgccacccccaccacaagcaaactcacctcctccatcagctccaataagctcacctcctcctccgatgcaatcccctccaccgcctgctccagtcagctcaccaccaccacctataaaatcaccaccacctgtaaaatcacctcctccaccggctccagttagctcaccaccgcctcctgtgaaatactcttcaccacctactccagtcaactcac

SEQ ID NO: 9748 - DNA, 420 bp, Zea mays
  Clone ID: LIB148-015-Q1-E1-H12
gcgagcgggcatgtggaacgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccatccagtctaactaatccattcctgtgctgctcggcgaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtttaaaaaacaatca

SEQ ID NO: 9749 - DNA, 385 bp, Zea mays
  Clone ID: LIB148-015-Q1-E1-H2
atctcactcaccacgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctg

SEQ ID NO: 9750 - DNA, 400 bp, Zea mays
  Clone ID: LIB148-015-Q1-E1-H3
aggacgcgtgggcggacgcgtgggccgccacacactagtcggggaaaacgatcgaacgagcacaggcacgcacgcaccatggcccgcgctctcgccctcgcctccttcctcctcgtcgcctccgccaccgtggctttcgccgcggaggccccggtagcctcgccgaagcattcggcctccacgccgtcaaaggcgcccagcagttcgcccgacaagtccgagaaggcccccacggcgtcggctgagaatgctgcagagacgccgaaggcaaccccggccaaggccccggcggcggcctccaagtcagaggcatcgccttccgaggcgcccgactccgggtccagcgctgcgtcacctactagcgagagcgccgcgtcagagaaggccccgccggtgcccc

SEQ ID NO: 9751 - DNA, 402 bp, Zea mays
  Clone ID: LIB148-015-Q1-E1-H4
attaccgggccgaccatgcgtctgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccggctcaagaacgtggagagcggggagattcagctgcagctgc

SEQ ID NO: 9752 - DNA, 373 bp, Zea mays
  Clone ID: LIB148-015-Q1-E1-G10
ggaccctgttcctcgaacacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcacctgccgtcgcacgagctgctgcagccctgc

SEQ ID NO: 9753 - DNA, 384 bp, Zea mays
  unsure at all n locations
  Clone ID: LIB148-015-Q1-E1-E4
attaaatctgtaggaggatgatgtatgggcgtgcacggcattagattctattgctgtttgtttggctcacgataatgatcatagaaaagtggagcaggcactgttgaaaaaagaggcaattcaaaagttagtgaagttcttccaagactgcccagaacagtattttgtccatatattggactctttcttgaagataataatgaaatcttctaggctaaacacagcaatggccaccaatggcttgacagcattgctcattgcaaggcttaaccatcgagacgctattgcncgcctgactctgctgaaactcataaaggttgtctatgagcatcatcctcgaccaaaacaggtcatagtagagaaatgactccctcagaagctaca

SEQ ID NO: 9754 - DNA, 423 bp, Zea mays
  Clone ID: LIB148-015-Q1-E1-E6
aaacatcggaagcgatgagatggtgagcatgaacgagatggctgagatcgtgctgggctttgaggataggaagctgcccatccaccacatccctggcccggaaggggtccgcgggcgcaactctgacaacacccttatcaaggagaagcttggctgggccccgacgatgaagctcaaggatgggctgcggttcacctacttctggatcaaagagcagatcgagaaggagaagacgcagggggtcgacatcgcggcgtacgggtcgtccaaggtggtgtccacccaggcgcccgtgcagctgggctccctccgcgccgccgacggcaaggagggcctctaagcgacgacccaaggctggggctgtcttcgtccatcacagctggcgtaccatggcaggatatactgtttgcggtagaatatcac

SEQ ID NO: 9755 - DNA, 347 bp, Zea mays
  Clone ID: LIB148-015-Q1-E1-E7
gacaccgtaacagtgctaaaaatgcatgtggacgctttcaacaatcgcgtgaagcgccgctcagaggctcgccacggacgaggtcaagacggccgccactcacgaggcgcggcgggcgctgaacctctgtaatacctactacctgtacgccgccgacaaactcagctcctgcaactcgcgccatcaagtcttccgctcactctctcaccatcctcgccacgataaccatgctggttcatgacacgcaaaactgcaactaagaattctcgaaagccgtctccaggaaccccatggctgaccacaacaggtcgctcatcgtgatatccgatatctgacacacgcgctcc

SEQ ID NO: 9756 - DNA, 401 bp, Zea mays
  Clone ID: LIB148-015-Q1-E1-E8
agcggaccagaagcccggcgactacctgctggtggcgtccacccggttcatcaaggagaagagcagcaccacggccgtgatccgctacaagggctccagcgccccgccgccggccaagctgccggagggccccagcgggtgggcgtggtccatcaaccagtgcaggtccttccgctggaacctgacggccagcgcggcgcggcccaacccgcaggggtcgtaccactacggccagatcaacatcacccgcaccatcaagctcgccatgggccgcggcaaggtcgacggcaaggagaggttcggcttcaacggcgtgtcgcacgtggacccggaaacccccgtgaagctcgccgagtacttcaacgccagcgacggcgtgttcaagtacaacctcatcgggg

SEQ ID NO: 9757 - DNA, 390 bp, Zea mays
  Clone ID: LIB148-015-Q1-E1-F1
aaaagaaagaagcaatggagggaaagcgtcgttcacgagattcatcaagaaacagtgggtaagtgaatagttgacatgtgtagagtgatcaggtaactactgaccagcaacaccccagcaccaccattttgcagcatttcttctgttgtggcacttccttgatcacattcacatgtaatatctgggagttctgatctagaactagattgaagtattgaattgctactgtggaggtggctgctgcttatagctctcatcccaagtgaggagcatgccttgtcctcagcaaggtccttgcccaggaatgtaggcagctttactcagccctttgaccttgatggcacatacaggttgaaagattaacgatgccaaaatgatatggcttgtata

SEQ ID NO: 9758 - DNA, 404 bp, Zea mays
  unsure at all n locations
  Clone ID: LIB148-015-Q1-E1-F10
accacgcgtccgggaagcccaggcggcctgacatgctcactgacacttttgggtttggccggatcatacatgatggcctcatgttcaagcagaacttctccattaggtcctatgagattggggctgataggacggcatctatagagacaatgatgaaccatttgcaggaaacggcacttaatcatgtgaagaccgctgggctgctaggtgatggattcggctccacaccagagatgagtaaacggaacttattctgggtggttagccagatgcaggctatcgtcgagcgttatccatgctggggtgatactgttgaagtaaatacatgggttagtgctaatggtaaaaatggaatgcgtanggattggcatatacgtgattctatgacaggccacacaatactg

SEQ ID NO: 9759 - DNA, 410 bp, Zea mays
  Clone ID: LIB148-015-Q1-E1-F11
ctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtg

SEQ ID NO: 9760 - DNA, 136 bp, Zea mays
  Clone ID: LIB148-015-Q1-E1-F12
tcccgggatcagcttgcggcatgaatgtaatcgttcagatcttaaccgaaattgcattcgtgtcagagacgactctacccaatatggatcaggaagaaatgtatcagtgatcgcatcgataaacacagtttgtctg

SEQ ID NO: 9761 - DNA, 387 bp, Zea mays
  Clone ID: LIB148-015-Q1-E1-F2
accacgcgtccgaccacgcgtccggggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgatgagtaagacgggcttctggggt

SEQ ID NO: 9762 - DNA, 422 bp, Zea mays
  Clone ID: LIB148-015-Q1-E1-F3
aggtaaaaatgacgagtccatggaagattcaacaaggaaatgtattgaaatgctttgtgctcctgatggtgagcttcctgagaagctgaggaatctagaacctcgccttattgaacatgtcagtaatgaaataatggatagggatcctaatgtccgctggaatgacatagctggtttggaacatgcaaagaagtgtgtgacagagatggtgatatggccactgctacgtcctgatatattccgtggttgtcggtctcctggaagaggtctactgttgtttggacctcctggaacaggcaaaaccatgattggaaaggcaatagctggtgaagccaaggcaacatttttctacatatctgctagttcactaacaagcaaatggattggtgagggtgaaaaacttgttcgggcactttttggtg

SEQ ID NO: 9763 - DNA, 414 bp, Zea mays
  Clone ID: LIB148-015-Q1-E1-F4
gtgttccgcagcggcgggtcccggaggttgagccgcgcttcgtcggcggcgtccccgcggtacgcgccgtcgccgtagcccagcacccagaagtcgtggccgtggaggtgccacgggtgcacctcgctgacgttgcgcgacagcgcgttggcgttctggagcagcacgtcgacggtggtgttgtgcgccaggacgtacacgttgtcccccaccgtcgtgttggggttcggcggcggcagcgtcacgtcgtattcccggctgaacgtctccgcggggcgcgccgccgccagcgtcgacttgagccccatcttcagggagcccaggtacggcgtggcgggcagaaacatggacacgttgttgatgggacacctgatgcgcccgtccatccggttctgcgtgttgagcaactcgatg

SEQ ID NO: 9764 - DNA, 390 bp, Zea mays
  Clone ID: LIB148-015-Q1-E1-F5
accgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgattctcttctactaaactcaacgacga

SEQ ID NO: 9765 - DNA, 314 bp, Zea mays
  Clone ID: LIB148-015-Q1-E1-F6
acaggacttcgactcgtgcgaccgccccttcacccaggccggcgtccccaaccccatggggaagtttgacaaggagctcaaccagatggccagcaactgcatggctcttgcaaacatgatatgaaccacgcatgcaaccccagcgtgaggtgccatcgcatgcagggaatgcttgcattcatttttcatttaattaagaattcattgaaattatgagttatatatattgagtaactctatgtatttgttcctgacctgcactatttattcaatagtatgtcatgaaacgaggtagagcgcctttcattgccttt

SEQ ID NO: 9766 - DNA, 413 bp, Zea mays
  Clone ID: LIB148-015-Q1-E1-F8
acttgagaggaatatacagagccactggaatcaagcagttcatggtctcactgcaaatgtgcgcaagatgtttttggacatggacagtgaactatttgaagagtgccagcagcagtacatggagaaacaagcgaaagccaaagagatacaggaacaacgagaatcagcatggagacaattggaagctgttgttgctgccaaggctgctggagatgacatggttttggtcaactagatgatagctgctcacttatttcatgagcgtcatgtgcgcttatcgaggcaacaaggtatcggtgctagttgcggtgctcttatatcaacattgttgacttgggactatcagatccatgttccttgcatcagtgcaaaaaaatgcggaccgagtttgaacacattggtggcaacgaaag

SEQ ID NO: 9767 - DNA, 418 bp, Zea mays
  Clone ID: LIB148-015-Q1-E1-F9
aaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaacctt

SEQ ID NO: 9768 - DNA, 394 bp, Zea mays
  Clone ID: LIB148-015-Q1-E1-G1
accacgcgtccgaccacgcgtccgcgaattcgcctccgccgcctgctcgatccggtgggaactcgccgctgccgggttgttttcgctgggtgattaaggctcgggattcgagatctacgcgagtcgcgggcaagcagccatgagcgaggtgttcgagggctacgagcggcagtactgcgaggcctccgcctcgctctcccgcaagtgcaccgctgcctccgccctcgatggggagaagaagaagcagaagctgtccgagatccaatccggcgttgaggaagctgaatcgctgattcgtaagatggacctggaggcaaggagcctacagcctagcattaaggctggtttgcttgcaaagctgagggagtataaatctgacctcaacaacgtcaag

SEQ ID NO: 9769 - DNA, 378 bp, Zea mays
  Clone ID: LIB148-015-Q1-E1-E3
acctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgac

SEQ ID NO: 9770 - DNA, 387 bp, Zea mays
  Clone ID: LIB148-015-Q1-E1-C9
acaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtga

SEQ ID NO: 9771 - DNA, 369 bp, Zea mays
  Clone ID: LIB148-015-Q1-E1-D1
agcgcatgaataatttaatgatatcacttgcccacaagttcacgaagttgcgagttctcactcgccggcagaacacacctcagcttgaacacagtgccgtacaagctgttgccaactactgccatgacctacgtgagttacacctcaccagaagcttcaggcttattgaccgctccttgtatgcactggcccatggatgcccacggcttacaacactgaacattagtggatgttccactttcagcgacactgccttgatttaccttagctgccgctgtagtcacctcaagtgcctgaacttgtgtggatacgtacaggctgttactgacacagctttgcacgctattgctcacaactgtgggcagctgc

SEQ ID NO: 9772 - DNA, 399 bp, Zea mays
  Clone ID: LIB148-015-Q1-E1-D11
gccggcggcagcgtggacgcccacgacggcgtgctgtcgctggggaacggcgacatgtccttcgccgtccacgccgccaagcgcttcgggcagcgcttctccttctgcctgctcagcgccaacagctcccgcgacgcctccagctacctcaccttcgggcccaacccggcggtgatgggtccgggcaccatggagacggacatcctgtacaacgtggacgtgaagcctgcatacggggccaaggtgacgggcgtcttggtgggcggggagcggctggacatcccggacgaggtgtgggacgccgagaggtttgtgggcggcggtgtcatcctagacacgagcacgtcggtgacgtcgctggtgccggaggcgtacgcgccggtgacggcggcgctggac

SEQ ID NO: 9773 - DNA, 411 bp, Zea mays
  Clone ID: LIB148-015-Q1-E1-D12
cagggcgccgtcggagccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaaccagtgccagcattcttacaattgcaagatcctcgcgaatagcttggtgctggattttgtgac

SEQ ID NO: 9774 - DNA, 331 bp, Zea mays
  Clone ID: LIB148-015-Q1-E1-D3
acatgcgtccggaagggcgctacacgacgaagtcatgcagcacgatgtagccgccactgaatctgaacatatgcgtgcgtgtaaaaccgataagaatcgaggaaaaacgggtttgacctacgggcctcatgtgtcagcgacaagagcatgtgaggcggttgcctcagcgcgatacggcgatggcagggaaaacgatgtacgcacaatcgttgcatgactacatgacatgaggtaagactgatggacgactcgacgtagacagttggtacacaaagggagtagtccacagctcgacgaggtagtcagggtatcagatgcaagcgacttgctg

SEQ ID NO: 9775 - DNA, 427 bp, Zea mays
  Clone ID: LIB148-015-Q1-E1-D4
aggaggcacccgaagcagcgcacagcaacagagcacacgccgcacaccgccgccgcctccgcagcagcagcagcaatggcgcgcgccggcgctctctgcctggtgctgctctgcctcgtggccgtgcactcagccacggcgcagaagtccacgacagccccggccgccgcgccggccgccgccaccaccccgccggcgaccccgaccaagaagtcgcccgcgcccgccgccgcgccgcccaccaccccggccaccctggccccggccgccgcgccgcccaccacgccggccacccccgcgcccgccgctgcgccgcccactacccctgccaccctggcacccgccgcggggccgcccaagtccgcccccaaagggtcccctcccggccccgtcgccaaaggccaaggccaccccgccggtggccgaa

SEQ ID NO: 9776 - DNA, 414 bp, Zea mays
  Clone ID: LIB148-015-Q1-E1-D5
agaccgattaacccaccaccgcctcgcctcgtctccgctctcttcctcggacaaagccggggccgttcggcgggaggcaggggacgcacgggcaggcagccatgaacggcatcaaccccaacggcgggttcctgtcgtacgggaacatggagagctatgcgatgtgggtggcgaccggcgtggcgtcggccttcttcgcgtccctcgagcgctgctcctgcatccacctccacaccgcggaggacgacggcgacgaggaggaggaggacctcgaggaggcccgccgctccttctcccgcccgatccctgagtactactacgaccggtccggctcctccgcctccgtcgccaagatgtgacctgaccgaaccgcgcctccctccgcccaagaaatgcgtggtgatacgattcgtt

SEQ ID NO: 9777 - DNA, 379 bp, Zea mays
  Clone ID: LIB148-015-Q1-E1-D7
aaacagctcccgcgacgcctccagctacctcaccttcgggcccaacccggcggtgatgggtccgggcaccatggagacggacatcctgtacaacgtggacgtgaagcctgcatacggggccaaggtgacgggcgtcttggtgggcggggagcggctggacatcccggacgaggtgtgggacgccgagaggtttgtgggcggcggtgtcatcctagacacgagcacgtcggtgacgtcgctggtgccggaggcgtacgcgccggtgacggcggcgctggacaggcacctgtcgcacctgccgcgggtgtacgagctggagggcttcgagtactgctacaagtggaccttcaccggcgacggcgtggacccggcgcacaac

SEQ ID NO: 9778 - DNA, 384 bp, Zea mays
  Clone ID: LIB148-015-Q1-E1-D8
aatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcatgaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagatt

SEQ ID NO: 9779 - DNA, 417 bp, Zea mays
  Clone ID: LIB148-015-Q1-E1-D9
agtgggatcgagttgtttcactgcacgagcacatcctccggcgaccaccggcctccctctccgtcctctagcgaccgaccaacgcgtcgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatccgggggcatcactgtgaagaaaacagggcagtcactcatcattggcatctacgac

SEQ ID NO: 9780 - DNA, 392 bp, Zea mays
  unsure at all n locations
  Clone ID: LIB148-015-Q1-E1-E1
aatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcngcgggctgcgccgctg

SEQ ID NO: 9781 - DNA, 423 bp, Zea mays
  Clone ID: LIB148-015-Q1-E1-E10
agcctcgtgccttcacttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagaagacagacgacgacaccacgagccccaggaagagagccatcgcggctgctga

SEQ ID NO: 9782 - DNA, 421 bp, Zea mays
  Clone ID: LIB148-015-Q1-E1-E12
acacgcgtccgcccacgcgtccgcccacgcgtccggcctgttctcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgaggagatcctacggggctgcaaccagaacatgcccagcaaggcgctgacgttcagccagctgggcgccgcgaacgac

SEQ ID NO: 9783 - DNA, 394 bp, Zea mays
  Clone ID: LIB148-015-Q1-E1-E2
aaaaaaacttggtagaagcatatgctcaatttgtgaaagattattacattaaaaaaatggagacaccaccatcctcgtatgatcgagaatatctgaaggaaacaactccacatgattctagtaaggttctaggctctggtggttccaagtttgcagtgaggttgcctactttcaagtggcacccaaaaatgacagcgttcgttctgcaaggatcaatacgaggtaccatttggacctatgcagacatgtctttggggaaggcgtttatcccgatgtgttcatgacgaacttgtattatggaggcacaagaatcgctgcttctaaaatcgtgtttacaaatggctcccaagacccatggcgccatgcctccaagcagaaatcatcgaaagacatg

SEQ ID NO: 9784 - DNA, 368 bp, Zea mays
  Clone ID: LIB148-015-Q1-E1-C8
atcggagagtcggagcccggcggccggagggcgacgtcgtccctaataaatactaataatttatcactatacataaccaatatataagccatgggcaagcgcagcgtccctcggtaccctgaggacgaggacaaacgcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcagcgcctccgtgcgcaccgagaaccccaacgagatgatcaccatcag

SEQ ID NO: 9785 - DNA, 307 bp, Zea mays
  Clone ID: LIB148-015-Q1-E1-B3
acggaattatcgacatcttcggatggattggtggacgaagaagcgaggcagcaggaaccaggacaaggaagtgctgaaggtagccatggtctgcaagacacaaaggagcaggacataataaagggaaaggcggctcttgtttccactgaactgctgagggaggatctggttcagagtgctgttagttttctgaaacacccgaaagtagtagcctcttcagatggacagaggcgatctttccttgtaaataaaggactcaccatggatgaaatagatgaagcatttcaacgtctacaaaacccgtcat

SEQ ID NO: 9786 - DNA, 375 bp, Zea mays
  Clone ID: LIB148-015-Q1-E1-B4
agccgccgccgcaggtgcggctcgcttccgtcccccccggtccgcgcgggctgcctgcgggagcagggtggcagggcactccggcaaccacgtgggtggggaggcgacgacaccaccctaggctctgtcctcgcccgcagggtaagattgcagcagcagtgaatttgggagcttgaagcattcatctgagacatggaaaaagtgatctgctgggcatatctccttcaacgcaagcagttctcgaaagaaactcttgattgctgtgtcgtagctcgtgggaacactcctctcccctctctcgtgaactacacatagtgattatatgttccctctatgctcaacagcaagcaggctgatgcgatattttgctgaagt

SEQ ID NO: 9787 - DNA, 421 bp, Zea mays
  Clone ID: LIB148-015-Q1-E1-B5
cggcatccgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaacgcggcgggctgcgccgctgtgtgctgctgcttcccctgcg

SEQ ID NO: 9788 - DNA, 391 bp, Zea mays
  Clone ID: LIB148-015-Q1-E1-B6
accacgcgtccgcccacgcgtccgggagctcaacatggacctcttccgcaagtgcatggagcccgtggagaagtgcctccgcgacgccaagatggacaagagcagcgtgcaggacgtcgttctcgtgggcggctccactcgcatcccccgcgtgcagcagctgctccaggacttcttcaacggcaaggagttgtgcaagagcatcaacccagacgaggctgtcgcgtacggagcggccgtccaggccgccatcctcactggcgagggcaatgagaaggttcaggatctgctcctgctcgacgtctcgccgctctcgctcggcctggagacggccggatgcctcatgactgtgctcatcgccaggaacaccaccatcccgactaagaaggag

SEQ ID NO: 9789 - DNA, 387 bp, Zea mays
  unsure at all n locations
  Clone ID: LIB148-015-Q1-E1-B7
accacgcgtccgaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccangaggagtgcgacaaggcg

SEQ ID NO: 9790 - DNA, 412 bp, Zea mays
  Clone ID: LIB148-015-Q1-E1-B8
agcaagacatacagcacgaaggctgtgcaggaggcatgggcatcggcgtgcggcggcactgggaagcagacaatcctcatacccacgggtgacttccttgtcggacaactcagcttcacaggcccttgcagtggcgacgtgaccatccaggtggatggcaatctgctggcgaccacggacctaagccagtataaggaccatggtaattggatcgagattctacgtgtggataacctggtcatcaccggcaagggaaaccttgacgggcacggcccagccgtgtggagcaagaactcctgcacgatgaagtacgactgcaagatccttcccaactcgctggtgatggacttcgtgaacaacggggacgtgtccggtgtcacgctgctcaactccaagttcgtccacaatgaca

SEQ ID NO: 9791 - DNA, 396 bp, Zea mays
  Clone ID: LIB148-015-Q1-E1-B9
acccacgcgtccgggaacgaggtggaggaggaaggggaggagttcgcagcgtactgccggaggggaaagggaaggagaagggtggaaatggaggaccggcatgtggccaaggtcgctctcggcggggacccccaagtggcactgtttggtgtgttcgatggccacggcgggaaaaacgcggcagagttcgccgcggagaacatgcccaagtttatggccgaggagttgacgaaggtaaacggcggagagatcgaaggagcggtgaagaggggttacctcaagacggacgaggagttcctcaagatggacgagagcgggggcgcgtgctgcgtcacagccgtcctccaaaagggtggactggtcgtctccaacgctggagactgccgtgcggtgctc

SEQ ID NO: 9792 - DNA, 427 bp, Zea mays
  Clone ID: LIB148-015-Q1-E1-C1
attcccttaattaattctaggggcagatcagatcgaaagaaatcaaactaacgtagccatggaagaagctccacgtcattccatgtagttacttcttcagagcgcgcggtggcggccggctagaagctttgttcgttgcatttgaattcatcaccaaaggagaaggcgcctgttggcgttccaccaattccatcccatcgccacaaggtcgtcgatcacgcggatcgtcgcgactgaccggccggcctcctcagccgtccttgttgtgctacaagatcgaggcgacaggatccagccagccacgatgtcggcggccggcgccaccgccgtctgcacgaaggacggcggcctcctcccgctgcgtccgcactgcgcgaggtcgtcctcctccttcgccgccgccgccgccggcatcgtgatctacctg

SEQ ID NO: 9793 - DNA, 347 bp, Zea mays
  Clone ID: LIB148-015-Q1-E1-C10
acgcgtgccactgctgtaactcaacctgccttcataccaccatcaccagtatagtgtcccgcccttttctgacattcgcagcgtggacaggcgttgctgcgcgaacggctcctgtcgggggagtagcttcggcgtcagcggatcagtccgcttctgtgcccctgctgggagcggctctctcaccgacctcggcggctacgtcatccacgagccgcgtctactgcgacagactgcggcgccgggtgtcggatcacctgtcaccggaatacattctgtccccggcggtgaggcttacgtgcatgcacttcggcttcggctcgatcgaccactctatcgtcggggtgccc

SEQ ID NO: 9794 - DNA, 417 bp, Zea mays
  Clone ID: LIB148-015-Q1-E1-C11
agcaagcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatg

SEQ ID NO: 9795 - DNA, 399 bp, Zea mays
  Clone ID: LIB148-015-Q1-E1-C12
acttcatcacgggatgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatacgaggtcgcggcggggcgccgcgacggcatgcgctcgaacatggacgacctcccgggcaacttccccgtgccgggccaccacgtgccgcgcctcaccgagctcttcagccagcgggggctctcccaggaggacctcgtcctgctctccggcgcgcactccatcggcggcgcgcact

SEQ ID NO: 9796 - DNA, 397 bp, Zea mays
  unsure at all n locations
  Clone ID: LIB148-015-Q1-E1-C2
acgtgccacccaacctcctctcgcggtcgcgggggtagggccgggtgagcacgagcgctgcccgctcgctgaaccatggcgggctccgcggtggccgtcgtcctcctgtcggccgtcgcgctgctctgcctgtaccacctccttttcctctccctgtccgtcccggacccggcagcagcagcagcagccgtcccccgccgcgccggtggccaccgtggcagcaacgttccgtccgggtcaggaaccgccaacgtcgtcctccgcttcggcctgtccgggcagccgctccgcctccacgaccccgccgccgccgccggcctcccggacatcgacaccttccgcggcaagctcgancggctgctttctcccggacgacacgaccccggctggtcgcgcc

SEQ ID NO: 9797 - DNA, 387 bp, Zea mays
  Clone ID: LIB148-015-Q1-E1-C4
agtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccaccaggaggacatc

SEQ ID NO: 9798 - DNA, 390 bp, Zea mays
  Clone ID: LIB148-015-Q1-E1-C5
cgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacg

SEQ ID NO: 9799 - DNA, 389 bp, Zea mays
  Clone ID: LIB148-015-Q1-E1-C6
agcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtga

SEQ ID NO: 9800 - DNA, 377 bp, Zea mays
  Clone ID: LIB148-015-Q1-E1-C7
aaccacgcgtccgggtaaggtggccaaggataccgtgtccgagtcacctgctccaagccccgcccccgtctccgccccttagttgcgtgttgggcgccgctgcccgccggcccccggccaccatgcgtcgtgtctgcgcgcgcacgcacgcattgaacgggagatagaatatggtatcgttcaatgcagattgccatgctatagctccagagtttatctacctggtagcaccatgacacgatggcccgttcgtattttctggcttgctcgtacttttcagttccatggttttacaacaccttttactcccagcagaaaatacataatatgcatgtactcctctttttttccgtatagtaatataaacaaattttcac

SEQ ID NO: 9801 - DNA, 406 bp, Zea mays
  Clone ID: LIB148-015-Q1-E1-B12
aggacgcgtgggtggcctgcggctgcagaagatgaatcctaacacagactttcactgcttgaagacctttggttctcacttcacagaagatatcgctataccttcgggtacgaagattgacttctgtcaaacatcagatgggaagcttataacagaaattgatgggaaacaaattggtgctgttcggagcaaagatctttgcaaggctttcttcgacatgtatattggtgattcaccggtttcactggaggccaaaaaagtcgttgcccagaacgtggctgggctcattggaagacgctgaggatagcgagaggatggttatttcattcttctgtacagttagagaggattcatatgagcgggaaaataggccaagtatgtagagtgatctgtcctgtatagaaag

SEQ ID NO: 9802 - DNA, 425 bp, Zea mays
  Clone ID: LIB148-014-Q1-E1-H7
acgagatcttcccccgatcgacctcgtgatccttgcggccatgtcgtcgtcggcagccatgggcaattgatgaattcgtctagctctctgagtccatgcggctagacgcctcgctacctgcggatgatgacccatccaatgagaccgcctcgcatcgcccctccatcattctcaacgccgtcgcgctcggcaatatcgatgctggcaagtcggctgtgtggaacagcctcatcggccaccctgtgctgcccacggaaggggaaaaccacgcgtcgcagaccgccgggaacctgggcgcggcggaatcttgcgcggtggtctgctggtgaggccggaatcgctcactagagccaactcgtcgccttgcgcccgccgtatatcgtggccagcagcttctgctctacaatcgctggaaataccgcctt

SEQ ID NO: 9803 - DNA, 419 bp, Zea mays
  unsure at all n locations
  Clone ID: LIB148-014-Q1-E1-H8
aacaccaagcgtcaaacttgccaagcagctagcaaccaacccaagaaagctagacaccatacccatggctcgcgctagcgtcgtcttcgtcattgctactctcctcttcgtcgccatggttgtggcaccgatggccgaggcaaagtccgctgatgccccctccgccgacgcccccgcccccgctgctgacgcacctgccgatggacctagcggaccggcgggtgcacctggtccccagggcgtcgagggtctatcgggcaatgaggacgacgatgatgactccaccaactaaggccaagcacgtcggtccggttgcatttggaacaagacatggaagaaaagtgagagcaatgtcgtttaaaaccaaaagtccataataatgtgtggtcatccgtgatatgttcntgctctncctcttt

SEQ ID NO: 9804 - DNA, 445 bp, Zea mays
  Clone ID: LIB148-014-Q1-E1-H9
cgggtggctccacgcgtccgcaaagacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccac

SEQ ID NO: 9805 - DNA, 377 bp, Zea mays
  unsure at all n locations
  Clone ID: LIB148-015-Q1-E1-A1
aggccctgccggcgagctgcgctacccgtcctacccggagagcgacggcacctggtcgttccctggcatcggcgagttccagtgctacgacaggttcatgctgagtagcttgaaggcggctgctgaggcagtgggcaagccggagtggggcaacgcgggtccgggcgactccggcagctacaaggactggccggaggacacgggcttcttccggcgcgagggcggctggagcacggagtacggggagttcttcatgagctggtactcgcagatgctcctggagcacggcgagcgcatcctgtcggcggcgacgggcgtgttcacngnngtccccggcgtgaagatctcggtgaaggtggccgggatccactggcact

SEQ ID NO: 9806 - DNA, 418 bp, Zea mays
  Clone ID: LIB148-015-Q1-E1-A10
agcagactggaggaaaaccttggcattttcacaaacaggcttgcttccggtgacgccagaggtagtcaagaagacgtgctgtttgaagagcatgagcatacaacagctgatgggtcaccttccaacggtgacaagttgagcggcgtagcgaatcttaaggctgggatttctctgctcaatataagactgagggcacttgaagatgaccaggagtttctcaagcaggtgttgagttccctccaatgcggtagtgatggactgcagtgtatacaggagataagcggccatctagcagagttgcgaagagttgtgactcgctaaggaaaatggttttgccccgagtccaaattgttaggtcatcatgaggtcttctcatgcagcagactaacgagggtgcttccactgagtgcccacaatc

SEQ ID NO: 9807 - DNA, 401 bp, Zea mays
  Clone ID: LIB148-015-Q1-E1-A11
acccacgcgtccgatcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacg

SEQ ID NO: 9808 - DNA, 399 bp, Zea mays
  Clone ID: LIB148-015-Q1-E1-A2
accacgcgtccgacgctgcccccgcccggccctgccctgccctgccctgctgcgcccaagcagctgaatctccgcacagacaattagagtagctgcattggcggggaaagcgcaagaagctcagcagaaatggcggagcaggcaggcgccggaaggtactggtgccacatgtgcgccgcggtcgtgagccccgcggagggcgaggcggaggtgaagtgcccgcattgccacagcggcttccttgaggagatggagaccgtccgcggcacgcccgcggccgatgacggcgacggtgacggcgcggtggctcaagtgtaccccggcgccgaccgcccgagctccatctgggcgcacgctatcctcagcacggtcgacagctccgtccgccgccgccgcaac

SEQ ID NO: 9809 - DNA, 409 bp, Zea mays
  Clone ID: LIB148-015-Q1-E1-A4
agagctttcgttatcctcctcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaaca

SEQ ID NO: 9810 - DNA, 421 bp, Zea mays
  Clone ID: LIB148-015-Q1-E1-A5
agtcaggacaagatcagacctctttggaggcattacttccagaacacccagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgaaggcctggactggctgtccagcaacattgcgagcaaggcttgaggcctaccttgaatgtcaaccgcgaactgactaggagctccggatgtatcatggaaactcaggacagaatcgcagttgcaac

SEQ ID NO: 9811 - DNA, 354 bp, Zea mays
  unsure at all n locations
  Clone ID: LIB148-015-Q1-E1-A6
agacggcgggtccgggtcgtcgtacacggcgcagatggagcggatcaggcgggccgcgcagcccagcccggattacagcaccgactaccccgtctccatcccggagttcggccacccgtcgcccgcgagcagcgccagctcagtcgagcgggatgaccggcggcatcgtggagggcgccggtgagtacgtgatcgacaggtgtgagcgtgatgtgctgacgactaattgactcctgcgcatccctgtcacgtgtgtatagcatatagtcgtcttgctgtaaaaggttatggcatactcccctgtttaaaatgtacaggttaaatttggcttacttcaacaanggattatataat

SEQ ID NO: 9812 - DNA, 195 bp, Zea mays
  Clone ID: LIB148-015-Q1-E1-A7
cggacgcgtgggaaaatcatcaaaaaaagaaaaaaaaaaaacaaataaagaaaaaaaaaaaaaaacaaaaaaaaaaaaaaaaacaaaaaaaaaaatctccaacacaagggttgacctcaacgatgttccacgattaggggccacctcaatccaacttcataacccttctaatctttcacggaacttcatgtcctc

SEQ ID NO: 9813 - DNA, 406 bp, Zea mays
  Clone ID: LIB148-015-Q1-E1-A8
aggctagttcgtggatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgcc

SEQ ID NO: 9814 - DNA, 363 bp, Zea mays
  Clone ID: LIB148-015-Q1-E1-A9
acggacgcgtgggcggacgcgtgggcgaacgcaagtaagagaggctcgagctcatccaggccaagggcggccagtacgctgagtcgctcaccaagtacgccggcgcgctcaactgccgcgtccgtaggaagtgctagtgcgtgtgcatcactaggctgcagctttcatcattggagatcgatcgcaacagtgcacggttgtgttgtagataaatcgtgtgtttggaatgctgcccgtacatactggacaactcgaacagtgcttgcctttgcctgctggccagcatcaccattggcgatggcgcagcctgcggcgggtgctacgaggtgcggtgcgtggacagccccagcgggtgcaagccca

SEQ ID NO: 9815 - DNA, 342 bp, Zea mays
  Clone ID: LIB148-015-Q1-E1-B1
gcggccgaacctgatggacatcagctcttcatgggacatccgtgcaaccccgacattcttcttcctcaagaacgggcagcagatcgacaagctcgtgggcgcgaacaaacctgagctcgagaagaaagtgctagcagccgctgatgccagtacgtcctagtgacacaagtggaagtgggcaaacgatctgtgatggcttcccggtgtatagtttccatggttcatttgtgtgcttgtcccatgtttgcctggggacgatgacgttttacaattttggcccccatcgcgcgcactcgtctgtttctctcatggaagccgtgtgaacctgtgcgtgtgtgtgac

SEQ ID NO: 9816 - DNA, 389 bp, Zea mays
  Clone ID: LIB148-015-Q1-E1-B10
cagcggcgccatggacaccgtgttcctcgtcgcggaggggccctcggccttgcgccccagccgctacgccctcaaggtcttcgacaagcgctccgccgcccgcagcaggaagcctgacgccgaccgccgcgcgcggtgggagatcagcgtgctctcccgccttgcgcacccgcacctcccctcgctcctcggcttcaccgagacggacgaccttctcgcgtgggccgtcccctactgctccggcggcgacctcaacgagctccgctactcgctccccgaccgcatcttctcccccgcggccatccgcttctacattgccgagatcgtctccgcggtcgccgagctccacgccgcgggcgtcgtgtaccgccacctcaagcccgacaacg

SEQ ID NO: 9817 - DNA, 249 bp, Zea mays
  Clone ID: LIB148-015-Q1-E1-B11
acggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaatcattgtaatgggagttatatatataactttatctc

SEQ ID NO: 9818 - DNA, 307 bp, Zea mays
  Clone ID: LIB148-014-Q1-E1-H6
acaagatccacttcgcgcagctgttcatggagaaggggagctacagccacatgattaagaagagcccgtcccaagattaccctgccggacatggaacccgacgagcatccgccggaaccggcgccaccgcaagacggggaaggagaggacaactaggaggaagggaccgccaccaatatatatcacacacacacacacacactcacacattctcacactcaagtctgcgtttgccatttttcttttctttttctctacgacttcgttattccctcctttcatctatctctccgtgaactcggtttgt

SEQ ID NO: 9819 - DNA, 423 bp, Zea mays
  Clone ID: LIB148-014-Q1-E1-G11
ctcctagatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctc

SEQ ID NO: 9820 - DNA, 200 bp, Zea mays
  Clone ID: LIB148-014-Q1-E1-G12
caatgggcgaaccgaaaaatgcacctgtttcatcatcatctggttctgaccaagagaatggttcgcctgtctcggtgttatctgcaatgcaatcggatgcttttggttcatcaatatcaaacccatcaactgggggcacgtctcctgcgtcatcagatgatgggaataatgtccctgagatagtgaatggggatgaaaat

SEQ ID NO: 9821 - DNA, 412 bp, Zea mays
  Clone ID: LIB148-014-Q1-E1-G2
gccgacccacccgtctaaccaagcgtcctgacaaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgttttgtgcc

SEQ ID NO: 9822 - DNA, 416 bp, Zea mays
  Clone ID: LIB148-014-Q1-E1-G3
accacgcgtccgaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacaaattccagcctaactctgaagctggaggtgttcgacaaggacacgttcagcaaggacgacccgatgggggacgcggagatcgacgtggcgccgctggtggaggcggcgaacgcgagcccg

SEQ ID NO: 9823 - DNA, 391 bp, Zea mays
  Clone ID: LIB148-014-Q1-E1-G4
gacgcgtgggcggacgcgtgggcgcgagcggccccctttttttttttttttaaacaagatgaaaaccccgatgaattatataattataaaggctagtttgacaacttcattttctcaagtgaatcctattttttcaagagaaaatgaattaaattcccttgaaaaaataaaacctcttagaaaaaataaggttgtgaaactagccctattaataaatttatgcagaatgcaacatcggtttccaccattttcctctttacagaatactactgctccgtgtatacggagaaactacatttcacggagtagtaaataaacagggattaattagcgccgtgtgcatgcatgcatacggcgttgggctggccgacatgatcataacaattaatta

SEQ ID NO: 9824 - DNA, 426 bp, Zea mays
  Clone ID: LIB148-014-Q1-E1-G5
atgaactacgagcctatcgctccctaccacttcgacttgagcggcaaggccttcggctccctggcaaagcccgggctcaacgacaagattcgccactgcggcatcatggacgtcgagttcagaagggtgccatgcaagtaccccgccgggcagaagatcgtgttccacatcgagaagggctgcaaccccaactacctggccgtgctggtgaagtatgtggcggacgacggcgacatcgtgctgatggaaatccaggacatgttgtcggctgagtggaagcccatgaagctctcttggggcgccaaccggaaggttgacaacgccaaagcgctcaatggccccttctccatccgcctcaccagcgagtccggcaagaaggtcatcgccaaagacgtcatcccggcgaactggagacccgatgccgtc

SEQ ID NO: 9825 - DNA, 359 bp, Zea mays
  Clone ID: LIB148-014-Q1-E1-G6
acctttaccaccgagagaggaacgcgaacaaccaacgatcgcctcatcgccatggcacgctctgtccccatcgcgcctctgctcctgctccccctcctcctcctcctcgtctccactgcgtccgctgcacggaccgtgggcgacaccgtgcaggacgcgtgcagcaagacacaattccccaagatctgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctc

SEQ ID NO: 9826 - DNA, 423 bp, Zea mays
  Clone ID: LIB148-014-Q1-E1-G7
cggacgcgtgggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccgg

SEQ ID NO: 9827 - DNA, 407 bp, Zea mays
  Clone ID: LIB148-014-Q1-E1-G9
cggacacgtgggagacatctggcaagtggtgctggtgggcaacccgcgcaagggctgccaccaaggccaagcgctcaaggaacgcgccggggtcctggtcaacaagaacgttgggatctccgacaacctgggccccggcaaaccgctaaggtactttaagggccttccgctccccgtttgcgccgcgctggtcaagcaactggactccggcgaagacgacgaccaattaactataccaagggggggttcccggcatgctgcacaaaactacaacgattcaaaacgaacgcatgggatgggtaacaatttctacgggaagaaaagggagaaaagggaaattaaaaatgtttcaaaatgcctgattccaaaaaaaaaaaaaaaaaaaaaaaaaagggcgggcgctccaa

SEQ ID NO: 9828 - DNA, 427 bp, Zea mays
  unsure at all n locations
  Clone ID: LIB148-014-Q1-E1-H1
aaggtacacgatcgccggcacaacaaacggcctgcccatcaattcttacaaggacccaaatcctcccccaagggcaacaagtttctggtccaagggaaccacaatggccatgttctctaacccaaccccatcaacaaaaattatggcccaataaacatctgcgtcaagtccggcgcctcaaatgtggccgtcaacgacgtcgtcttcaagaacatccacggcacctccaacacgccggatgccatcacgctcaactgcgccaacaacctgccatgccagggcgtgcagctcgtcaacgtcgacatcaagtacaatggatccggcaacaagaccatggccgtctgcaagaatgccatcggcaagtccatcggcttggcaaangagctggcgtgcatttgaaccaattgactaacatgcatatattatg

SEQ ID NO: 9829 - DNA, 101 bp, Zea mays
  Clone ID: LIB148-014-Q1-E1-H10
attatggtgtgtacatttttttagtcgatattcttgttcttgtttgtgttgtagaaatggttggatatgctaattttcaatagccttgagggttcgtggta

SEQ ID NO: 9830 - DNA, 423 bp, Zea mays
  Clone ID: LIB148-014-Q1-E1-H11
aaaaaaacagcagctagctagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagca

SEQ ID NO: 9831 - DNA, 386 bp, Zea mays
  unsure at all n locations
  Clone ID: LIB148-014-Q1-E1-H12
ggccgtcttctcgtctcgctcccctctttgcgccgcccccagatccggcaccgcccgctgctcgaacccgcaccccacgcccgcaggccgggaccggtgggcgcgcgccgggcagtangagggagaggaagggcggcatggcggcgccgccggcgaaggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggtaagcgtataaagctacagatttgggatacagcgggccaagaacgcttccgtactattaccactgcg

SEQ ID NO: 9832 - DNA, 290 bp, Zea mays
  Clone ID: LIB148-014-Q1-E1-H2
cgcgtcggaggcaaccatgcgcctgtccctcctcctcgtcgtcgtggccgccctctcggcgcgcaccgcggcgcagctgccgctggcgggcggcggcggcggcgccctgaagccggacttctatagccagtcgtgcccgcgcgcggagcggatcattgcggaggtgatgcagacgaagcagatggcgaacccgacgactgccgcgggcctgctccgcgtcttcttccaggactgcttcgtcagcgggtgcgacgcgtcggtgctgatcgcgtccacccagttccaaaagt

SEQ ID NO: 9833 - DNA, 381 bp, Zea mays
  unsure at all n locations
  Clone ID: LIB148-014-Q1-E1-H3
tcctcccccggccggcaacaaatcaaccgccggaaacggcaaaacaaccaatggcccctggcccaacaaaccccaaaacccttaaggggcaggccccacctaaggccgccgtctcaacacccaaggttgcgcccgaggccactccaatctccgttgaggttgcggctgatgaacaggtacctgaaaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgangaggagaagccagcggcagcagcccatgcagaggaaaaggtcgccaccgccgccgagacca

SEQ ID NO: 9834 - DNA, 385 bp, Zea mays
  Clone ID: LIB148-014-Q1-E1-H4
ttataccaatccctggccgaaaaacggaaggccaatccttgggaacccaaggtccaggttcataaccgacaacttcttcgacccaaacaagctcctgcattccgtggacctgtcgacggagcacaagatcgtggacctcaaggaccggatcaaggcctccgtcgtcatctggcaccggaagatcagcaacaagctctcgtggggccccgccggcgtcagcctggagaagcgggaggagttcgaggagcgggcgcagaccgccctgctcatcctcaagcacaggttccccggcatccctcagtcggcgctcgacatcagcaagatccagtacaacacggacgtcgggtacgccatcctggagagctactccaggaccctcgagagc

SEQ ID NO: 9835 - DNA, 424 bp, Zea mays
  Clone ID: LIB148-014-Q1-E1-H5
accacgcgtccggggacgtaagaagtcgtctaattcttggatcgaattagacgacttcttcgtccctctcttcattagcacgctaacttgtaatctgcaggatctaagcagagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagattccagccaaccactgaaagctggtgagtgagcagcaagcagaacgatcctgtttgtgattcattattctagactgtttgctacaggaagtgttccacaaggacaccttcagc

SEQ ID NO: 9836 - DNA, 415 bp, Zea mays
  Clone ID: LIB148-014-Q1-E1-G10
cacgcgtccgccaacgcgtcatggctgtgaatgtgagcaccatgtggacgttgatgcaggcacaagttgcgatggttgtggcgttgtccttcttggtgagcggtgcatggtgcggtcctcccaaggtcacccctggcaagagcatcactgccacctatggcaaggactggttagacgctaaagcaacatggtatggcaagccgacgggtgccggtcccgacgacaatggtggcggctgcgggtacaaggacgtgaacaagccccccttcaatatcatgggcgcgtgcggcaacatccccatcttcaaagatggtctgggttgtgggtcctgcttcgagattaagtgcgataagcctgtggagtgctccggcaagcccgtggtggtgcacatcacagacatgaactatgagcctat

SEQ ID NO: 9837 - DNA, 427 bp, Zea mays
  Clone ID: LIB148-014-Q1-E1-E7
acgcaggtgtccccgaccaacggcacggggtggtacaggggcatcgcccgggagttcgtggacgcccacaacgagctccgcgcgcgctacggcgtgccgcccatgaagtgggacaaccagctggcgcggcaggcgcggcgctggtccaacgccatgcgcaaggactgccagatcctccacagcggccacgagtacggcgagagcgtgttcaggagctacgacgactggaacgccaccgccagggaggccgtcttctggtggggcaaggaggaggccatctacgacaaggagaaggagaagtgcaagtacggcaaggtcttcaaggagtgcggccacttcgcgctcatggtcggcaagaggagcaccaatgtcggctgcgcacgagccgagtgcttcaaaggcggcgtcttcatcacctgcaactact

SEQ ID NO: 9838 - DNA, 422 bp, Zea mays
  Clone ID: LIB148-014-Q1-E1-E8
ggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatctcccacgagtccgcctcttccgacaacgccgagtccgccgcgttcaccgtgaactcgggcaacgtcatcgtc

SEQ ID NO: 9839 - DNA, 426 bp, Zea mays
  Clone ID: LIB148-014-Q1-E1-E9
gtacgtacgcatcttctggctcacgacgatagccgaggaattcgaaggaccgaacgagaagctcctgcgtggtgtcaacgtctaccctaccgtaccagctagccaccacacgcgtagcgcgggaaatgccggcggcggcggccatgacgacgaggcgggtggtgctggaggtgctacggtcggcctcccgcgacgccttccaggtggccttctccttcgcggcgaggccgcccgtgtccaccatgctcaagccggccatcaccaagcccctctaccaccaccaccacgacaacgactaatctggcgcagatctacagcacggccgtcggcatgccttcacagcccggtgggtgtgacgactattgatgacgtactaccacatttcgtcgctcctattctagtaagcaacgcaaaagaaaatgttgt

SEQ ID NO: 9840 - DNA, 382 bp, Zea mays
  Clone ID: LIB148-014-Q1-E1-F10
tccggcaaaacatcagcggcatgggagcactgctcctcctcgtcgccttcgtcgtcctcccctccgccgccctgtcctcctcgtcctcgcttctgcactcacctcctgagagtgatgagacaagcggcggcagcgagcagcaagccacgccggaagacgagaacaaggagaacgagcggcagctggcgacggagaatgcgtacgcggaggataacgtcgtctaccaggagatgctcaattacgccaatgagaaaggtctggtgtccccgaacaaaggcacggggtggtacaggggcatcccccgggagttcgtggacgcccacaacgagctccgcgcgcgctacggcgtaccgcccatgaagtgggacaaccagctggctcg

SEQ ID NO: 9841 - DNA, 450 bp, Zea mays
  unsure at all n locations
  Clone ID: LIB148-014-Q1-E1-F11
cggtcggcatcncgggtggccccacgcgtccgctcaaagacaaccagagtgcagcggagacgggggcacccgcccccggctggccgacctggcccgtgtacgtgtcggccgaggtgggcatgaccgtggccgcgttcgcgcaccacgagctcaacgccatcaaggacgacgacgtcctgtacaagtgcatcgacacctgctccgaggacatcgaggaagccgtggcgcacctcagcgccctctcccgcgacttctccgacgccaggttcctcgaggtcaagtcctggctcacctccacgctcggcggcaccgccacctgcgaggacgcctgcaaggacgcccccgtcagcgacatcaagaacgtctgcataaccaagagcttcgagtttgagaagctgctgcgcgtcacgctggacctcatcaccgaggcttccggctccatgtcggccg

SEQ ID NO: 9842 - DNA, 395 bp, Zea mays
  Clone ID: LIB148-014-Q1-E1-F12
cgtccggtaacatgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgattcgacagatcaagcgcgagatctccgtcatgcgc

SEQ ID NO: 9843 - DNA, 373 bp, Zea mays
  Clone ID: LIB148-014-Q1-E1-F2
ccctccctccctcacacaaataataaggaaaggccccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccacggccgcgtgtactgcgacacctgccgcgccgggttcgtgaccaacgtcaccgagtacatcgcgggcgccaaggtgaggctggaattcaaagcacttcggcaccggcaagctcgagcgcgccatcgacggggtcactgacgcgaccggcacctacacga

SEQ ID NO: 9844 - DNA, 434 bp, Zea mays
  unsure at all n locations
  Clone ID: LIB148-014-Q1-E1-F3
acgcgtccgaaacaaggaggtttccgaacatttcanggattctatgatgaggtttttcgaggacgaaaccgagaaggtgaaagggttcacgtcagaatccactgtgagctacagagatcggctgaagatcatggccggcctggtcaacccggacgacctccagctgggctctacggagaggaagctcgtccaggcgtacaacgagaagccagtcctctcgcggccccagcacagcttctacgagggagaggactaccttgaggtggaccttgacatccaccggttcagctacattgctangaaggggctggactcgttcagggcacgcctcaagaacggcatcctcgatctggggttaacgatccaggcccagaagcagtcggagctccctgagcaggtcctctgctgcgtcaggttgaacaagatcgatttca

SEQ ID NO: 9845 - DNA, 376 bp, Zea mays
  Clone ID: LIB148-014-Q1-E1-F4
acccggccttaacgcttccttcaccaaataaggtcccgcccttttccgacattcacaggggggacaggaaatcaccggccatggcctcaattccggcgacaaccttcgccgtcaccttatccgtcctcttctgtgccgcggctggaaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaagaagacatctg

SEQ ID NO: 9846 - DNA, 449 bp, Zea mays
  Clone ID: LIB148-014-Q1-E1-F5
attcgccggtcacccacgcgaccgagacgcgtccgagtccttcgacggccggcaccagcagctgctgtccacggccacggcgcgggtggcgtcgctggaccgccgcctgggcctcagcgacaagttcagcctcggcacggccgcggcccgcggcgcggcgcgcggcgtcgacgagcgcttccaggtcacggagcgcgcctggggggccttctcggcggccggggaggtcgtggccggcagcccctacgcgtcccgcggcgccgcctgggtgtcggcggccgtcggcgccgtcgcccgggccgcgtccgacgttcgggccaatgacaaggaaaaagtgggcaaggcccaagcagagggggaggcctcggcggcggagcatggtcactacgcgtcgtcccgtgtcgacgtgcacgacggacagggacgtgcagctcagcacggtgaccata

SEQ ID NO: 9847 - DNA, 411 bp, Zea mays
  Clone ID: LIB148-014-Q1-E1-F6
accagtggcttggccgtgtcgatcgctgatcccaccggctgatagagttggcggccgggggagtgagtcgtcagggatggcgtcggagccggtggcgcgggcggtggcggaggaggtgggccgctggggcagcatgaagcagacgggggtgaccctgcggtacatgatggagttcggctcccgccccacccagcgcaacctgctcctctccgcgcagttcctgcacaaggagctccccatccgcttcgcacgccgcgcgctcgagctcgactcgctgcccttcggcctctccaacaagcccgccatcctcaaggtgcgggactggtacatggactcattccgggacatcagatacttccctgaagtgaggagcaagaacgacgagctcgctttcacgcagatgatcaacat

SEQ ID NO: 9848 - DNA, 415 bp, Zea mays
  Clone ID: LIB148-014-Q1-E1-F8
acccacgcgtccggcgagccgcgcgcggaggcgaggcgttcgcacacctcgcccgcgccaccaccaccgctccgttgcgcccgccagccgtcacgcgtgacgtttcccggggggccgggggagagagaggcagaaggaggaggcacggagaggacgagacaggatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagcctcggggatggc

SEQ ID NO: 9849 - DNA, 454 bp, Zea mays
  Clone ID: LIB148-014-Q1-E1-F9
acggtccgtcgattccgggtggccccacgcgtccgcttagagtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggt

SEQ ID NO: 9850 - DNA, 357 bp, Zea mays
  Clone ID: LIB148-014-Q1-E1-E6
aggacgcgtgggcggacgcgtgggcagagatgttgcgtggccaaaaactccagcaagggaagtctatgaagtgttgacttatcgaggatggcaggagctgtttcctctgttatcaacagtgcatgagatctgtattgggcagttgcctcctacatcgatagttgaatacagtgagcacacgccaaatctctccatcatcggtggtcatactccattctactgagctagatactgctgtttggactagtgctccagtatcacttgttataaactaagaaatatgagatatgttgaatatctgaatatgttttgcatataaatatgatttcagtcatgtcaccttattaggtgcatatg

SEQ ID NO: 9851 - DNA, 312 bp, Zea mays
  Clone ID: LIB148-014-Q1-E1-D3
tctaaagtgactcgtggtaagtacaaggccggttacgttttgcaaggacttgaaggacaacaacctcgtcacgcccttctccgacaacaattacttgccaaggggctgcaacttcgaaggaaaactcctccccgcaagcaaaaccccaaaaaggacttgtccgtaaccaggcaagaacaatcaaaaccaccccgttgaggtggtgttgacgccggactccgacgagagctcgccgaagccgccgccgcacgcggaccaggactcgcccggaggctgcgagtcggggcgccgcagcacggtgccgttcaaggt

SEQ ID NO: 9852 - DNA, 404 bp, Zea mays
  Clone ID: LIB148-014-Q1-E1-D4
gaccgcttccttgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcctgccccgcattcgccggcgacggcggtgtcgtcgggcgccgccaagcccaagtgcgtggccggcgccaggaacgaccacgcgtgccgcttcggctccgtgcacgacccggacagccaggaggaggagggctccagcgtcacaatcgacgcgcccgccgccgcgcccgacgacgtcggccactacgacggcagcgactacaacgaccccgacgtgcccaacaacgaccagctcgtcgtcgtcggccactgaaa

SEQ ID NO: 9853 - DNA, 419 bp, Zea mays
  Clone ID: LIB148-014-Q1-E1-D5
gtcgcacttccggcaggcagacgagctcctcgccgattcagggtggcattgcagcttctgcttccgctacataagcgatttcgcattcaagatgcaagcgtatagccacgtcgaccggatcaggttcaagtacttcctgaaccctgagaggatccaagatgtcatctgcagaggggcggaccttttcgatatgcttccagaagagtacacgttccaagagatcatcgccaagctggggccgatcccgagcacgtattctggcgttcatcttcctagctatctgctaaggaatgtcgaccggtttagataccttctaccgggcaactgcaggagagaaagtggctaggttttatggcccactaccctgcaacctgttgtgcgtgggtgggtgggtgccagtgccacactgccccgctgca

SEQ ID NO: 9854 - DNA, 450 bp, Zea mays
  unsure at all n locations
  Clone ID: LIB148-014-Q1-E1-D6
cggccgtcgacgcacgcctacgaccctcgtctcaccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccangtggtgc

SEQ ID NO: 9855 - DNA, 436 bp, Zea mays
  Clone ID: LIB148-014-Q1-E1-D7
gcacgccaccgaaatgagtcagcagctagctagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgttcacatccgcgccacgatgagcat

SEQ ID NO: 9856 - DNA, 424 bp, Zea mays
  Clone ID: LIB148-014-Q1-E1-D8
agcggcgagggcgcacgtcaaggaggccgccgtgacggcgtcccccaaggcgcggacggtgctggacctgtgcaacaacctgtacctggacgtggaggacaacctgggagcctgccgccgcgccatcggcttcaaggacgccgtcaccatccgcgccaccatgggcatggcggcgcaggacatgcagaactgcgacgagcagttcaggcagatcggcgagaagaaccccatggagcagttcgacgcgtcgctcgtcgagatgtccgagaactgccgctcgctctccaacatgatctgatcgatctccttctccacggacgacaacagagagccgggcgttttgggccctcgcatcgtttgtcgccgctgctaacgttcgcatgcccatgcccgcgagcgcgctctcgcgcgacaataactgatg

SEQ ID NO: 9857 - DNA, 436 bp, Zea mays
  Clone ID: LIB148-014-Q1-E1-D9
cacgcgtccgaaactgccatcctctccatcacgaagatggcgttcatcagcaatgtcgcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgt

SEQ ID NO: 9858 - DNA, 428 bp, Zea mays
  unsure at all n locations
  Clone ID: LIB148-014-Q1-E1-E1
cacacacgtccgcccacgcgtccgcagcacgaatgctgtgcangaggcatgggcatcagcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaacgaacatggtaattggatcgagattctacgcgtggataacctggtcatcaccggcaagggaaaccttgacgggcaaggcccagccgtgtggagcaagaactcctgcaccaagaagtacgactgcaagattcttcccaactcgctggtgatggacctccttgaacaacggggaggtgtccgggatcacgctgctcaactccaagttcttccacatgaacatg

SEQ ID NO: 9859 - DNA, 295 bp, Zea mays
  Clone ID: LIB148-014-Q1-E1-E10
cgcgtccgcccacacgtccgctctcttcctgatggcggcggctaccacatattcggcggcgcggtgggtgcggacccagcggttgtgggtgctgccccggcggcctgcagccccggcggctcgcggccccgagccccggcctcggtggcggcacggacgcagaggctccggcctagcgcaagcgcatggcgcacagccgcacccccgacagcgcgggggccagtttactcggcagcccgtccgtgagtgcgcggactcctgggcgcacaggcgcaggtacaacctcaagcgcaca

SEQ ID NO: 9860 - DNA, 445 bp, Zea mays
  Clone ID: LIB148-014-Q1-E1-E11
cgggtccgccacgcgtccgcccacacgtccgagcgggttttctgcatacgacgtcctcaaacaaccctgggttaaaggaggacggcaagggccggacacgccgctggacaacgcggtcctcggccggctgaagcagttcacggccatgaaccagttcaagaaggcggcgctgcgggtcatcgcggggtgcctgtcggaggaggagatccgtgggctcaaggagatgttcaagagcatggactccgacagcagcggcaccatcaccgtggacgagctgcggagaaggctggccaacaagggcaccaagctgagcgaggccgaagtccagcagctcatggaagctgccgacgccgacgggaacgggacgatcgactacgaggagttcatcacggcgacgatgcacatgaaccggatggatcgcgacgagcacctctacaccgcgttc

SEQ ID NO: 9861 - DNA, 404 bp, Zea mays
  Clone ID: LIB148-014-Q1-E1-E12
cggacgcgtgggctcccgtcgccgggatcccgccggtgacaatggtgaggtggctgccgccgccgccgccagcggacggcgagatacccttcggacacgacgccgtcgccttgtccttcttcgtggcgtgtgtggccgccaccgtcgcgctcgcgtcgtccatgtgctcggcatgcggtcgcaagccgaaggcggccacccgtgcagacccggccgcttcggaccagtccaccgggacgggctcgggctccgtctccggtggcggcggaagccaggaggctagcgccgcggaagccgaagaggaagtggtgagactgtcaccggagctggcgatgcacggcgccatcgacccggtgacgctgccgtcgtcgacgtcgaagcggcgcctggtcatcagcgtgagc

SEQ ID NO: 9862 - DNA, 413 bp, Zea mays
  Clone ID: LIB148-014-Q1-E1-E2
accaagcgtccgcccacgcgtccggttgagcctaccctgccgcccttccagctcgccgggcccatggagctctggatccagaacggcgacgacgtcaggcttgccttgccgcatgatgtggacgctggtaccttgaagaacgttgttctttctgatggtgcagtcgtaacagtgaagggtgctagagctgtgagcctccggttgccgcttgaattaccacttcctctcaaccgtaccacttacaagggtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggcca

SEQ ID NO: 9863 - DNA, 410 bp, Zea mays
  Clone ID: LIB148-014-Q1-E1-E3
cacacacgtccgcccacgcgtccgaaacaatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccaaccccgccgttgccgctgccccatcgtcgtcgtcgtctaggaagtctggtccagctgccgcgccgaccaccgccgcctctacaccgtcttcttccacggacgaggagttgagccct

SEQ ID NO: 9864 - DNA, 425 bp, Zea mays
  Clone ID: LIB148-014-Q1-E1-E5
aggacgcgtgggcccttaacgaggatccattggaggacgtgccggtgcagcagcggttcatctggtcagggaagagaaagatgcggcgcctttttcacgactccatcatctctcttctggattactctcagtgctgcagcgtaaactcgcgcgcagttccctgtaaaagctggagcttttctgagcgtgtaggtgcgttggtggaacttgggcccccagtcccccacccaagatctcacctatctgcactgggctggccggctgggcccgccgccaaccaccgtgcttccgccattgcgtcgccgcataaccttggctaagcgtgaactttgtcacaacaaccacgtttggcgtttccatgcttgtcctgggttcctggcaatctctgtattaatccgtctgccattgcattatcttgcactgaa

SEQ ID NO: 9865 - DNA, 410 bp, Zea mays
  Clone ID: LIB148-014-Q1-E1-D2
acaacactctaaagtgagtcgttgtaaggagaagcaattaaaaattcattcgcaccatgcaatgctctaccgacctgaattgaatgctatcggataaccccatgtacttttgtccttaagggtataacaccataggtaatgtaacaattgtttgcacatgtaacatgatgaccgagaagagaaacatgcaaatggagaaggaattgtttctgcctttctaggattcttcttagcacaatgtgcaaaactttttcataatgtaagagagttctggcgtcaaaaaaaaaaaaaaaaaaaaaaaaatacataaaaataaagtctgcattaaaagaatagacgccacaaacatacagaagatactcatggcattcgaagacaacacaaaaaaaaaaagggggggccccccaaaa

SEQ ID NO: 9866 - DNA, 392 bp, Zea mays
  Clone ID: LIB148-014-Q1-E1-B9
acgcgtccgcaaaaacaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtga

SEQ ID NO: 9867 - DNA, 414 bp, Zea mays
  unsure at all n locations
  Clone ID: LIB148-014-Q1-E1-C1
ccttacaaggccaacttaacaaccaagttggatggaatccggctggcaacaacggacctaaccaattacaaggacaatggtaattggttcaaaattcaacgcgtggataacctggccatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacattttaccggtgcaaggacatgctgatcaaagacgtgaccgtgacggcgcccggggacagccccaacacggatggcatccacatgggcgactcatccgggattcacatcnnacaacacgtcattgg

SEQ ID NO: 9868 - DNA, 440 bp, Zea mays
  Clone ID: LIB148-014-Q1-E1-C10
ccgggtggcgccacgcgtccgccaacacgtccgcccacgcgtccgcccacgcgtccgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaagggcttcgacgagcctgggtttctggccccgatcgggctcctccttggccccaccaagtacatggtcatccaaggcgagcccggcgctgtcatccgcgggaagaagggatctggaggcataactgtgaagaagaccggacaggcgctggtgatcggcatctacg

SEQ ID NO: 9869 - DNA, 427 bp, Zea mays
  unsure at all n locations
  Clone ID: LIB148-014-Q1-E1-C11
ataagaggcgaccaccaggacgagatctgcgacgtgcgcctgctcaagagccccgaggcggactgcgccgagatcgaccactcccgcgaccgctgccgcgtcncgctcacccgcaacgacggcatcaagcagagcggcgtccgctacgccaaccccatcgccttcctccgcaaggagccgctccccaactgcggcgagctgctccgcgcctacgacctctacaacgagacgtccgagaattcctaagcgtccaaacaaaagttctctcgctcgctttttttttaaaaaaaaaatcccatatacatatagcacatttgtttcggtttgttgatgcgcgcatgcatgctagcagacatctttcctaaaaaaaatttaaataatttccatctcgcattattttagtagctaccattcatgttttctgagt

SEQ ID NO: 9870 - DNA, 84 bp, Zea mays
  Clone ID: LIB148-014-Q1-E1-C12
cggtccggcatcacgggtgccccacgcgtccggttacacttcatggcttcaacgacagcaggcatcagacgctgtctcccctgc

SEQ ID NO: 9871 - DNA, 428 bp, Zea mays
  Clone ID: LIB148-014-Q1-E1-C2
agagagcacaacgtgtaccgtctctccccagcgtgcgcgcgcgcgtggtcggaggctgccgtcgctcgcgtcggccgcccccgccggccagcgagagcgagggacaacgaccgaccgaccgaccagctcgaggtgaatgaacagccgcataccgttcctccagaaaatgcaccgctggatcatccctagctgcggcgacacccgccagccgcgcccttcctcccgccatcgagatgcgttcccgaggccggcgtcggcgtcggcgtcggcgtcggcggccccgtcccctcagaagctgaggaaggtggggtcggaggggacgctggtgctgtccgtgcccaaggacgtagaggagatccggaccatgtcggcgtacggccgcctcaagctcttcacctaccacgagctcaggaaggccaccggcaact

SEQ ID NO: 9872 - DNA, 108 bp, Zea mays
  Clone ID: LIB148-014-Q1-E1-C3
cgccctccgctgcggcaaagtcctggggctgccgctgccgccgtcctacgcccccgcgcgctaagacgacgaaagccttcgtttctcctcgtggtctgaccatccaat

SEQ ID NO: 9873 - DNA, 377 bp, Zea mays
  Clone ID: LIB148-014-Q1-E1-C4
tccgtgaggaggtggaaggagcaaccccttgggcaggtcaacacaaagcacctggaaaaaacggcggaaccaaaggtcaaggtgctggacctgacgatcctgtcacctggcagaccggacctgatccttccgatcccgttccaggctgacgagaagggctatgcgtttgccctcaaggacggcagcccctacagcttccgcttctccttcatcgtctccaacaacatcgtgtcaggcctcaagtacaccaacactgtctggaaaactggagtcaaagtggagacccagaagatgatgctggggacgttcagcccccagcttgagccctatgtctacgagggcgaagaagagaccacccctgctggcatttttgcgac

SEQ ID NO: 9874 - DNA, 239 bp, Zea mays
  Clone ID: LIB148-014-Q1-E1-C5
cccacgcgaccgagcgaggacacgtgtcatctgaaaagcaagttggtacctgaaatctcaagtgccaggtcaagatcaggtactgcaggatgaggcgcatggtggatgctgtgatgagttcgtgagtggtctaggccgtcgtctcccagtcaactttggtttgctggaccgttgtctccttataatgtaattatttattttgtatataactccgattatatagtaaagatgtgacattc

SEQ ID NO: 9875 - DNA, 403 bp, Zea mays
  Clone ID: LIB148-014-Q1-E1-C6
aggatcgatcgattacagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgc

SEQ ID NO: 9876 - DNA, 423 bp, Zea mays
  Clone ID: LIB148-014-Q1-E1-C7
aagaattcatatataagagtgcatatatatatataatcctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttcccccctaacaataagaaaacgcacgtgctggcatgtacgttgtgttgtatatgcttttcttgctggcttcatttgct

SEQ ID NO: 9877 - DNA, 426 bp, Zea mays
  Clone ID: LIB148-014-Q1-E1-C8
caggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgcctcacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaaagggtggtcagaaaaagag

SEQ ID NO: 9878 - DNA, 438 bp, Zea mays
  Clone ID: LIB148-014-Q1-E1-C9
acgcgtccgatatgagcatcacaccttctacaacgagctccgcgtggctcccgaggagcaccccgtcctcctcaccgaggcgcccctgaaccccaaggctaacagggagaagatgacccagatcatgttcgagaccttcaacacccccgctatgtacgtcgccatccaggccgtgctctctctgtatgccagtggccgtaccacaggtatcgtgctcgactcgggagatggtgtgagccacaccgtccccatctacgagggatacgccctcccccacgccatccttcgtcttgacctggccggtcgcgacctcaccgactacctgatgaagatcctgactgagcgcggatactccttcaccaccaccgctgagcgggaaatcgtgagggacatgaaggagaagctcgcctacatcgccctggactacgaccaggagat

SEQ ID NO: 9879 - DNA, 387 bp, Zea mays
  Clone ID: LIB148-014-Q1-E1-D1
acctcctcctcgacgaagttgaacaagccggccggcggaacgggaaacccgcggtgggtgctaaatggctccggcaaccggagggcccctttggtataatgatctcggtaataaatgcaaggccttaggtcacggccatttccttgatcgattattttcgcggaactatttatgcagctcaaaatttatactactatatatacctacggaaagcaacaattcaaaccatatactggagtttgtttaaggtatcatcgagcagaaatatattcttgttattcgtagcattatatttgtattttattacacgttttgataataatcagtaaacatcccggaattcggcttcagctcacacatgtaaaacatagaaaacgtttgtgtgca

SEQ ID NO: 9880 - DNA, 364 bp, Zea mays
  Clone ID: LIB148-014-Q1-E1-D10
aagactctagtatgagtcatacataaactttataaataaaaaaatagaatagtacaccataacaacatacaacagctttgcctcgatcgagagcatgcatgaatcacaggcgtcgtcgaatcaaaagaaaggaagaaacaaaatgatgtgtggggtgggggtttggtgcatggccgtcgctgttaaaattcgacacacgacagttgcgtaaatagacctagcgtaatcagctgcacaaacgaatgagagagcgagcgagggaagcaaaatctgggtgaagagatgaatagatgatgaccggaaccccgcgcggcctggcaaactgggcctaagcacctgctccgattcatctgctctgctgggc

SEQ ID NO: 9881 - DNA, 436 bp, Zea mays
  unsure at all n locations
  Clone ID: LIB148-014-Q1-E1-D11
cacgcctctaccatgacgtcccgggagccacaacctctcctgctgtcgctgctggtcgccgtgctaaccgttggcgccgatgttcccaaagccgggcaagccaaacccctaaagccttgccggccccttggtaaacaacaaccacggaaagttcacggccgggccgtggaaacccgcccacgcaaccttctacggcnggcgtgacaggtccggcaccacngcgggcgcgtgcgggtacaaggacacgcgcacgcatgggtacggcgtgcagacggtggccgtgagcactgtgctgttcggtgacggcgcggcctgcggagggtgctacgaagtgcggtgcgtggacagccctagcgggtgcaagcccgacgcggcagcgctggtggtgacggtgaccgacctgtgcccgcccaaggatcagtggtgcaagccaccg

SEQ ID NO: 9882 - DNA, 425 bp, Zea mays
  Clone ID: LIB148-014-Q1-E1-D12
cacgcgtccggtacggcgcccacacgctgggcttctcccactgcaaggagttcgccgaccgcctctacaacttccgcagccagggcgggaagccggagccgttcgaccccagcatgaacccgtcctacgccagggggctgcaggacgtgtgcaaggactacctcaaggaccccaccatcgccgcgttcaacgacatcatgactcccggcaagttcgacaacatgtacttcgtcaacctggagcgcggcctcggactgctcagcaccgacgaggagctgtggacggacccccgcaccaagcccctggtgcagctctacgcgtccaaccccactgccttcttcaccgacttcggccgcgccatggagaagctcagcttgttcggcgtcaagaccggcgccgacggcgaggtcaggcggcgttgcgac

SEQ ID NO: 9883 - DNA, 420 bp, Zea mays
  Clone ID: LIB148-014-Q1-E1-B8
ataatccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgatgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacataacggacatgaactatgagcctatcgcggcgt

SEQ ID NO: 9884 - DNA, 448 bp, Zea mays
  unsure at all n locations
  Clone ID: LIB148-014-Q1-E1-A2
gggtccagccacgcgtccgatcgacatgaatggacgcacaaccgggtatgttgcgccgccaattccgtggtgagaacgaagacagagagaaagaaccgagctgtgccatcgccggtgggctcgtcgttgtcgctgccccagtgccgtgccgtgaagctccacctgtccatggagaagttattatggcctcgccgcgttgaaccggcgcccggggctcgggaattcttcaccggagaccgcgaacccactgtcctccgtggccagcctctccgctgactccttctctgcgtgaggtcacgagtcacctgatgagcaagtttggtacctggaatctcaagtcncaagtcaagaacatgtaccagagaatgaggcgcttggaggatgcggtgatgatttcgtgagtggtctaggccgtcgtctcncagtcaactttgggttgctggaccgt

SEQ ID NO: 9885 - DNA, 421 bp, Zea mays
  Clone ID: LIB148-014-Q1-E1-A3
aggaggcctacggttgcggaggaatgctgtgccccaaaatgggaaccgaggaccgcgcaaacggcttcatgcacaacttcaagaacacaaccaatttcggcctcatggccgtcagcctcggctactacgaaacgctcatgtcctgctccggaagcagcaccagcatcgagatgccgcccgaggaccgcgcgcgcgcgggcatctcaccgggcctcgtccgcatgtccgtcggctacaacggcacgctggagcagcgctgggcgcagttcgagcgcgcgctcgcgctcatgcaaactccgaagcccaagcaacatcctcaagccgccgccgccgaccgcgacggccccgaagccgccaacatacagcaccgcaagcactgacgcgcttgcgcttccgagcgtgcatggcctgtgtgggactg

SEQ ID NO: 9886 - DNA, 408 bp, Zea mays
  Clone ID: LIB148-014-Q1-E1-A4
cgggggcagccaagccttcggtatcacccgattacctgggggcgggtcctggttcaaaacaacggaacaaccaagggcaaggaaacctggttttggaccaggaccaattgcaacaattcttacaattcaaggttgttcccaattacctggatgaggggtttgggtccaactttcaaattcgcaggaacaacgcggatcagcacaaggtccttcaacttcaaaacatccaattggaaaaacgttctgtttgagacagtgacagtcaaagcctccggcgacagctccaacacggacggcatccacatcggcgactccaacaacgttacaatcagcagcatcatcatcggcgtcggcgacgactgcatctgcatcggccccgggagcaacatgatccgcatccatggcgtc

SEQ ID NO: 9887 - DNA, 419 bp, Zea mays
  unsure at all n locations
  Clone ID: LIB148-014-Q1-E1-A5
acgcgtggggtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctggtaggattcctcatgcgtgtgttttcttctggctgttgtatctgatgctcaaagtanatgctccgtgtgtcttccgctgctgttccggcaagaaactgaatcccccgaccgtcgtcgtgat

SEQ ID NO: 9888 - DNA, 354 bp, Zea mays
  Clone ID: LIB148-014-Q1-E1-A6
ttcgcccgtcgacccacgcgaccgaggtcgcgtggggtcacttagtctgtagtcaacgatgatgtgctcgagagctcccttaaattcgtcatcattggtactgatggagtctgagatgttgtcactaattaggagtctgtttgcacggtcaaccctattcatgagccgcaggatgtattactgaagcttctcaaagaagcgtcaccattgggagcctctgaacagatcaccgttgtacatcgtcggcgtcctatatcgagctacgggtcagtactgaagctgaaattctgagacgaccagtgatcagtgctccaaagtagttgcagctcggattgctcatgcatctgtgttctt

SEQ ID NO: 9889 - DNA, 420 bp, Zea mays
  Clone ID: LIB148-014-Q1-E1-A7
aggacgcgtgggggaccatggtaattggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctg

SEQ ID NO: 9890 - DNA, 415 bp, Zea mays
  Clone ID: LIB148-014-Q1-E1-A8
attcggccgtcgacccacgcgaccgaggacgcgtgggatagcatgcgccgtccttttatattctattccagcatggccagttcatcaccggcaagggaaaccttgacgggcaaggcccagctgtgtggaccaggagggcctgcaccattaactacgactgcatgatccttcccaactcgctggtgatggacttcgtgaacaacggggaagtgtccggggtcacgctgctcaactccaagttcttccacatgaacatgtaccggtgcaaggacatgctgatcaacgacgtgaccgtgacagcgcccggggacagccccaacacggatggcatccacatggtcgactcatccgggatcaccatcaccaacaccgtcattggcgtcagcgaccactgcatctccatcggcccccggac

SEQ ID NO: 9891 - DNA, 245 bp, Zea mays
  Clone ID: LIB148-014-Q1-E1-A9
gggtggccccacgcgtccggaaatcaccgtcgaaaagcagtctcccaattccaccgaataactaataacatctcctcgagcgcgaggccggcttccttggaccaatccagcagcaagcgacccggccagcaccagcagccatggagatgaagaaggtcctctgcgccgcgctcgtcgccgccgcctccgccaccgccgtgctggccgaggtcgcctccgagtcgccctccgaggcgcccgccggc

SEQ ID NO: 9892 - DNA, 395 bp, Zea mays
  Clone ID: LIB148-014-Q1-E1-B10
aaaagattctccgtactctagcagatggcaaggataaagcctaagcaattgctaatccaaagcaaaacaaagaaggctccatctcgaatcagctactctactatcatcacatggaacttgattgtcatattggttgtgctatctctctatgctacctacagccattggcatcaaaggtctacccaagacttcgaaatggagcttcatgaagctgagcttgctgtgagaccggaggattcaaaaatgataagtagaccaagatatgcggtaatgaacaccgcaaaagggccaattactatagaaatatacaaagatgcttctgctgacgttgtggatagatttatcaacttgtgcaagagttatcatttcaaaggaatgccatttcggcatatcat

SEQ ID NO: 9893 - DNA, 453 bp, Zea mays
  Clone ID: LIB148-014-Q1-E1-B11
taccggtcgcactctcgggtggccccacgcgtccgccacacctcgctcatgtccgctcaacggggcgggctcaacaaccctttcgaaaaattaaaacttctccttgaggcctgagcccctcgccgcggtgagccaagccggcgcacgtcgccccggggctcacgctcaccacgagcccaaccaattaataatatatatatatagctaggatcgatcgtcagtaacatggcaggctccgccgtcctgaagagccccctgtcagtcctcgtctacatcctcgccgccgtgcccgccaacgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtgggcgtcgtgcagcgc

SEQ ID NO: 9894 - DNA, 418 bp, Zea mays
  Clone ID: LIB148-014-Q1-E1-B12
ccaacacgtccgcccacgcgtccgcccacgcgtccgggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacaaccacggcacctccaacaagccggaagccatcacgctcaactgcgccaacaacctgccctgccagggcgtgcagctcatcaacgtcgacatcaagtacaacaggtccgacaacatgaccatgtccgtctgcaagaacgccatc

SEQ ID NO: 9895 - DNA, 412 bp, Zea mays
  unsure at all n locations
  Clone ID: LIB148-014-Q1-E1-B4
gccggaaatggacccgaattctgcatcctacagttccggggccctccttctcttcgccgccatcattgcggaggtcgtcatccccgcatccgccatcggagacaagtgcgccgcctgcaaggccgttgctgcggagctggagattggaatttcgagtgagaagccgagaaatcacttggacttgcgcaaccgcttaaattctaaaggccagagggaggggaaggtcatcgattatagggtcagtgagcttcgggttgtggaacttctggatggcctatgcgataagatgcaagattataccttaaagaagttggaatcaggcgaaaagggatgggttaaagtaacagactggaatagctttcaaactgaaaataaggcagcagcaagagcgcactccanaaaactgtccacc

SEQ ID NO: 9896 - DNA, 403 bp, Zea mays
  Clone ID: LIB148-014-Q1-E1-B5
ttcgcccgtcgacccacgcgaccgaggcagcgtggctaaataattaagtcgaaaatgaacaacgatgcaaacaacagtagcagcaacacggcgtgtgacgctggtaactgctcggtctccgcatgctgggttctggttggtgttgctcaagcggtatttggagttggtgcctgctgatgaaaaatatcccggctgccgcggatggcacggccgtggacgatggttaaccgcctcagcattgggcaaccccggtgagcttgcatgaggcttgccgcggcgcatccgagatgcacacccagcgtggcctacgacaactgcatggcgtcgctgggcgccgacccgcacatcacggaggccggcagcaataacatgcacgggctggcggtgctggccaccaggatgg

SEQ ID NO: 9897 - DNA, 419 bp, Zea mays
  unsure at all n locations
  Clone ID: LIB148-014-Q1-E1-B6
aggacgcgtgggttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggangaggttctgc

SEQ ID NO: 9898 - DNA, 432 bp, Zea mays
  unsure at all n locations
  Clone ID: LIB148-014-Q1-E1-B7
acccacgcgaccgaggacgcgtgggttgtgatgtcccgatggttgaagaggccatacacgccatctgcaagagccacggaacaccaccagatgagaagattgccatcaccaaagctattataggggtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggangaggttctgc

SEQ ID NO: 9899 - DNA, 436 bp, Zea mays
  Clone ID: LIB148-014-Q1-E1-A10
cgggtggccccacgcgtccgccaacacgtccggcagccagcccatgtctggtggcgctcccgacgagcttccaccggtggccaagacctctgccacgcccgaaccgtacgcatctctgaacgtcgccggcggcgggcagcccaacgagccggcggcggggaggccgccgaagctgtcgatggagacgttctcggggatgatcaagaggccgttcgccaagttcctgagcccggtgatcaagggcgtgtgcgccaagacggagtacccggaggactgcgagtcgtcgatcgggggcctcccgggggccgcgtcggcggcggccacggacagcgtgggcgtgctgaagctggccatggaggcggtgcggcagaaggccatcgaggcgatgaacgcggccacggacaggatgaacgcgccgggcacggacccgacgacc

SEQ ID NO: 9900 - DNA, 433 bp, Zea mays
  unsure at all n locations
  Clone ID: LIB148-013-Q1-E1-G6
accacgcgtccgctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccanggaggccaagagcggggtggacgagttcgcggcgaggaaccacgagggccggccgatggagt

SEQ ID NO: 9901 - DNA, 434 bp, Zea mays
  Clone ID: LIB148-013-Q1-E1-G7
acggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgc

SEQ ID NO: 9902 - DNA, 436 bp, Zea mays
  unsure at all n locations
  Clone ID: LIB148-013-Q1-E1-G8
aaacggcttcatctctgccgccgagctccgccatgtcatgacaaatcttggggagaagctaactgatgaggaggtagacgagatgatccgtgaggctgatgtcgatggtgatggccagattaactacgaggagtttgttaaggtcatgatggccaagtgagccacagaagcataagctcaaggcagagaggattgtgcattgcatattagtcaagatgcaatgcaactcttatttcatcgacttccagtgaaacattctgctagttgtagtttttgaaaggcaatgcagttgctgctttgttcttccctccagtgtgttttcagaactgttgattcatgtgaaactgtaatgattgccctccctgctgtgtcttggttgcagttganaccatatgtagctacattccccctcccaccacctccacacatcaacttc

SEQ ID NO: 9903 - DNA, 373 bp, Zea mays
  unsure at all n locations
  Clone ID: LIB148-013-Q1-E1-G9
agatttccaagaacagtgttgctagaagattctcgaccgggactctatctacgatgaaatctcatagcaatgcacctgcaaaatcaaacggtttatctaggactggtgtacaaagaaaacttcacttggatcgtcagccaccgcagaagagtacaaaaccgaccgagaacagcaataagctagctacaaatcgggtcccagcccggaacagcccagggaatcctgtacttaggcattcacgcagcttgcctgaaactggtcgacgagcagtacagaaggtctcatcaatcacagagaaactgtcgcaaatgtcggtgacctccagaacacgaagcgccgtgaagcctgccngcccgacgatgaaagccggaca

SEQ ID NO: 9904 - DNA, 340 bp, Zea mays
  Clone ID: LIB148-013-Q1-E1-H1
gtcgtattacgatgactactaataagcccctcctcctcctcgccctggcgtccgcgctccttggtgctgcaccggccgccgcgaacgcgcccggcagtgcgttcaggaggggggtggcgatgaatcatcagagctaggcgctgtacgcgcacaagtccctcggggacgggggcaaggagcccctggacaagaagctgtcggacgcggagaataagaaggtcacgtacgttgtggaccccagcggcaatggcgactacaccaagatcaccgccgggctggaggatatcccggtgaccaacaccaagcccctgattctggatgtcaagccctgcgctcagtt

SEQ ID NO: 9905 - DNA, 313 bp, Zea mays
  Clone ID: LIB148-013-Q1-E1-H10
tctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgaactgctgc

SEQ ID NO: 9906 - DNA, 396 bp, Zea mays
  Clone ID: LIB148-013-Q1-E1-H12
cgctgatctacagctacaaggccgccgctagcgggttcgccgccaagctcacgccggcgcaggtcgccgcgttgcagaagcatcctgacgttgtgcaggcgctgcctgacgtgaagtacacccttgaggacaggaaccacctcaactgaaccgagtgcggctttcaccaacacgatacatagctcggcactagtgccatctcatgttagcaagtgtgcatgtgcccacaccctaaggtcagaatttatataagcatgctatgtgtgggctagtgatggtaatttagtctcttcataaagattgaatgctgtacccggagcgtacgtacatattactacccagcctgctgttcattgtttgatatcaccgtggattcacgagactgctggcactgat

SEQ ID NO: 9907 - DNA, 458 bp, Zea mays
  Clone ID: LIB148-013-Q1-E1-H2
ccgggtcgacgtccgacaacatgatcctccacaacctgcacgtccacgacgccgcggcgcacggcggccgccccaatcggggacccgcagcaacaacggggcgttcccgggggaaagcgaacgcgacggcgtccccgtgatggggtccaccgatatccggatcgagcacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatca

SEQ ID NO: 9908 - DNA, 436 bp, Zea mays
  unsure at all n locations
  Clone ID: LIB148-013-Q1-E1-H3
accgcatcttctcgttcgcggagatccaggcggccaccaagaacttcgacaaaaaggcaatcatcggcttggccgggtccggcaacttgtacgtcggggagatcgacgacggcacaaaggtggcggtgaagcgcgggagcgcggagtccgagcagggcatcaacgagttcaacacggagatccagatgctgtcgaagctgcggcaccggcacctggtgtcgctgatcggctactgcgacgagaaccaggagatgatcctggtgtacgagtacatgcacaacggcgtgttccgggaccacatctacggcagcgaggggaaggcgccgctgccgtggaagcagcggctggagatctgcatcngcgcggcgcgggggctgcactacntgcacacgggcacggcgcaagggatcatccaccgcgacgtgaagaccaccaa

SEQ ID NO: 9909 - DNA, 413 bp, Zea mays
  unsure at all n locations
  Clone ID: LIB148-013-Q1-E1-H4
aggtccagggacgccgccctgcacccgcgccatgccgacgctcggcatcgctcggctgctggacgcctccttccggcgccgcttcgccgcggcgggcctcgtcaaggcctccgtcccgctggacggcggcgcgaccacggtgcactgctggcgcttcccgccgagcgccgacgacggcggcggcgaggacgcccgccccgtcctggtgctcctgcacggctttgggcccccggcgacgtggcagtggcggcgccaggtgggcccgctctcgcgccggttccggctcatcgtcccggacctgctcttcttcggcggctcgtccacgtcgtcggcgcccggcgtctccgaggcccancaggcggaggcngtggcgaaggtcgtggcggctgtggcgccggcgccggcgcgcgtgt

SEQ ID NO: 9910 - DNA, 432 bp, Zea mays
  Clone ID: LIB148-013-Q1-E1-H5
accacgcgtccgggaacatccatcgatctccccccagcggcgaggagagccggcggccacaggaaggagaaatggcttccgcacacaacgctctccgggtgtttttcatcctagccgtggtatgtgccgtatgcacagcgaaaaggacaggagccaagaaggaagaatcggcggcagcccctggtggtgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaagggcagcagcatcgccatccagctggatggcaacctgctgggatcaaacgacctga

SEQ ID NO: 9911 - DNA, 434 bp, Zea mays
  Clone ID: LIB148-013-Q1-E1-H6
ggcgccgccagcgacgacgacgcgtcgttccttgaagagttccgaaccaaggtggccaacgggaacgactctgtccgctatgaagacaggacagtgggagggaaagaggaagtcgttgaggcgatcaaggcaacagggcggtgcaacctgttcctcgtcggacagggcacgccctgcatgccgctggttgactggagcacggacagcccggagctcgggccggtgggtacttacctggcgctgccggaattctcgacggtggcatctgtgctggtcatgaaacagtacgatccgatggcgaagcacgacgacttcgtcgaggaggtggccgacatagcggtggacgttgacacgccgggccccagtaaccggggaaacaatactagcttccatgccggatgatacgtgctggtgttagatgtattattaacatg

SEQ ID NO: 9912 - DNA, 311 bp, Zea mays
  Clone ID: LIB148-013-Q1-E1-H7
agcggcgccgccagcgactacaacgcttcgttccttgaagagttccgaaccaaggtggccaacgggaacgactctgtccgctatgaagacaggacagtgggagggaaagaggaagtcgttgaggcgatcaaggcaacagggcggtgcaacctgttcctcgtctgacagggcacgcactgcatgccgctggttgactggaccacggacagcccggagctcgtgccggtgggtacttacctggcgctgccggaattctcgacggtggcatctgtgctggtcatgaaacagtacgatccgatggcgaagcacga

SEQ ID NO: 9913 - DNA, 443 bp, Zea mays
  unsure at all n locations
  Clone ID: LIB148-013-Q1-E1-H8
tccgaccacgcgtccgcccacgcgtccggcttgcgcgagcgcagaaggcacacacgtacagccatggcgaactcgtcgtccggcctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaggttcanganggagctggacggcatccagtgcgagatccaggccaccgaccccaa

SEQ ID NO: 9914 - DNA, 361 bp, Zea mays
  unsure at all n locations
  Clone ID: LIB148-013-Q1-E1-H9
gctgttgangaaaccccgacgccaagcaccttccccaccggagcttcgctgacctgctgtccacgtttctcctcgctgtgcttcatcgtgatggtgtggtgaggtgaggtcgtctacccccttccctcgtctatctcgctctcgctccgccccgccgtagttagctgctgcgcgctcgccaccatggccagtgccggctccctgcaacgcagaccgcgtgggggctgggcgcatgtgtgttcttgctcctagccgccgatgcccgctccggcgagcagcagccccaccgcgcgtcnctggcgccactggccgtggtagcagccatggcattgctctgcgcgcccttgcacctggccaaaaa

SEQ ID NO: 9915 - DNA, 150 bp, Zea mays
  Clone ID: LIB148-014-Q1-E1-A1
agactgcaatcatcgtcattacttaaaatacgatcggagccatgtaggaaaagactacggggatgcacatgttccaggtgcaccaggcggatgcgtagctgctgttcttggttgtgttggctccgttacccgggtcacccaggggacctc

SEQ ID NO: 9916 - DNA, 364 bp, Zea mays
  Clone ID: LIB148-013-Q1-E1-G5
aaaactgcgtacaccatgtccatcagaaatactagttccaattccaacacatgcgctgtgcatcaaggtcaacaccgggagttttttcgcacggtaatttgaaaatgaaattgtggtggaaactgtgtaatccgccaatccggtgcggatctgcacagagaaactctggtggctgctgtgactaatgaaaagtggttattctggcttggccgttgtccatcgagggagatgtaatacctgatcagccctgaaatcttaaagggctcccttctttcctcatgctgggacaacatttatttacatcgggtgtgtacttggagttctctccatcaccgaatatatgtcggcgtgattgctggtatct

SEQ ID NO: 9917 - DNA, 387 bp, Zea mays
  Clone ID: LIB148-013-Q1-E1-F2
gggtcgagcacgcgtccgagcgcaatctggctcgttcttgtgatctatctagccgtttcttgagtcagtgctggaaagtcaaactgttggaggaaacctcaacggggtgcttcaacaaacgcgaaagtgtcgctgtcatttagcgcgtcctgaatggatttgacctgatgggcctgatggctgttgtccttgatttgagctcgaaggatgatgaaatggggggctcaacatcagcactcccgcggattcctactacgacgtaccgtcatattgcactgacggtgtacccaagagcaagttcaagatcaaggctggcaagacattaactgctcggaaatggtaggctgcatttagtcgcaatggctgtcttgatattgcctcagtcct

SEQ ID NO: 9918 - DNA, 425 bp, Zea mays
  Clone ID: LIB148-013-Q1-E1-F3
caccaattttggaaggtccaccacctcctcctcggcccgcggcaaaaatggcgtgggagatccgccacctcacctcctccaattctcgcgctcgcgcctgatatggaaggtccgtcggagggactcgggcatcgaggccatggcggagccgcaccccttctcccccctgcctcgcgcgcggcggccgagatggtgctgagcgcctgagcctgccctcctacgggctcactggcacgctctccacggccatcgaattccagagctgcgattcccgaggccatggagcagcagacaatatcaattgccaaagctgccattacaatagtactcattttagggacttcagttcttgcagctgtcaatccaattgcaggatgctatgacgctcttaaggttcgtaaacatgtatttattgatgcaataat

SEQ ID NO: 9919 - DNA, 436 bp, Zea mays
  unsure at all n locations
  Clone ID: LIB148-013-Q1-E1-F4
aacacacgtccgcggcaccttccacaccgagcaggccatcgagtacggcaccaacatggttggtggagtgactcctaagaaaggtggaactgaacatttagggctcccagtgtttaactctgtagcagaagctaaggctgaaacaaaagccaatgcaactgttatatatgttccaccaccatttgccgccgccgctataatggangcaatggaggctgagctcgaccttgccgtctgcattacagaaggaatacctcagcatgacatggtgaaagtgaaggctgcactaaacagccagtctaaaactcgattgattgggccaaattgccctggtatcattaagcctggtgagtgtaaaattggaatcatgccaggttacatccacaagcctgngcgtattgggatcgtatctcgttctggtactttgacatatgaa

SEQ ID NO: 9920 - DNA, 428 bp, Zea mays
  unsure at all n locations
  Clone ID: LIB148-013-Q1-E1-F5
accacgcgtccgcgcgcctctgcctgtctggccatagccatccacagccacgcaagggcgccacgccgcaggcttttgcatgcccccgcgcgtggaaattcgaatgcgcagagcccaggcgccgcggctccgtgtcggcggcgttgcccagcggtccgcctccgcctccgcttccctgtagcacgccgccgtgcgcctggaaatattcattggcattggcaatgcaaccacgatgacgccctgcctttttgacgcccccgcatctgctgctggcgcctggctggctgcttcttcacaccacatctcgcccggccccggcctatctagttcccatgcgtgtagagatgttgttactgctcccgctggcccatgggccggcatggaccatggggatgcanatgcaattgtggccagcgatgcgtgcgtac

SEQ ID NO: 9921 - DNA, 367 bp, Zea mays
  Clone ID: LIB148-013-Q1-E1-F6
cagcagcctccaataaaagccagcacatccaaactaagaaccgagagacctcaggcctcaggcaagccgaccgccgacgtaccaccgcgccaacccgagagaaagagggggaggatcatgacgatcctcaactccgcgctcctcgtagtcgccgtctcggtcatcgcagtgctggaccccaacgatgctgccgtcgccggtgaccaagacgactccgactcatccgtatcagcaggtacccgtcacaggtgcaccgaggcgtctgccgcaagaacaggttcaggatcagggctggcagcacactatgtcctccaaactctcacgctggatttagtcgcgatcgtcgtcttgctattggctcagttcc

SEQ ID NO: 9922 - DNA, 433 bp, Zea mays
  unsure at all n locations
  Clone ID: LIB148-013-Q1-E1-F7
aaagagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaaggggtcgacgttccacaggatcatcccggggttcatgatccanggaggcgacttcaccaacggcaacggcacgggggg

SEQ ID NO: 9923 - DNA, 436 bp, Zea mays
  Clone ID: LIB148-013-Q1-E1-F8
aaggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacggtggcaaggagcccctggacaataagctgtcggaggcggagaagaagaaggtcacgtacgtggtggaccccagcggtaagggcgactacaccaacatcaccgcggcgctggaggatatcccggtgagcaacaccaagcgcgtgatcctggatctcaagcccggcgctcagttccgcgagaagctgttcctgaacatcagcatgccgtgcatcacgttccggtcggaccccatgaagcccgccgtcgtggtctggaacgacactgcgg

SEQ ID NO: 9924 - DNA, 349 bp, Zea mays
  unsure at all n locations
  Clone ID: LIB148-013-Q1-E1-F9
aggtcagttcaggtacggtggcgatgaggtcgtccgtggcccgcctgattcgctcctcctctgcctcgccctcccgtctcagtggaaatgcattcttcggcaatgccacacccagtgatcagaggcacattgagaagccttttaaagtgaaggaggcagaacctgtgaatgtgacaaaaccttcaccacacaagctgctggttctangangaagtggtttcgttggatcacacgtttgcaaagaggctttggacaaaggtttagttgtctctagtcttaatagatcgggaaagccatccttaaatgaaccttgggctgacaaagttatatggaaccaaggcaacctcct

SEQ ID NO: 9925 - DNA, 436 bp, Zea mays
  Clone ID: LIB148-013-Q1-E1-G1
agtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaaggacaagtggtgcaagccgccgcaggagcacttcga

SEQ ID NO: 9926 - DNA, 383 bp, Zea mays
  Clone ID: LIB148-013-Q1-E1-G10
gacccttcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatgaaggatgaacggttgcggccgatgatcgatgtgtccgtcggcatgtcgatcactca

SEQ ID NO: 9927 - DNA, 389 bp, Zea mays
  Clone ID: LIB148-013-Q1-E1-G11
agggaaaaacttggcatttccacaatcagacttgcttctggtgacgccagaaattgtcaagaagacatactgtttgaagatcaggcaagagctgatgcatcgccttccagctgtgacgagtcgagtggtgtagcaagccttaaaattcagatttctctgttgaatataagactgagggcacttgaagaggatcaggagttcctcaatcaggtattgagttcgctccaatgtggtagtgatgggctgcagtgtatacaggagataagcaggcacttagcagagttgcgaagagttgtggctcactaaaatgaaaatggttttgccccgagttcacactttttggccgtcatgaggttctcctttgtaacggcaaacctatttgcagtcat

SEQ ID NO: 9928 - DNA, 391 bp, Zea mays
  Clone ID: LIB148-013-Q1-E1-G12
gaccgacccgtcagctcgcggttcatgacccagaaaccggcgtcggcgatagtgtcaaagctggagcagatcgctgagacagagcgcttcatggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctctta

SEQ ID NO: 9929 - DNA, 377 bp, Zea mays
  Clone ID: LIB148-013-Q1-E1-G2
aggcgacttcggcctcagcacctgctactacgccgaggtggagaaccacgggcccggcgccaacatgagcgaacgcgtaaagtggaggggtatcaagaacatcacctaccagcacgcgctgcagaagtacaccgtcgagagcttcatccagggccagcactggctcccacagctcggcgtgccattcatcccggggctgctgccgcagcagcaatcgggcaggatacactgacatctaaggaagataatatatgatcggcaggctgcgttgtcgatatgacgtggcactaacatgtacgtaccatggtttagtttgttggttggtttatgctattttgactactactttttttatatttgataaaaaaatgcagtac

SEQ ID NO: 9930 - DNA, 447 bp, Zea mays
  Clone ID: LIB148-013-Q1-E1-G3
gggtccacgcacgcgtccgaccacatcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcaattccagccccacctcatgatcctcggccatggccactgatgagtgtaaatggttggttggttggtcgtcctcagccgatctactgtacgacacgat

SEQ ID NO: 9931 - DNA, 357 bp, Zea mays
  Clone ID: LIB148-013-Q1-E1-G4
cgtccgaccatattatagtgctagaatggcttgttacctagaggccgttgatctaggtgtttggaaagtcactcgtgacgggatgaaacctctcaagaatcccgaaaaacccacacgagtgaggaaaaagaaattcatttaaatgctagagccaaaaattgcttgtatgaatctctcagcatggatatttttaatcaagtatttaccttgagaactgctaatgaagaagctaatttatttaattaataaagatgaataaaacgaagatacaaccagttgcacttcaggaagatgtgccataacttgacaaggctcccgaaggtgaccacacaaaaaaaaagggggggccgcctcaaa

SEQ ID NO: 9932 - DNA, 412 bp, Zea mays
  Clone ID: LIB148-013-Q1-E1-F12
aattcaaagctcgaccgacccgtcagaagcaacagtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatac

SEQ ID NO: 9933 - DNA, 435 bp, Zea mays
  Clone ID: LIB148-013-Q1-E1-D8
accacgcgtccggtgacgacgctggcgtggacggcgctggcgttcaagcccgagctggagtcgaccaaggagctgaagcacgtgcaccaggccatcaagtggggcaccgactacctgctgaaatgcgccgccaggaagaacaagctgtgggtgcaggtcggcgatcccaacctggaccaccagtgctgggtgcggccggagaacatgaaggcgccgcgcacgctgtacgagatcgactcgaagacgcccgggacggagatcgccgccgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgac

SEQ ID NO: 9934 - DNA, 405 bp, Zea mays
  Clone ID: LIB148-013-Q1-E1-D9
gaccgacgcgtcaacccacgcatccgcttaccctcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcagagaatccaccaatgacgatggccatcgcttgacgatggaatgctccactcccgtctcctccagtagcccttccactcgcaagaagcgcggggcgttcagcctcttcaaggcgatgttcctgtccttcggccggagccacgac

SEQ ID NO: 9935 - DNA, 426 bp, Zea mays
  unsure at all n locations
  Clone ID: LIB148-013-Q1-E1-E1
atggaagggaatgagccatgcttcttcaagacgtacttttcttgggataacacaaaatctttggttcatggaaattccttccagaagaaactctcgctgctttttggattgcgttctgagggtgcacctangagctctggtaatggtgggccaactcagagggcatctgcattagcagctctatcatccgcattcaatccatcatctcaacaaaggctgtctaatgagaggcctaaaagcacaggcgatggacccacgcaacgtgcctcagcactggctgccttatctaatgcattcaacccatccttaaaacccaaaacatcacctccatctcgctcaagtcgaggttctcaaagagcagctgctgtagctgctctatcctctgtgctgactgctgagcaatctggatcttcagaatttctacga

SEQ ID NO: 9936 - DNA, 342 bp, Zea mays
  unsure at all n locations
  Clone ID: LIB148-013-Q1-E1-E10
agcccacgcgtccgctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcncagcagtccaacctggtgctgtacggcaggattcagttgcaaggcaaatgcaccgag

SEQ ID NO: 9937 - DNA, 282 bp, Zea mays
  Clone ID: LIB148-013-Q1-E1-E11
ggccggccccttggccggccccttggcctcctcaaggcggcggtaacccaaccccaaccaaggcagcgcaatcaaggcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgaggagatcgtgaacgagcacaacgtgttccgcgccaaggagcacgtgcctcggctggtgtggaacg

SEQ ID NO: 9938 - DNA, 417 bp, Zea mays
  Clone ID: LIB148-013-Q1-E1-E2
gcgtccgaacgtaagcggcgccggcgacatcgcggcggtgtcggtgaaggggagcaagcccgttaagtggacgggaagaagcgcaactgggggcaaatgttgcaaaccgggaagacccaactgcgagtcactgacgttccgggtgatgaccagcgaccaccgcaaggccacctcatggcacgttctccccgctgactggaagttcggcgtcacgtaccaggcgtccaagaacttctaagtagccactttccctcctcttcttcaacctgcatgccagcaagcagccatacggatgataacatgcatcatgcatgcatattcattctttcgctcatgcactccgatacggtgccggagttaaaaaaaaatgtaaatcaatgtgcaaattcaaatgacatcctaaccagttgtgatcaa

SEQ ID NO: 9939 - DNA, 400 bp, Zea mays
  Clone ID: LIB148-013-Q1-E1-E3
gggtccacgcacgcgtccgaactcaccccgccttcacgcctccctcaccaaataaggtcccgcccttttccaacatccacagggggaacaggaaaccaccggcaatggcctcaattccggcaacaaccttcgccgtcatctaacccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaagaggacatctg

SEQ ID NO: 9940 - DNA, 370 bp, Zea mays
  unsure at all n locations
  Clone ID: LIB148-013-Q1-E1-E4
cgtccgaaccaagncgccttcacgccaccctcaccaatgtaaagttacagggaattaccgacattcacaaggaggaaaatgaactcaactggcagtgaactctagtccagcgaatgactatcgcagtaaacggggcggctcccctacagtttcaaagctgagatcaccgtcaaggcaactcaagaccccttcaataagcatcacaaacatcaattcatcgccttgcatttaaaaaatcctgaccagggaaacacccttgcgtctcccactttaacgtgctgtcagaaaacccccctttcgcaaccggggataactcatacatggcccaccaggtttcccctcccaaaagcttgtacaccgtaaaggtcaa

SEQ ID NO: 9941 - DNA, 413 bp, Zea mays
  Clone ID: LIB148-013-Q1-E1-E5
aatggatgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcg

SEQ ID NO: 9942 - DNA, 438 bp, Zea mays
  Clone ID: LIB148-013-Q1-E1-E6
aatccgagggcaccttctgctacatcgacccggagtaccagcagacggggaagctgggcgtcaagtcggacatctactcgctcggcgtgctcctgctgcaggtggtcaccgcgcggccacccatggggctcacgcaccacgtcgagaaggccatcgacgcgggcaccttcgcgcagatgctcgacatcaccgtcaaggactggcccgtcgaggaggcgctcggctacgcaaagctcgcgctcaagtgcacggagatgcggcggagggaccggccggacctcgcaaccgtcgtactgccggagctcaaccggttaaggaacctcggccacgcgtacgaggcacgcatgagcgccgtcggggccaacagtggaagtggcgaaagtaatgaccaggtcagcgggagctcgccgacggcgggtggttcatggagaacggcgg

SEQ ID NO: 9943 - DNA, 429 bp, Zea mays
  Clone ID: LIB148-013-Q1-E1-E7
accgcggccaccccttcctgcctatatttctctctctgtcttgcgcgacagggagagaccagcgccaacacctccggtttcttgattgggtggtgatcggtgaaggaaggagaaattaagatgagcctcttcgggcttgggagcaagaatcagaagacgttcaggcctaagaagaatgcaccgtctggcaacaagggtgtgcagctgaagaaacacatcgatgcaaccttaggaagcgggaatttgagggatgctgtccgattgccaccaggggaggatctcaatgaatggctagctgttaacactgttgatttcttcaaccaggtgaacatcctgtatggtactctaatggagttctgcacaccagctacatgcccaacaatgtcagctggaccaaagtttgagtatagatgggccgatggggtgcag

SEQ ID NO: 9944 - DNA, 267 bp, Zea mays
  Clone ID: LIB148-013-Q1-E1-E8
ttcttgtctctttttctctctctgtcctgcgcgccgggcagatacgatcgcctacacctccggtttcttgtgtgggtggtgatcggtgaaggaaggggaacttaagatcaccctcttcgggcttgggaggcaatctcagaagacattcaggcctaagaacgatgcaccgtctggcaacaaggctgtgcacctgacgaatcacattcgtctaaccttatgaagccggactttgaggtatgctgtccggttgccaccaggggacgatct

SEQ ID NO: 9945 - DNA, 379 bp, Zea mays
  Clone ID: LIB148-013-Q1-E1-E9
agcccacgcatccgcggacgcttgggtgattctcgtcgtcgccttggcgacttgtacaaacaagtctgttgatgcccgcgtggtccaccccatcgtcaccctcgaggccgatggctcatctcccacctctggcgatggtcgtcgcctgatcagctccaccaaccaagatgaacttggagcgttatgccaacagatgcactacaagacgttgtgctccacgatgacgacactgcctggggtgactacgccagagcaactcttagatgcatccctgcggattacagcggtgaaggcagcgatggcggagatgaagctagacaatgcaataaaatcaggcagtgctcagggtaacccgatgatgtcgtcgctaaagacatgc

SEQ ID NO: 9946 - DNA, 363 bp, Zea mays
  Clone ID: LIB148-013-Q1-E1-F1
gggtccacgcacgcgtccgaaggaatccgccgacatctccagtgcaaatcatgtggtcattccgggtggattgatgccgggggaccctgggattgttcaccggaaaatctacacagcggcaaagcgactctgagcggtgaccggagtgattacgccatcccatttggagaagaacatgtggttcaagtggagccacatatcaaggagttcgatttgatctaggtggcgtctcccagttgactttctgacgccaaggatggattttagatcctgttatatttatcttttatttttgtaagacttccgctatgtaatatgtactctgattatattgtgacatttatctctatacactctgttatt

SEQ ID NO: 9947 - DNA, 397 bp, Zea mays
  Clone ID: LIB148-013-Q1-E1-F10
agcccacgcgtccgcctctccctcaatctaaggagaggagagatatgcagctcacgagctccaccaaatgctgacctcccaaagctgtggtcgcgatccaaacagaagggaaatgatcaggcgacaacccggcatggatcggttcctgcagctgctggccgccggcgtggccgtgctactgctagtggcaccgcgggccatggctgacgacgacattgtagaagtcggcgtcaactggggatcgcagctctcgcacccgcttctccccggctccgtggtgaagatgctcaaggcgaaccgcatcgccagggtcaagatgttcgacgccgactcctggcccgtcggagcgctcgtcgactccggcattgaggtcatgctcggcatccccaacgacatg

SEQ ID NO: 9948 - DNA, 330 bp, Zea mays
  unsure at all n locations
  Clone ID: LIB148-013-Q1-E1-F11
attcctaggccgaccgacccgtcaacggtaggagcattgcttcggtggtccaacatggggcaacgaacggtgggcaagatgacgaacaataagcccctcctcctcctcgccctggggtccgcgctccttggtgcggcgccggccgccgcgaacgcccccggccgggcgttcagcaactgggtggcgatgaaccagcagagctacgcgctgtacgcgcagaaatccgtcggggaacggggcaaggagcccctggacaagaagctgtcngaggccgagaagaagaaggtcacgtacgtggtggaccccagcgggcaagggcactacaccaac

SEQ ID NO: 9949 - DNA, 425 bp, Zea mays
  Clone ID: LIB148-013-Q1-E1-D7
agccgcccccacacagccggctcccgcgccggcggcttcgtctccgcctcccatgtcggggatcccgccgcggtacgacctgtacgccacgtgggacgcgtgcctcgacctcgccagccgccgcgtcgcgtactcctccctcggctgcgccttcgcgggcctcctcctcttccgtatccctactactcgctgggcatcagttgcccttggcgctggtgtggggatcggggctgcatacactgaatgctcatacttattcactggtgctccagtctgttcacccaaactatcacctattccctctgcacactctgatgggggacatacgtatacacttgctgttggcttggtccaactcggtggagtttgtgtatgtgtgaagtaacggttgtttcatgctggatattgcgctacttctggccata

SEQ ID NO: 9950 - DNA, 424 bp, Zea mays
  Clone ID: LIB148-013-Q1-E1-C3
actgcaatcatctcctccatcaccaccagcaagctcaacaacagtcagctcgcgataataatgaagagccgcagcatggcatcatcggccgcgctcttggtgctagccctcgcgctagtggcggccaccgccccacaggtagcggaggcactgaagaagagagcggcggacagcggcgaggctgcggaggcgattaagatccagcacgacttctgctctacgctgtgcgagggcaacaatgggactgacctggtcgtgtgcaaggagtcctgcgcgctctcccagcagtctaacctggtgctgtacggcacgatccagtgcacaggcaagtgcaccgatcagcatggcatcacagcgccggtcatgaatgtctgccaggaggagtgcgagtcggcgtacgtggtgaatgcggccgatgtcacca

SEQ ID NO: 9951 - DNA, 429 bp, Zea mays
  Clone ID: LIB148-013-Q1-E1-C5
aatggttgatgccttcaactacacagaccactacctggggtctgtgctggggcggtacgatgggaatgtgtacccagcgctgtacgaggaggcgtggaaggaccctctgaacgagacggtggtgcccgaggggtaccacgagtacctccgccccttgctcaagcagcagctcaagctctccaggctctagtctgatcggctaccccccctggaattctccatggcggctgccttctcagaaaatctcacgcgacctccgaatgaaagtgatgtaagctactaacgattcttgttagagccaggaaagaggctctccagccaattataaatttattcctcaagctctgaggatcaagttcaagctgtggattatataggaagcacgtttaataattaataaagagggagaggatgagcatctctctgttg

SEQ ID NO: 9952 - DNA, 337 bp, Zea mays
  Clone ID: LIB148-013-Q1-E1-C6
acgcatccgaccacgcgtccgggccgctagtctgatgcgcatctgcacctacaccaacatcgtggataacacctccattgcatcgagcggatctgtgggcctgttgttagtgcggggctgggcccagcgcgctgatgccaatgccacctccagcgtctccgatctaggcggatcagctagcggtggcgccgctgcgcttgtggcgctggatgaccatctcgatgtcagattgtcaattgcgtcccgttatctgatcatgaacccttgactgggcatgaccatcgtcgactagttcatccatcttcagggactatctcattgttcagcaccattccct

SEQ ID NO: 9953 - DNA, 430 bp, Zea mays
  Clone ID: LIB148-013-Q1-E1-C7
aaccgggacgggctcctccgtctccgatggtagcgacagccaggaggctggcgcggaggaggcggcggtagaggaggaggtggtgaggctgtcgccggagctggcgatgcacggcgccatcgagccggtggcgctgccgtcgtcgacgtcgaggcggcggctgtccatcagcgtgagcaagaagctgagcctgaatatcccggacaagctgcggctgagccggcgggagcacaaggaccaccaccatcacaaggtggagtcggaggacacgctgtggaagaagggcatcatcctcggggagaagtgcaggatcccgggggagcgggaggcggagtgcgctgaccccgacgacgacatcgccgccgccagcttccgccggtccagctactcccggcccgtgtcgcggtcgagctcgttcgccatgcaccag

SEQ ID NO: 9954 - DNA, 427 bp, Zea mays
  unsure at all n locations
  Clone ID: LIB148-013-Q1-E1-C8
accaactctgacaacatctctagcagagatgacaagagcagtaatgtggacaccaccacttccagtgttgtcaacaaagatgcgaagcgcagcattagaagtgtcgttaattcttatatcaagaacttcgatgcaaagtgcaacactggaagcactgctaacagtgatgctagggacccatcagatacgaaatccagcactaaaattgttagtagtgctgataatgccaagtgtgtggacataaaaccgatcaatggaagtgataagagcaatgacaccagtgataagagcaatgacaccgtcgatgctaatgtgaaatccaactctggaattgttgcaaacagtgatgctagtaacaccgatgtacagactaacactggaagtgtcaacaacagcgatgattacagcattgactcanaaccaaaca

SEQ ID NO: 9955 - DNA, 372 bp, Zea mays
  Clone ID: LIB148-013-Q1-E1-C9
acacatagtagacaacgcaattagctaggaatagcatccatggcgtccggggctgctgcttcctcggccctcttgctcctcgtcgcggccttggtggccaccagtgcgagggcggccacattcaccatcaccaacaactgcggctcgacggtgtggccggcggccaccccggtgggcggcggcacgcagcttgaccccgggcagacgtggaccgtggacgtgccggcggggacccagtccggcagggtgtgggggcgcacggggtgctccttcaacggcggcagcgggagctgccagacgggcgactgcggcggcgcactctcctgcacgctctcggggcagcctcccatgacgctggccgagtttcaccat

SEQ ID NO: 9956 - DNA, 432 bp, Zea mays
  unsure at all n locations
  Clone ID: LIB148-013-Q1-E1-D1
atgcataccaggggagacttcacctgtgacgcttcaggggctcgtgtgggggggggatctgcctttaaaaaggggttgatcccccgggcagtagacatgcctcgctcctcttacgaccaccgcgccctttcgccttccgggcccccagatggggtgcgccggtgttctctggagggatccgtgtcaaggtcgtctcttccggcgacttcactgtcggagagcgtgcgctcgtggtggtgtcgccgatcttgtcttcttcctgccaccgttggaggggtgcaacccaatgggggttggcatccttccaccaccattcggcttcaaggattttcatcatgcagcccggctgcagtcccccgtcngtggtcatccagaaggatgactaccagccttgtggtggggagaagcaaaccgggctgtggcctccctcct

SEQ ID NO: 9957 - DNA, 388 bp, Zea mays
  Clone ID: LIB148-013-Q1-E1-D10
aggggagcaggcactggtcaatgctccaagcacccatacaagccaagcagttgagaccaacttggctggaggctttgacaagctgctacttgacagcctctacgaagacgaggccaggaggcagcagatcgccggcgcgacctacaccggtagcctaggagcagccaaccctttctgcaccaatgccagcgatccgttcaccatgtctagcagatttgcaccaccggctaatgtgcagttggcactgatggctcagaaccaacagcagtattaccaggcgcagcagtattaccaggcgcagctgtatttccagccacagcagcagcagtattttcagcagcatcaacagacgttggcaatgccaatgccaaacatgtatcaccaccag

SEQ ID NO: 9958 - DNA, 405 bp, Zea mays
  unsure at all n locations
  Clone ID: LIB148-013-Q1-E1-D11
aattcntaggccgacccgacccgtcaggccccctaacgtccgtgcccaccaccctcgctcgtcggcgtcgtccccctctttctctctcctgtgccccggccaagaaggcaaggctgcctgccgactggttggacctggacgaaggaggacgagaggctcgctcgtcgctggcggttggtacgtgcgcgcgcgatggacaggggaacggtggaggacctcatacggcggttgctggacgggaagaagcacaaggcgacggggaagaaggtgcagctgaccgagaccgagatccggcacctctgcgtcaccgccaaggagatcttcctctcccagcccaacctcctcgagctggtggcccccatcaacgtctgcggtgacatccacgggcagttctcggacctgctg

SEQ ID NO: 9959 - DNA, 251 bp, Zea mays
  unsure at all n locations
  Clone ID: LIB148-013-Q1-E1-D12
agctttctacctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcncttcccacagcacccaagcagaccacagcaacggctgcaacccctgctggaacgccgtg

SEQ ID NO: 9960 - DNA, 456 bp, Zea mays
  Clone ID: LIB148-013-Q1-E1-D2
gggtcgagccagcgtccgaacacacgtccgcccacgcgtccggccggagcgacgacagcatgaagaagacagacgacgacaccacgagccccaagaagagagccatcgcggctgctgatgacgattgcaagcctgccgatgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaggtgggcatgaccagccgctacgcgtccgctgaggatctgcaccagatggacagcgaccaggaaaaagggtgctgagggtggcgatgacggtgacagcagttgcccacacgccatcgacatgcaggcggaggagttcatc

SEQ ID NO: 9961 - DNA, 353 bp, Zea mays
  Clone ID: LIB148-013-Q1-E1-D3
gcgtccgattcggagtggtgctgctggaggcgctgtgcgcgcggccccccatcgacccgcagctgccccgggagcaggtcagcctgccggactggggcatgcactggaagcgcaagggcctcatcgagaagatcatggaccccaagctcgccggcaccgtcaacccggagtcgctcgccaagttcgccgagaccgccgagaagtgcctcgccgagttcggcagcgaccgcatctccatgggcgacgtgctgtggaacctcgagtacgcgctgcagctgcaggacgccaacccgcccgatggcgcgcggcatggcggcgacggggacgaccaggacggcgccgcggcggcgggc

SEQ ID NO: 9962 - DNA, 429 bp, Zea mays
  Clone ID: LIB148-013-Q1-E1-D4
gcgtccgatggcaggggtccccaaagtggacttccccccgttcgagcactgctacaactggacggcaccgcgaccgggagcgccggagatcccaaagcgggcggtgcagttcaccgggtgcgcgcggctggagccaccggcgaagagctacgtgatcgacgtgaaaccgggcgtgaagtgcatcggcttgcaggagggcgagtggcccggcgtgtcggtcatcggcaacatcatgcagcaagagcacctctgggaattcgacctcaagaacatggaggtcaggttcatgcagtcgacctgcacccggtgatcgtaaagctgacctcgatggttttgttcagagcattccaaggggaaatgttttttctgaacataaaaaaatagaaaacgaaaatgatgctctgcataaatcaactttctgcacgagat

SEQ ID NO: 9963 - DNA, 432 bp, Zea mays
  unsure at all n locations
  Clone ID: LIB148-013-Q1-E1-D5
aaattccaattcgcccctctcgcggccggcctcgcgagacgccgattcggatcccatctcctgctcagagcctcgattcgaccggcgggggcgacgattcgaccgggtcggtagccaggcagaggcagcggaaggagaggatgagcttccaggacctggaggcggggcacgtccggggggcgccgctcggcggcggccggaggaacggcaggggccccgcgggggcggggggcgccggcgccggcgcgtcgcaggccgtggcgtcgggcgtcttccagatcaacaccgcggttgccacgttccagcgcctcgtcaacacgctcggcacgcccaaggatacccccgacctccgcgacaggatacataaaacacggcaacacataacacaactagtgaaggatacatcagacaagcttaaacangctagcgagg

SEQ ID NO: 9964 - DNA, 434 bp, Zea mays
  Clone ID: LIB148-013-Q1-E1-D6
aggccgagcaccatgcgaggaaataacatgccgcggcacacgtcgccgttcctttttgccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcg

SEQ ID NO: 9965 - DNA, 432 bp, Zea mays
  Clone ID: LIB148-013-Q1-E1-C2
atcaacactctctacctgtgtccgtgtgctctgctactctgcaccaccaaccaaccagtgctgccctccgccgattcactgacctaccgcgagcgccaatggcgaccgccgcggtcctggccgccacattagcgctgttcctccgcgccgccgccgcaacggccgcgacggctgcggcggaggcggaccggatcggcaggctgcctggccagccgccggtcaacttctccatgtactccggctacgtcaccgtggacgcggcggcggggcgggccctcttctactggttcatcgaggcggccggcgtgcccgcggagtccgcgccgctcgtgctgtggctcaacggcgggcccgggtgctcctccgtcggctacggcgcgtcagaggagctcggcgccttccggattaacgccgacggcaggacgctctact

SEQ ID NO: 9966 - DNA, 353 bp, Zea mays
  unsure at all n locations
  Clone ID: LIB148-013-Q1-E1-A9
aacgggcngggcgcgcaggtgcacatcatgttcgcgcagatcacgctgcagaacgtgcagaacgtgatcctgcacaacctgcacatccacgactccaaggcgcactcgggcggcatgatccgcgactcgaagcggcactacgggctgcgcacgcggagcgacggcgacggcgtctccgtgctgtcgtccagcaacgtgtggatcgaccacgtgtccatgtccagctgctccgacgggctgatcgacgtggtgaacgggtcgacggccatcaccgtgtccaacangcacttcaccgacgacgaccacgtgatgctgttcggcgccagcaacgacagcccgcaagaagcggtgat

SEQ ID NO: 9967 - DNA, 454 bp, Zea mays
  unsure at all n locations
  Clone ID: LIB148-013-Q1-E1-B1
gggtcgacgcccgcgtccgagacgatgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgcacggcggctgcatcctgaccacctcctcttatgccgcgctcaacggcgtcttgtactgcaagatccacttcgcgcagctgttcatggagaaggggagcttacaccacatgaacaagaagagcccgtcncaggaggttctgccggacgtggctgacgaggagcaaccgccggaaccagcgccaccgca

SEQ ID NO: 9968 - DNA, 411 bp, Zea mays
  Clone ID: LIB148-013-Q1-E1-B10
gaccgacgcgtcagggcatcaacgacgagccgatgacccctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtgactcgccttaattagttcgctttgcttttgaggttgactcgaccattttgctgtaacgtgaattgcatggacatgcaacgctccaatggcctttggaatgtggaatttttttcccgtttctgtaattttcctataaaatgaagtaatgaactggttcttatat

SEQ ID NO: 9969 - DNA, 377 bp, Zea mays
  unsure at all n locations
  Clone ID: LIB148-013-Q1-E1-B11
tttcaggttgcattttctttgaggagctattcactcactgaagcagattcattacaaccatctcggcgccggtcattgtttactctgtcgacagccatgattattttctcgtcaagagcttacaatgtcttgccactcatcncgatctgtaaacanatgatcaatgatcgtgcggccgatccgttccttcatttggtggatgagagcagacttacagctgttaaggattcttcaaatgatccttcaaaaatatatggattcacagaggacaacaataatgcactgaagtccctttcagaaatagaactatcagaaagtcaatctcgagaatgcatagtctccacaatcatgaacaacatcgcaaatatgctggatgc

SEQ ID NO: 9970 - DNA, 386 bp, Zea mays
  Clone ID: LIB148-013-Q1-E1-B12
aggggctgaccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacgcgacccgccgtcaccgttcagctccaacacggtgcaccaccccgtctccgtgcccaccacacctaggttgtccttatcgtgctcgtcgttcggccacatggtgaccccgcccaacgacacaccgccg

SEQ ID NO: 9971 - DNA, 392 bp, Zea mays
  unsure at all n locations
  Clone ID: LIB148-013-Q1-E1-B2
agcggactcatgaaggtgccgccccggtccgcgcccaccgcggttgcgcaggacacggtggtgctcccgtggacacgccgcgggttcccggcgcttggtccatcatcagcgagaacgcgggcgtgtccccgatgcacctggtgatcatgcggagcgacaaggccatcatgttcgacacggtcaccacggngccgtcgctgctgcggctgcccaaggggaactgccgcctcgatctccgcagcaagcaagtcggcgccaaggactgcgccgcgcacgccgtcgagtttgattacgcgacaggcggtgtcagggccctcaaggtcttgacggacgtgtggtgctcgtcgggcgcgctcgacgccgagggcaacctggtgcagaccggcggctac

SEQ ID NO: 9972 - DNA, 379 bp, Zea mays
  Clone ID: LIB148-013-Q1-E1-B3
gcgtccgatcggatcaacaatttcgtgaaccgggcaagggcggctaaattcaacgcgcacataatcagccacctgaagaaaaaaatgcctgcactgatgggcaaggccaaggcccagcaaaagctgctcgacgggctggatcaaaagttcgccaaggtccagaaggagctgcacctgccgccaggggacttcccgagcgtggaggagtacagggagctcctgagcgcctacaacttcgacaggttcgagaagctgaggcccaagatggtccagggcgtggacgacatgctggcctacgacatcccggacctcctgaagaaattcaagaacccctacaactgaagccggaaaccaatctctttgctcctcggggaagggt

SEQ ID NO: 9973 - DNA, 352 bp, Zea mays
  Clone ID: LIB148-013-Q1-E1-B4
gcgtccgcacacacgtccgctggagctccgccccggcgatcacccgccgggaacgtagcgcccggctccacagccgcgccattcgagctgctgctcgcgcgcggctggttcttctcggggggattttctttttgcgggcaccctccgctccccctcaccgccctgccgtcagccgtctcgttttcggattcgtttgctccggcggtggccgacctgccgtgcggggcgcggtgatgccggaggtggggcagtacgggtacaagaagaccgacggcatctgcgacagcgtgtgcggcgagcctgtgttcacgacagctctgacgatgtcaaggctacagtgcgctctccgggg

SEQ ID NO: 9974 - DNA, 428 bp, Zea mays
  Clone ID: LIB148-013-Q1-E1-B5
agcggagttcgacgtggaggcgctggcgcagatcgtgcagatggacctggaggacatccgcagcggcaccgtcgtccgcaccgtccgccccggcggcacgggaagctgcctcgccgacgagagccacatcatctgggacaagggccacgtcgtgcaggacctcctcctcaggctccggaacgtcgactccggcgtcgtccacctgcagctcagatgggtcgccaccccacctgaagactgaactggaggagacgaactgcagtatgtacgtgctctcgctccatatccccatgggaagaacgtacggattcgctcgcgtgacgatgatactatgcgatgcatgcatgctcaagagtcaagatgtcactgtcttctgtgtattttagtacagccacgtacattgtcgccatccaacatcactatgcatg

SEQ ID NO: 9975 - DNA, 275 bp, Zea mays
  Clone ID: LIB148-013-Q1-E1-B6
aggagccgttaccgccgccagcctctcctgcccccgttttcgttgccgtttcttcattagcgcgaacaaagttttgtgccggtctatcggccgccgctttcctcccctattcatcaagaccgcaataactgtcgctacctatgcttctcacttgtgatttttggacacaatatgttaaggtccattcaattctaatgagacgcctgatgaggctacttcggattgtcattggttattgatgtcttatgaatgaataatataaattttttttggtc

SEQ ID NO: 9976 - DNA, 331 bp, Zea mays
  Clone ID: LIB148-013-Q1-E1-B7
agcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccagcgtggtcctcgccgccgaggtcccggcgcgcggccgcatcagcgcctcctcggccgcgttcccgggcgtcggcgccgtgctgggcgcctccgtgctctcgttcttcgcctactagctgcagtacaattaaaggagggtcggagggagatgc

SEQ ID NO: 9977 - DNA, 179 bp, Zea mays
  Clone ID: LIB148-013-Q1-E1-B8
agcacacgtaataatagctagtctcatcatccgttgttttatcttgcttatcttcatgcgtgccattagttttctgttcaattccaacgacgctcgctttcgttccggagggataaattacgtcacaattgtcacaacttaggtctcctacttcttctttttgtacacagtatcttaaa

SEQ ID NO: 9978 - DNA, 372 bp, Zea mays
  Clone ID: LIB148-013-Q1-E1-B9
cagcccaggcatccgtccacccggccgagagcacaacgtgtaccgtctctccccagcgtgcgcgcgcgcgtggtcggaggctgccgtcgctcgcgtcggccgcccccgccggccagcgagagcgagggacaacgaccgaccgaccgaccagctcgaggtgaatgaacagccgcataccgttcctccagaaaatgcaccgctggatcatccctagctgcggcgacacccgccagccgcgcccttcctcccgccatcgagatgcgttcccgaggccggcgtcggcgtcggcgtcggcgtcggcggccccgtcccctcagaagctgaggaaggtggggtcggaggggacgctggtgctgtccgtgcccaaggacg

SEQ ID NO: 9979 - DNA, 168 bp, Zea mays
  Clone ID: LIB148-013-Q1-E1-C1
agatgacctgtctatatggttagtacgtggagctaacgcaagtgtgtgtttggcacggctccggctacttttaaattgactccggctccaacatttttacaagaggaatttttaataaattatttggcaaaacgacatctcttgtatttttatttgatatatataagg

SEQ ID NO: 9980 - DNA, 363 bp, Zea mays
  Clone ID: LIB148-013-Q1-E1-C10
aggcgcagcgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatgctcatcaggaggcactgaggaaggagatcgagaggctgaggcaaatctaccaccagcagagcctgaagagcggcagggagcccgacgcggccccgtcggtccgcgacgacaaggacatgatcggcagcgaggggaccgccgcgcccggcccgccctcgtgatgaggaggaggtggtggggcgacacgtccagacatccgagtcggtcgctgt

SEQ ID NO: 9981 - DNA, 410 bp, Zea mays
  Clone ID: LIB148-013-Q1-E1-C11
gtcagccacgcatcgctcatccgtgcacgccggcaatggtgtcctccgcccgtgcgctcatcggcctcctcgtcgccgcggcctccctcgccgtcgcgctctcggatggcggcgggatggcggcgccggtgtacgggtacgcggcggggagccccaacgggccggagaactgggggaagctgagccccgcgtacaagctgtgcggggaggggaagcagcagtcgccgatcgacatcgtcaccaagcaggccgtccccgccgccaccctcgacaccctcaaccgcacctacggcgccaccaacgccacgctcatcaacgacggccacgacatcacgctggcgctcgagggcaaggttgggacggtgacggtgaacggcaaggcgtacagcttcgagaagctgcactggcac

SEQ ID NO: 9982 - DNA, 381 bp, Zea mays
  Clone ID: LIB148-013-Q1-E1-C12
gacgacgcgtcaggtccttaggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccatcagagctacgcgctgtacgcgcagaagtccgtcagggacgggggcaaggagcccctggacaagaagctgtcggaggcggagaagaagaacgtcacgtacgtggtggaccccagcggcaagggcgactacaccaacatcaccgcggcgctggaggatatctcggtgagcaacaccaagcgcgtgatcctggat

SEQ ID NO: 9983 - DNA, 302 bp, Zea mays
  Clone ID: LIB148-013-Q1-E1-A8
aatccgaggacgcctccggaggactctccccattccactcactatctacatcgatctcctctaacgtcacgttccgtggaccattatggcgaagggctcacagctggtccaccgtgggagtcatggcgatgctgtatgtcatctgctccgccctcgtgtcgggtacggctgtcagagccgtgctggcgtcagtcgcatcgtaggcgccgtcctaagcgtccaccagcacttccgctggtgcgggtgccacggccgtaagcggagcggcctacgcctctgtgcccactgccgggggctctctc

SEQ ID NO: 9984 - DNA, 306 bp, Zea mays
  unsure at all n locations
  Clone ID: LIB148-012-Q1-E1-H2
cggaggaaccttggaaggaattggaaaggaaaaaaccgaacctaatcaaggtaaaattgttccaaccggagattcggcggccgccaatccggtaaccgttgcaaccttggttgcgggggtcccaaaaaacccaaaatttggtggtggcttcggaggaattttggaaggaattggaaatgccaaaaccggaactgttgccggcgttccaattggaggatcctccggtggcgccgatgctggcgctggcgctaccgtangtgctggtgtctcgggaagcgctaaagttggtggtggcgttggaggaaa

SEQ ID NO: 9985 - DNA, 324 bp, Zea mays
  Clone ID: LIB148-012-Q1-E1-H3
cgcaaagggcaatccgctgcggtcattgtaggttcctgaaccaaaccttggcaatgcctgaggctaaacaaatacggagctacccttcagaaaaaaaaagaaaagaaagaaattgaaaaccagggaaaaaaaatggaactggcccattgaggaagcttgaaaaccatttaacaagaattgccaacatatccttggacaaccttgttaacaaagtttaaaggtttccaagcaaaaaaaaccgcttgcaaccacaacattcatataattaataagcaaggtttagaaaagaggcaacatgggcacaaagatgaagaagggattctg

SEQ ID NO: 9986 - DNA, 397 bp, Zea mays
  Clone ID: LIB148-012-Q1-E1-H4
ttccggagagagagagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggccatcgagatcgacggcaagcctgcaggccggttcgtgctgggactgtttggggacaccgttcctaaaacagcagagaacttccgagcactttgcacaggggagaaaggaattgccaagtccggcaagcctctgtggtacaaggggtcgacgttccacaggatcatcccggggt

SEQ ID NO: 9987 - DNA, 427 bp, Zea mays
  Clone ID: LIB148-012-Q1-E1-H5
acctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgccggcgcaacgcgaaggtggacgcctcgtgctgccggaaatgcgcctgccgtcgcaaggactgctgcaaccctgcaaggaggacggcaggttcaagctcctcatgcacccggaggcccgcgcgcggccgtgcgggggc

SEQ ID NO: 9988 - DNA, 422 bp, Zea mays
  Clone ID: LIB148-012-Q1-E1-H6
atccgcccacgcgtccgcggacgcgtgggctcgcctcgtccttctcctccgtcccaaccatgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacaccgagggcgccgagctcatcgactccgtgctcgacgtcgtccgc

SEQ ID NO: 9989 - DNA, 340 bp, Zea mays
  Clone ID: LIB148-012-Q1-E1-H7
aagcccctgaagcactcctggggcgccatctggaggaaggacagcgacaaaccgcttaagggacccctcaccgtccgcctcactaccgagggaggcaccatgtccgtctacgacgatgtcatccctgccaactggaaggccaacaccgcctacaccgccaaataattaactttagtgctgacaatactttaagccgacctatgctagctatactagattgggttggatcccaagcaatgcattacacatgcatgcattggaccgtgatatctatttgctaccactaccctattacgacagtgatgctggcgccaacaatgatggtgtcatcctccttctc

SEQ ID NO: 9990 - DNA, 293 bp, Zea mays
  Clone ID: LIB148-012-Q1-E1-H8
cggcgagagagattgacgcaggatctgcggcgatcgtcaccgtcggacgctttagggactcctcaacgtccatctcacgatcgacggaggtcacatgtccgtcgaggactatgtcatccctgtcaactgggaagcgggaccctcgacaacggggcccaagtaagctttagagctgaaactactttaagcctacctatgctaactatactagattgcgttggcttccatatagtgcattatacatgcatgcatttggccctgatatcgatttgcgaccacttacctaatacaac

SEQ ID NO: 9991 - DNA, 438 bp, Zea mays
  unsure at all n locations
  Clone ID: LIB148-013-Q1-E1-A1
agagaagctcgcctacatcgccctggactacgaccaggagatggagaccgccaagaccagctcttccgtggagaagagctacgagctccccgacggacaggtcatcaccatcggcgccgagcgcttccgctgccccgaggtcctcttccagccatccttcatcgggatggaagctgccggcatccacgagaccacctacaactccatcatgaagtgcgacgtggatattaagaaggacctgtacggcaacatcgtcctctccggtggcaccaccatgttccctgngatcgctgacaggatgagcaaggagatcactgccttggctcccagcagcatgaagatcaaggtggtcgctcctccagagaggaagtacagtgtctggatcggaggattcatcctggcatcnctcagcaccttccagcagatgtggatcgccaa

SEQ ID NO: 9992 - DNA, 388 bp, Zea mays
  Clone ID: LIB148-013-Q1-E1-A10
caccggaaaacaagcaacttcaacaacaaaagccaaaacaacttgcaattattaattgccttccaaaccctaagggtccaccaataagggctgaaccaattgcacccggtgcacgcattggttcacaatctgatgcagctacaatcataaaagcggctcattcaaaaggtgcaatctacattaggcctggggaaataatcccgaattacctgaaaccactagcaccaaaaccactttcctcggtaccaccgatgaacccagggcagctcagacgatttggtgattctgctgtcaccaaggatgcaatcttcggttcttcggatggcacggacgatgacgacgaagaagacactgatgacgaggaagacgacgagctgactgacaacga

SEQ ID NO: 9993 - DNA, 329 bp, Zea mays
  Clone ID: LIB148-013-Q1-E1-A11
cctccacgccctcctggcgttgttgtctgccggtctcttcccgcaggcgttacggaacggcaagggcaaggtgcatggcggctgtgccgtcaacccgctggttgctggcatctgctctcgcgccccattcccagaggtttgcactgccacagccgggcgccatgcatccacttacccggtcatcgaccatttggccgtgctgaacatgcaagtggccgcgttcgccaagcgcacatcgcatgcgcggaaacacgtcgcggtggcggcccgcactattccaccgccgcaagcacagggcctcacaacctgcgacacgatgtacatgaaca

SEQ ID NO: 9994 - DNA, 362 bp, Zea mays
  Clone ID: LIB148-013-Q1-E1-A12
ccaaggcttcggtcctccaacaacaacaacaagcttcaacaacaagcaagctccgccgaaaattaatggaagaagcggcagcatggaatcaaccggccgcgctccttggggcaacccctcgcgctagtggctgccaccgccccacaggtagcggaggcaaagaagaagagagcggcggagagcggcgaggcggcggatgcgaagaagatccaggacgacttctgctcgacgctgtgcgagggcaagaaggggacggacctggtcgtgtgcaaggagtcctgcgcgctctcccagcagtccaacctggtgctgtacggcaggattcagtgcaagggcaaatgcaccgagcagaagggcatcac

SEQ ID NO: 9995 - DNA, 341 bp, Zea mays
  Clone ID: LIB148-013-Q1-E1-A2
gcgtccgatcgcagcgacgctcccttcggctccggcacaccacatcaagtcgcgatggaaatgaagaaggtccctggccccgtcttccccgccgccgccctcggccaaggctggtccacgcgggggcgagcgcttccgctggccccaagtcctcttccatgcatccttcatcgggctggaagctgccggcatccaccataccacctacaactccatcatgaggtgcgacgtggatattacgaaggacctgttcggcaacatcgtcctctccggtggcaccaccatgttccctgggatcgctgacaggatgagcaaggagatcactgccttggctcccagca

SEQ ID NO: 9996 - DNA, 329 bp, Zea mays
  Clone ID: LIB148-013-Q1-E1-A3
acgcgtccgacgatgccttcgtaaggtggtgatcccgggataagaggatgacacctcaatgattacttgaggacaaatttaaggtcggtaagaaactgcggggaatggacattgcaagatgtggtgtggtataagataggcaaaatgtgtgattattttttgtccgaggttatcaccccccttgccccagacaagatgataagatgtcaatgtaacaagccgtctgagcttctgtaagtaaatgactgttgctgcatgccccctgtgtacatgtagctgtttgagcagaattccgtttgcatgaatcgtgtgatcaccagccagggatc

SEQ ID NO: 9997 - DNA, 308 bp, Zea mays
  Clone ID: LIB148-013-Q1-E1-A4
cgtccgaacgcatctcggctacatctgcctgtactacgagtagtagattctgaccgccaagaccaactcttccgtggagaagagctgcgagctccccgatcggcaggtcatcaccatcggtggcgagcgcttccgctgccctgaggtcctcttcgagccatccttcatcaggatggaacctgccggcatccacgacaccacctacaactccatcatgaagtgcgacgtggatattacgaaggacctgtacggcaacatcgtcctctccggtggcaccaccatgttccctgggatcgctgacaggatga

SEQ ID NO: 9998 - DNA, 427 bp, Zea mays
  Clone ID: LIB148-013-Q1-E1-A5
acgcgtccgtccatcttcacgcaggacgcatcggtcgccgactgctcgacgaaattcgctcgccccggcgaccttaactaccctgccttcgccgccgtcttctcctcgtaccaagactcggtcacctaccgccgggtggtgcgcaacgtcggcagcaactccagcgcggtgtaccagccgacgatcgccagcccgtacggcgtggatgtcacggtgaccccgagcaagctcgcgttcgacgggaagcagcagagcctgggatacgaaatcaccatcgcagtgtcaggcaacccggtgatcgtggattccagctactcgttcggatccatcacctggagcgacggcgcgcacgacgtcacgagccccattgccgtgacctggccgtccaacggtggagcagcagccatgtagtagactgatgctgttg

SEQ ID NO: 9999 - DNA, 432 bp, Zea mays
  Clone ID: LIB148-013-Q1-E1-A6
accacgcgtccgctggcccataaatatatatctatctatcgccatcgagcaattataatctcacagaataataaacatcatggggcaagcctcacggctcgtcctcctcgccgtcgtggcgctgctgtccgccgggctcctcccgcaggcgctgggtaagggtaggggaagcaagcggaggagagcggcgatgcggcggaggccatgaagatccaggacgacttctgctcgacgctgtgcgagggcaagaaggggacggacctggtcgtgtgcaaggactcctgcgcgctctcccagcagtccagcctgctgctgtacggcaggatccagtgcaagggcaaatgcaccgagcagtaacggcatcactgcgccgggccataacgtctgccaggaggagtgcgacaaggcgtacgtggtgaaggcggccgaggt

SEQ ID NO: 10000 - DNA, 272 bp, Zea mays
  Clone ID: LIB148-013-Q1-E1-A7
aagctctgcagtacctgaggatgatggaacagcaggctgaccacgaccacctggcgattcaggacctgcacgatttgcttacggcgagggagaaagagttgcttgacttgggcgctgagctcgcgcactgcacgaggctcctgcagcacgatccgttcaacggcgacggacgtaatattggcgctgacacaatgatcacaccgattggcggcacatatccggcgatcgactgcttggatgccgcggaccttgtggtcgagaccatgtcccct

SEQ ID NO: 10001 - DNA, 411 bp, Zea mays
  Clone ID: LIB148-012-Q1-E1-H12
cttttctcttcctgtatgttgggatggatgccctcgacatcgagaagtgggagtttgccagtgacagcccgggcaaatccattggcataagctcgattttgctaggattggttctgctggggagagctgcatttgttttcccattgtcgtttttgtccaacctgacaaagaagtctccattggagaaaataacatttagacagcaaattgtaatatggtgggccggactgatgagaggtgccgtctccattgctctcgcttacaacaagttcacgagatctggacacactgagctgcacggcaacgcgataatgatcaccagcacgatcactgtggtcctgtttagcactatggtgtttgggatgatgacgaagccattgatccggctgctgctccctgcctgcagcaaca

SEQ ID NO: 10002 - DNA, 432 bp, Zea mays
  Clone ID: LIB148-012-Q1-E1-F9
acgcgtccgagagttcaaccacttcggccgcgggctggtgcagcggatgccgcgctgccgctacggcttcttccacgtggtgaacaacgactacacgcactggatcatgtacgccatcggcggcaacatgaaccccaccatcatcagccagggcaaccgcttcatcgcccccgacgaccccaacgccaaggaggtgaccaagcgggagtacacgccgtacaaggactacatcgagtgggtgtggaagtcgcagggcgacttcatgatgaacggcaccttcttcaacgagtccggcggccagaacgagcgcaagtacgacaggttcgacttcatcccggccaagcacggccgctacgtcggtcagctcacgcacttcgccggactactcaagtgcatcatcagccagccgtgctactacacatcggcccggtc

SEQ ID NO: 10003 - DNA, 293 bp, Zea mays
  Clone ID: LIB148-012-Q1-E1-G1
aggcaaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtttaaaaaacaatcattgtaatgggagttatatatacttttatcttaacatttatttacaccagcaagtcctggtgtatgcatgctgtaccgtgtttactagtgaacactacactggcggacgggtccgcgccaccgcgatcaga

SEQ ID NO: 10004 - DNA, 389 bp, Zea mays
  Clone ID: LIB148-012-Q1-E1-G10
cacgcgtccgccaacgcgtccggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagattaagcgcgagatctccgtcatgcgcctcgtccgccaccccaacgtcgtgcagctgcacgaggtgatggccagcaagagcaagatatacttcgccatggagtacgtccggggcg

SEQ ID NO: 10005 - DNA, 418 bp, Zea mays
  Clone ID: LIB148-012-Q1-E1-G11
gtagaccgagtgctaccaccatcgtcgtttaggggggagggcatccgccgaagtcatgcagagtgctctaccgttgtagggcgaccaacacaaatcatggggttggggatcggctgcactcaggcaggccgcgcatcgtatcctcgtgtgggattgtgatcggagggcacggcaattcctcgccataatggatacaccatagtcgagccgcattctgtcgtcaaccgagcatggcgcgacattattcaaggtcaagaacaggtaccgcaggatgaggggcatggaggatgatgtgacgagttcgtgaggtcgtcgtctcccagtcaactttgggttgctggatcattgtctcatatgatgtaattatttattttattttgtacagaactcctattatatagtaaagatgtgacattcg

SEQ ID NO: 10006 - DNA, 420 bp, Zea mays
  unsure at all n locations
  Clone ID: LIB148-012-Q1-E1-G12
gacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggtgacttccttgtcggacaactcaacttcacaggcccttgcaagggcgacgtgaccatccaagtggatggcaatctgctggcgaccacggacctaagccagtacanaggacatggtaattggatcgagattctacgtgtggataacctggtcatcaccggcaaaggaaacctt

SEQ ID NO: 10007 - DNA, 458 bp, Zea mays
  Clone ID: LIB148-012-Q1-E1-G2
cggggccgaccaagccttcgacggacccttggggccttgctgacgccgccgctgtccctggggggcggcgggctcccggggaacctccgcccggcaaacctcggccaacggttgctcagccccttcggcaacttcggcccgggctccgacttctccaacttcaagctgccggcaactttcaaccggcccaagtcgcagctgcagctgtacggcgaggccgtgtactgcggcggcgaggacatgctggcgcggtgcgcgcgcggcgccgacagcctgcagcgcatgtgcgccgtggtggcgtggagcatctccaccacgcggccccccatcttcggcttcgcgccctacaacccggtgctcggggagacgcaccacgtctccacgcccgccggcctcaacgtgctcctggagcaggtctcgcaccgcccgcccgtgacggcgctgcacgcgacgcacgc

SEQ ID NO: 10008 - DNA, 355 bp, Zea mays
  Clone ID: LIB148-012-Q1-E1-G3
agcgagctccggccggaacgaaggagtcaacaacctccggtccaaccggcggaaaaaggtccacaaggccggccggacccattccgaacccttccccggccggcggacggccggcgaacccggggccgaagcaacgccccaaaggcaacgcacgcacggttctaacggcccgtttccgttgaaccctcaagcccgggaaccctcgcggccggttccggtcgccccaaaaacttagtacgttcatgaacacgacccgcctggtcaggtctctggaaatgtgcaacctgcatgtgttttgcctgcgagcgtttttcctttggctgtcgaccgatcgtgaatccgtcacgcagcactc

SEQ ID NO: 10009 - DNA, 419 bp, Zea mays
  unsure at all n locations
  Clone ID: LIB148-012-Q1-E1-G4
cgaccagcagaacctcataacggcgccggtgaccaaaagcggcctcatgaaggtgccgccccggtccgcgcccaccgcggttgcgcaggacacggtggtgctccccgtggacaacgccgcggggttccccggcgcttggtccatcatcagcgagaacgcgggcgtgtccgcgatgcacctggtgatcatgcggagcgacaaggccatcatgttcgacacggtcaccacggggccgtcgctgctgcggctgcccaaggggaactgccgcctcgatctccgcagcaagcaggtcggcgccaaggactgcgccgcgcacgccgtcgagtttgattacgcgacaggcggtgtcagggccctcaaggtcttgacggacgtgtggtgctcgtcnggcgcgctcgacgccgagggcaacctggtgc

SEQ ID NO: 10010 - DNA, 438 bp, Zea mays
  Clone ID: LIB148-012-Q1-E1-G5
cagcacgagacatatcgatggcgttcatcagcagtgcggcgatgaaggcagccgtggccgctctgctggtgttcgccgcggtgtcgcctgccgcgcgcgcggtggcggcggaggcggaggcgaaggcgaaagctgtgggaagcgcgccgtcggtgcccgctggctcgctggacatcgcgcagctgggcgccaagggcgacggcaagtcggacagcaccccgatggtgctcaaggcgtggaagcacgcgtgcgaagcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaactggatcgagatccagaacgtcgacaacctgtccatca

SEQ ID NO: 10011 - DNA, 442 bp, Zea mays
  Clone ID: LIB148-012-Q1-E1-G6
aaccgcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggc

SEQ ID NO: 10012 - DNA, 462 bp, Zea mays
  Clone ID: LIB148-012-Q1-E1-G7
ttcgcccgtcgacccacgcaaccgacgccgcacgtcgggcgcgctcgacaactgcggggagctgctcgactacgccatcgacgacctccggacgacgttcgacaggctcggcggcttcgagatgaccaacttcaagagcgccgtggacgacctccggacgtggctgagctccgcgctcacgtaccaggagacgtgcctggacgggttcgagaacaccacgacgcccgccgcgggcaagatgcgcaaggcgctcaacagctcgcaagagctgacggagaatatcctggcgctcgtggacgagttctccgagacgctcgccaacctgggcctgccgagcttccagcgccggctcctcgcggagcacgctcgcggcgcgccctcctggatgcccgacgccaagcgccggctgctgctggtctcccccggcgacaacggcttcaggcccgacgtgacggtggtcaa

SEQ ID NO: 10013 - DNA, 432 bp, Zea mays
  unsure at all n locations
  Clone ID: LIB148-012-Q1-E1-G8
atcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcancctgctcggcaccggcgacctcagcgcgtagcanaggaactggatcgagatcgagaacgtcgagaacctgtccatcaacggccac

SEQ ID NO: 10014 - DNA, 436 bp, Zea mays
  Clone ID: LIB148-012-Q1-E1-H1
aacatgaatggatccctctatgactttctgcacttgtccgacgactacagcaagccgctgacctgggacacccgcgtaaggattgctgttggtacagcttgtgctctggagtacctacatgacgcgtgttcacctccagtgatccacaagaacatcaaggcatccaacgtcttgctcgatgctgacctcaaccctcacctcactgactgcggccttgcatacttctatgaggatccgagtcagagcctgggaccagggtacgatcctccagagtgcacaaggccatcaggttacgttatgaagagcgatgtctactgctttggtgtcgtcatgcttcagctgttgaccggccggaagccctacgacagctcgaagcctagagcggagcagtccttggtcaagtttgtcggtccacagcttcatgacaccaacgcct

SEQ ID NO: 10015 - DNA, 190 bp, Zea mays
  Clone ID: LIB148-012-Q1-E1-H10
acgcgtccacgagagcggcccccttttttttttttttttattctaacgttttttgtttgtttgtgtacaacaaatgagtacatgtgtaatttttcattacaggtgaaaatggacacggggtgtcgcgaaatagggctcaactcagatttacattttaaacgcgtatatgtgcatcatcacagggacacgc

SEQ ID NO: 10016 - DNA, 419 bp, Zea mays
  Clone ID: LIB148-012-Q1-E1-H11
gtacaagcatgaacgcgaatgtaatgctgtaattgcacaaacacttgaaggaaaaattgctaggcttgagagcctcatggatggaactttaccagctgaagaattcatgaatgaagagtttttatcacttatgaatgagcataagatcctccaaaagaaatatgaaaaccatcctgatgttttgcatgctgaaattgaggtaaagagactccaggaggaattggacatgttcaggaactctgtggacgagaaagaagttctacaggaggagatacaagatctgaaaaatcagttgcattatatgctttcatcatcgtcatcaatccgtaggctctggcctccagtgccgttgtctcagggaagtaattctgaacgtggaacaaaagatatagatggagatactaattttgtggacactc

SEQ ID NO: 10017 - DNA, 446 bp, Zea mays
  Clone ID: LIB148-012-Q1-E1-F8
cccacgcgaccaaccacgcgtccgcgggagcacagagctagctagccagccagccagcagccagcttgctcgccgcgcccgtccttcttcctcgcctccgttccgttccgttccgtcgcgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctcgttcttcgcctactacattcagtgagccggccgcagtcggtcgcccggaggccgacgaagagacgattcgggacagagagtgacatggctgcgcgcattccgatgcgtgggcatgtttttgattcgacacaccttttgtcctcgttttc

SEQ ID NO: 10018 - DNA, 345 bp, Zea mays
  Clone ID: LIB148-012-Q1-E1-E5
cacgcgtcctctgactcgtgggcggactcgtgggttcgtccagccttctcggtcttctaccccggtggtcatcacatttctcacacttcgcggccacctctcatctcggggtactggtcacgctcctggttaaataatgttgtcttctgcagttgaatttgcctcgtcatctgctcacatcacttcgtcagtttctattcgagatgacgaggtagctgatggataggcgttcatagaagctcttacatacgttaattgtgtgtcgcactgttatggctatcatagatgtgtatagacgattgacaatgataagattgggcacttctcctgttacggccagtactt

SEQ ID NO: 10019 - DNA, 438 bp, Zea mays
  Clone ID: LIB148-012-Q1-E1-E6
agcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgcatgcctccgaatat

SEQ ID NO: 10020 - DNA, 414 bp, Zea mays
  Clone ID: LIB148-012-Q1-E1-E7
aaccaaggacgcgtgggcggcgaccgacctgtgcccacccaaggacaagtggtgcaagccgccgcaggagcacttcgacctcagcatgcccgcgttcctccagatcgcgcaggagaaggccggcatcgtgcccatctcctatcgcagggtggcatgcgcaaagcagggcggcatccggtacaccatcaccgggaacaagtacttcaacatggtgacgatcaccaacgtgggcggcgccggcgacatcgcggcggtgtcggtgaaggggagcaagcgcgtcaagtggacggagatgaagcgcaactgggggcaagtgtggcagaccgaggaggacctcacctgcgagtcgctgacgttccgggtgatgactagcgaccaaccgcaaggcacctcatggcacgttctccccgctga

SEQ ID NO: 10021 - DNA, 434 bp, Zea mays
  Clone ID: LIB148-012-Q1-E1-E8
ctctcgtgtcggtcccgcgatgggcatgttcgcatcggccgcaaagagatacagcaacggcaagaattttctccgcagcgcgggcgtgtgctgttgttcgccgtccgcctccgcccagcttggtggtgtgcgcggcaaggaagagacatcgacgtcggcgccagctttcgcgccggatagcaacaagaaaaggtggaggaagaggaggttctggagaaagaagatgaaggccaggaaggagatcggcgggctggtggacctcgtcaacgatatttcggccaagtcagaggagagcctaggggttagcaaccaaaacatgcccagcagggcgctgacgttcagtcagctgagcgccgcaacggacgggttcagttcgcagaacctgctcggagaaggcggctttggacgggtgtacaaagggctcctcgaggaca

SEQ ID NO: 10022 - DNA, 433 bp, Zea mays
  Clone ID: LIB148-012-Q1-E1-E9
cacgcgtccggtacctggacgccaacccgtccgaggtggtcaccgtcttcctcgaggactacgcggcgccagggtcactcagcaacaccttcaatgccgccggactgtccaagtactggttccccgaggctcaaatgcctagccctagtaagggcggcggtgactggccgctgctcagggacatgatcgccgataaccaccggctcatcgtgttcacatccaagaaagggaagcaggggacggaggggctcgcgtaccagtgggactacgtcgtggaaacccaatacgggagcgagggcatggcggatggcagttgcccaaagcggaccgagtcgaagcccatggactctaaggcccagtcactagtgctgctgaacttcttcaccagcaacccgagccaaagctgggcctgcagcaacaactccgcgccgct

SEQ ID NO: 10023 - DNA, 436 bp, Zea mays
  unsure at all n locations
  Clone ID: LIB148-012-Q1-E1-F1
aggcactctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctganggaccggctgctgatgactccgccggtgctgctgcccttggaagtggagctgccatcgccggcgttgccgctgctg

SEQ ID NO: 10024 - DNA, 375 bp, Zea mays
  Clone ID: LIB148-012-Q1-E1-F10
tgcaagattggggccttgagatcgttctcgctggagaagatacactactggagggagagagcgtccggcatgagctcgctggcatacttcctgtccaaagacacgatagatcacttcaacacgataatcaagcccatcgtctacctctccatgttttacttcttcaacaacccaaggtcatcgatctgggagaactatgtcgtccttcttgcgctcgtctactgcgtgacggggattggatacaccttcgccatcttcttccagccaagttctgcgcagctgtggtcggcgctccttccggttgttccaaccctgatagcaacccagcaaaaggacaccttcatcgcaaacctgtgctacacaaagtgggctctg

SEQ ID NO: 10025 - DNA, 421 bp, Zea mays
  Clone ID: LIB148-012-Q1-E1-F11
ctatcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcgtgctcgctgcgccctcctgcttccacccccggcagcggcaggggcaggaggagacgacggtcgccaccggcgccctgcaccggcggatgtcggatcgggagctccgccccctgcgctccatcagaatcacaggggacggtcgatgcctgttcaggtccgtcgcctacggcgcctgcctgaggagaggaaagcatgcgcccagcgacagcgcccagaaggaactggccgacgagctccgagccaaagtagctgatgagttcgtcaagcgaagaggagacaccgaat

SEQ ID NO: 10026 - DNA, 417 bp, Zea mays
  unsure at all n locations
  Clone ID: LIB148-012-Q1-E1-F12
acgcgtccggcatgtacaaggaccatggtaattggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacagcgcccggggacagccccaacacggatggcatccacatgggcgactcatccgggatcacaatcacagcaccgtcattggcgtcngcgacgactgcatcctcatcggccccgggacctcaaaggtgaacatcaccga

SEQ ID NO: 10027 - DNA, 429 bp, Zea mays
  unsure at all n locations
  Clone ID: LIB148-012-Q1-E1-F2
cggtgcttcggcccgccggcccaaaatcgcctcatcgacaacccccccttcaaggctcccgttctcaatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacangaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctctaccgtttcgagtacgcagtcaacccggcgctcttcctcgccaaagcgcg

SEQ ID NO: 10028 - DNA, 383 bp, Zea mays
  Clone ID: LIB148-012-Q1-E1-F3
cggtcagaacgaacgggtcggccacgcgtccgaggtaaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgacgaggacatctg

SEQ ID NO: 10029 - DNA, 210 bp, Zea mays
  unsure at all n locations
  Clone ID: LIB148-012-Q1-E1-F4
acccacgcgaccaaccacgcgtccgcttgatcacatcgctngcttgccgtccacctccctcgccttttgctccactcccgcgtccatcttcgtcctcttcctgttctgtcgcttcgttggggggggtggggctgccttccgagaaatttgccccggggagatcgtccttgccctcttcgacttgcatctctggtacaccgggtttatttt

SEQ ID NO: 10030 - DNA, 436 bp, Zea mays
  unsure at all n locations
  Clone ID: LIB148-012-Q1-E1-F5
cccacgcaaccaagacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcatgaggcatgggcatcggcgtgcggcggcactgggaagcatacaatcctcatacccaatgggcgacttccttgtccggacaacctaacttaacacgcccttgcaagaggcgacatgaccatccaggtggatggcaatctgctggcgaccacggacctaagccagtacaaggaccatggtaattggatcgagaatctacgcatggataacctgntcatcaccggcaagggaaacctt

SEQ ID NO: 10031 - DNA, 463 bp, Zea mays
  Clone ID: LIB148-012-Q1-E1-F6
attcgcccgtcgacccacgcgaccgagcagcatttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatccagtcacggtgttcatcacagacatgaactacgagcctatcgctccctaccacttcgacttgagcggcaa

SEQ ID NO: 10032 - DNA, 353 bp, Zea mays
  Clone ID: LIB148-012-Q1-E1-F7
agatacaacttcttttcatcacgcctcaaagacgctacaaggttcttgaaggagcacatgcatccttcatggagtcagtgcctttcaacacaatatgcaccttcacactcttccagctaatctatctgttgatcgtctttgggatgacatggataccagtagcatgaatcctcttcccactgctcttcttcttcctcattatcatcaggcagcacttcatcccgaaatattttgatccgatccacctgagggaattacatgcagccgaatacgacgaactgaaaggttttacacctgatccatcagtgtgtgatgacgagtctgttcgcagcggagatgctcatcctggatat

SEQ ID NO: 10033 - DNA, 466 bp, Zea mays
  unsure at all n locations
  Clone ID: LIB148-012-Q1-E1-E4
ggtcacaaatccgggtccgncacgcgtccgaaggaccgcaacgcaagcgccgacgccaaggactccccaaggggaaagaatggtcaacccaaaaggcaaaacaaaccaaatttaaaggaattcaaaccaaaaaattgcaaggcgtataaagaaaatcagaaggaacctgtaacaatgatggaaggatctccacctgatgttggtcaagatggtgatgatgagcaaggtattgatccatcttgggctgctgtagttacgccggttttacgagtcaagacaatttatatcagttcggcgattcttgctgcgaagagtcctttctttttcaagcttttctcaaacggcatgaaagaatcggaccagagacatgcaacccttagaaatactgactcagaggaaaatgccctcatggagcttttaagctttatgtatagtggaaagttgacaactactgagcccactcttc

SEQ ID NO: 10034 - DNA, 418 bp, Zea mays
  Clone ID: LIB148-012-Q1-E1-D12
ctaccactctcgcgtcggtcccgcgatgggcctgttctcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgaggagatcctacggggctgcaaccagaacatgcccagcagggcgctgacgttcagccagctgggcgccgcgaccgacggg

SEQ ID NO: 10035 - DNA, 456 bp, Zea mays
  unsure at all n locations
  Clone ID: LIB148-012-Q1-E1-D2
cggggggcacaagatcgtgtatcaaatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccggcgaactggagacccgatgccgtctacacttccaacgtccaattctactagactttgaattcncttcgattcatccggcacagcgggctatggaccttcagcagcaagctaattaagttggcagcatgcaccgctaaccttatatactactgagacttccaaattctagtatatgtaatccttttgttcgggttcaa

SEQ ID NO: 10036 - DNA, 424 bp, Zea mays
  unsure at all n locations
  Clone ID: LIB148-012-Q1-E1-D3
agctttggtcttgcaagggaagtctcatcattgccaccatatacagaatatgtctcaactcgctggtatcgggcaccagaagtcttgctccagtcatctgcttatgattctgcagttgatatgtgggcaatgggtgccataatggctgagctgttgacactccatcctctctttcctggaaccagtgaaccagatgagattcacaagatatgcaatgtcatcggtagtccagatgagcaatcttggcctcaaggattgtctcttgcagaagcaatgaagtatcagttcccacagaccaaaggcagtcaattgtctgaggtgatgacaacagctagtagcgaggcaattgacctcatctcatcactatgctcatgggatcctagcangagaccaaaggccacagaagtcctccagcataccttct

SEQ ID NO: 10037 - DNA, 438 bp, Zea mays
  unsure at all n locations
  Clone ID: LIB148-012-Q1-E1-D4
ctccccttcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcnaagaggacggcaggttcaagctcctcatgcacccggaggcccgcgcgcggccgtgcgg

SEQ ID NO: 10038 - DNA, 438 bp, Zea mays
  Clone ID: LIB148-012-Q1-E1-D5
cggacgcgtgggcggacgcgtgggcgcaccgcctccccgtgtcccctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaggattctgttcatctcctggtccccggacacctcgagggtcaggagcaagatgctgtacgcgagctccaaggaccggttcaagag

SEQ ID NO: 10039 - DNA, 258 bp, Zea mays
  Clone ID: LIB148-012-Q1-E1-D6
acccttggccgcaaccatagcaacacggctgcgctgtgtcgactccttctcgcccggcaacatcgatcgcggatgtggcaacagcagaaacttatcagccatggggaagtcggcgtcggggatggtcgtcaccaactagtggatgctcactttccaggagctcaaggcgaagctcaccatccggttcatcacattctccatcaacgatgacatcgaccaagtcgtcgtcgacacgatgtggcaacccggcgacgtcta

SEQ ID NO: 10040 - DNA, 435 bp, Zea mays
  Clone ID: LIB148-012-Q1-E1-D7
gtcaagaagacgtgctgtttgaagagcatgagcatacaacagctgatgggtcaccttccaacggtgacaagttgagcggcgtagcgaatcttaaggctgggatttctctgctcaatataagactgagggcacttgaagatgaccaggagtttctcaagcaggtgttgagttccctccaatgcggtagtgatggactgcagtgtatacaggagataagcggccatctagcagagttgcgaatagttgtgactcgctaaggaaaatggttttgccccgagtccaaattgttaggtcatcatgaggtcttctcatgcagcagactaactaaggtgcttccactgagtgcccacaatcccaatctatctgaagatggatgccgttgcaggaaatacccatgctcttcgcttctgatcgggctcaacagcagaccaaaat

SEQ ID NO: 10041 - DNA, 436 bp, Zea mays
  Clone ID: LIB148-012-Q1-E1-D8
aaccgcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagcctcccgccccgtttctttctccttttgttgctgtttcttcattagcatgaacaaagttttctgccggtctgtcggcagccgctttctcctattcatcaagactgtaatgtctattgttgctacctaatgcttctcacttgtcattttggacacatgttcgacctattcaattttaatgagatgcctgatgaggctacttgcaaaaaaaaaaaaaaagggcggccg

SEQ ID NO: 10042 - DNA, 422 bp, Zea mays
  Clone ID: LIB148-012-Q1-E1-D9
agacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatgaggctattgtaaggctcattaacgagagtggcgatg

SEQ ID NO: 10043 - DNA, 440 bp, Zea mays
  Clone ID: LIB148-012-Q1-E1-E1
accaaacgtccggtcgtcgtcgtccctcccgaaacaaaagaagctattttgacaccacacacacacacacagaggagagaagataagagaacgaggggcagggcagccagcgccgctagctgaagcaaggcagggcaagagaatccgtacgtcgaggtgcaggtcgtaggtaggatggacgcggaccagcagggcgtggttgcggcggcggtgaagccggcgctggccaaggggacgccgtcggcgtcgttccggctccgcaacgggagcctgaacgcggtgcgcctccgccgcgtgttcgacctgttcgaccgcaacggggacggcgagatcaccgtggacgagctggcgcaggcgctggatgcgctgggcctggacgccgaccgcgccgggctgtccgccaccgtcggcgcctacgtgcccgacggcgccgcgggcct

SEQ ID NO: 10044 - DNA, 406 bp, Zea mays
  Clone ID: LIB148-012-Q1-E1-E10
gcagacgctagcgcatgcactacacacaccgtaccgagtgaacgaaatggcaggtgcgtgagcgaagacctcgaggttccgcatggagcgctccttgtgaaagattctcaacagtgtacacatgaacatagtcggacaaagggaaagaagaaatgaacagaagttccaggaccagcgtgaagcagggtgggagttctcttacgtgtattttcctttcactttgtagttccagtagtttaaaattcacttaacgttttgatcattgaatgccacatataatgccacaccagacgcgccgggattcgatgaccaaacgtcaacgaagtacatcgcgggcgccaaggtgaggctggagtgcaagcacttccgaaccggcaaactcaagcgcgcaatctacggggtcacc

SEQ ID NO: 10045 - DNA, 423 bp, Zea mays
  unsure at all n locations
  Clone ID: LIB148-012-Q1-E1-E11
gtaggcatgggccccgccggcgagctgcgctacccgtcctacccggagagcaacggcacctggaagttcccaggcatcggcgccttccagtgcaacgacaggtacatgcgtagccgcctgaaggcggcagcggaggcggccggcaagcctgagtggggccacggtgggccgaccgacgctggcggctacaacaactggccggaggacaccgtcttcttccgcggcgacaacggtgggtggagcaccgagtacggcgacttcttcctgtcgtggtactcgcagatgctgctggagcacggcgaccgcatcctgtcgggcgccacgtccgtgttcggcgcggcgcccgtggaggtctccgtgaaggtggccggcatccactggcactacggcagccggtcccacgcncccgagctcaccgcgggg

SEQ ID NO: 10046 - DNA, 396 bp, Zea mays
  Clone ID: LIB148-012-Q1-E1-E12
cacgcgtccaccatcgcgtccggcgatgctctgtacgctatggagctgactctggctctggaaaagctggttaatgagaagctgcacagcctgcatggtgtggcaacaaggtgcaatgatcctcagctgatagacttcatcgagagtgagttcctcgaggagcaggtggaagccataaataaggtctccaagtatgtcgcgcagctgaggagagtgggcaacaaggggcacggggtgtggcactttgatcagatgctgcttcaggaaggggcctgaaggccaacaagggtggcgtggacggagctgagctctgggtgtgttattttcttttctttccagttggttagtgttttagttgtagaacggtgttgcgttgcccacatgacatgatggatg

SEQ ID NO: 10047 - DNA, 76 bp, Zea mays
  Clone ID: LIB148-012-Q1-E1-E2
accacgcgtccgtgctcatgaacaacctcatcgagcttcggcgccgacaacgactacttgcgcccacatcgacatg

SEQ ID NO: 10048 - DNA, 430 bp, Zea mays
  unsure at all n locations
  Clone ID: LIB148-012-Q1-E1-E3
ctcgctgctctgattctcgtcgtcgccttggcgacttgtacaaacaattctgttgatgcccgcttggtcaaccccatcgtcaccctcaaggccgatggctcatctcccacctctggcaatggtcgtcgcctgatcagctccaccaaccaagatgaacttggagcgttatgccaacagatgcactacaagacgttgtgctccacgatgacgacactgcctgnggtgactacgccagagcaactcttagatgcatccctgcggattacagcggtgaaggcagcgatggcggagatgaagctagacaatgcaataaaatcaggcagtgctcaaggtaacccgatgatgtcgtcgctaaagacatgcaaggagagctacgcgtcgctggtaaactccatcaataccacgcggaacacgctcaaaagcggcggca

SEQ ID NO: 10049 - DNA, 422 bp, Zea mays
  Clone ID: LIB148-012-Q1-E1-D11
acaacgcgtccggccatcttcttcttcttccccgaccttctcccttaaggcctcaaccaagcaaaggtttgattttacataccagagtaacggacccagcgccagctggaacaacgaccagagactccggcatccagtcgaccaacgtacaatgcgtttcatccaaggaaggacctccaagcagacgagcagggttaagacccttctatggcttgccttgtcccgccttgccgctgcccgccgtccccgcctcgctcgcaagtcgatttcccgcagcgatgttggacagctactagcactcggacacattgatcgtgctctccaccgtgcagagcagctcatagaggaggacaacatgctggaggcgttcaacataatagagctacactgcaatcgcctcattgagtgcgcaaagcagctag

SEQ ID NO: 10050 - DNA, 421 bp, Zea mays
  Clone ID: LIB148-012-Q1-E1-B9
agaccagcccaccttcacgctcaacttctccaaaggttccagccagattatcgcgcagtattaccagctcatccgcctcggattcgagggctacaaggacgtgatgcagaactgccgcgacaacgcggcggtgctccgcgagggcatcaacaagatgggctacttcgacgtggtgtccaaggactcgggcgtgccgctggtcgccttctccctcaaggactcctccaagtacacggtgttcgaggtggccgagagcctgcgccggttcggctggatcgtgccggcctacaccatgcccgccgacgcggagcacgtggccgtcatgcgcgtggtcatccgcgaggacttcagccgcgggctcgccgagcgcctcatcgcggacctgggcaagaccatggccgacatggacgcgcacgccggc

SEQ ID NO: 10051 - DNA, 419 bp, Zea mays
  Clone ID: LIB148-012-Q1-E1-C1
aggcactggccgtcgtccgccggtagctcgtggtcgctcgctcgctccatcattcctccctctccgccggcgtgcccgcccgcccacatgacggagtcagagggcgagacggaggctgcgcgcgcggccgtgctgacgccgccgctgtcgctggggggcggcgggctcgcgggggagctccgcccggccaacctcggccaacgggtgctcagcctcttccgcaacgtccgcccgggctccgacctctcccacttccagctgccggcgacgttcaacctgcccaagtcgcagctgcagctgtacggcgaggccgtgtactgcggcggcgaggacatgctggcgcggtgcgcgcgcggcgccgacagcctgcagcgcatgtgcgccgtggtggcctggagcatctccacaagcgggccccc

SEQ ID NO: 10052 - DNA, 417 bp, Zea mays
  Clone ID: LIB148-012-Q1-E1-C10
tagcggtctgatcgtatccgggtggccccacgcgtccgatagtagcgaaaggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagattcgtgaaccccaaatgggaagaagagctaactctgaacgtcacagattccaaccaaccactgaagctggaagtgttcgacaaggacaccttcagcagagacgaacccat

SEQ ID NO: 10053 - DNA, 422 bp, Zea mays
  Clone ID: LIB148-012-Q1-E1-C11
acatcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcactcggaggcccgcgcgcggccgtgcg

SEQ ID NO: 10054 - DNA, 428 bp, Zea mays
  unsure at all n locations
  Clone ID: LIB148-012-Q1-E1-C2
agatattcatgtcactgcttgctggtgctctgtttgggcagctccggggcgtggccctggtagtcttcgccgccactgctggcgcttcttcgtgctatttcctgtcgaagatgattgggaagccactggtgttcacgctgtggccagataaactcagcttcttccagagacaggttgctaaaagaagagagaagctcttgaattacatgcttttcctcagggtgaccccaacattgccaaataccttcatcaacttggcttcaccgatagtagatgtcncctaccacatattcttactgggaactctcattggccttatcccagcttcttatgtgactgtcanggctggaatcgctcttggagaataaactcgctaagcgacctttacgacacccagtcgatagcgctgctattcctgatcggtgttg

SEQ ID NO: 10055 - DNA, 459 bp, Zea mays
  Clone ID: LIB148-012-Q1-E1-C3
gggccggccaaggcgtcggggtaaatctcggacctggagcgcaccgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatggtgaccgccattgccggccgcccctgctcctcccgactacgaccctcgccgctcatcaggaggcactgaggaaggagatcgagaggctgaggcaaatctaccagcagcagagcctgaagagcggcagggagcccgacgcggccccgtcggtccgcgacgacaaggacatgatcggcagcgaggggaccgccgcggccgggcccgccctcgtgatgaggaggaggtggtggggcgacacgtccagacatccgagtcggtcgctgtagtcgggg

SEQ ID NO: 10056 - DNA, 399 bp, Zea mays
  Clone ID: LIB148-012-Q1-E1-C4
acggcactgcttggtagcgtcatgtctgtccagatccaggtgttggccctgtctactcttcgtcgcctatcgcgaacactacttctcgctatttgctgtcgagggagggtaggaaacgaatggtgttcatgctgtcgcgaaagacactatccttcatgctgataaaggttactgacggaagagactgctcctcgcgattaatacttttcctgatcatcaagacgaaattaggaaggatattcatcagcttaggcacatctactatcatcatcacctgagacacagtatgaatgccaactcggatctgtctgtccgcgacatctggacatgattctaagccaggggaccgtcttgcccagttaacttccttgatgaagattaggtagtccaactacatat

SEQ ID NO: 10057 - DNA, 436 bp, Zea mays
  Clone ID: LIB148-012-Q1-E1-C5
aatgacttctgcaaacagcttgagcttgccaggacgttccagtttcctactctcaggcagccacccgcatcgtttcttgcaacgatggaagagtacatcagagaagcaccccgaccctcgatcaagagtgaggagagcgaggagccgaagctactgacctacgagcaagaagctccagaggaacccgaaaatgctgtggaagaggagaaagaagaaccgagtcaaaaaccagaacctcagcctgtgcctgatccagaaccccacccacagcaaacgactggagatctactaaacctggaagcagaggtgaatccttcggctctggaactcgaacaaagcaatgcattggcactcgctaatgtagcaccaggtgactacaagccgccagcatctcaaagtatgtttgatgtcaattcgtctgggtgggagctggcac

SEQ ID NO: 10058 - DNA, 434 bp, Zea mays
  Clone ID: LIB148-012-Q1-E1-C6
agcacacacacgcaaccagatctcccccaaatccagccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaacctccaacttgtgctccgcctcaagggaggcatgcagatcttcgtgaagaccctgaccggcaagactatcaccctcgaggtggagtcctccgacaccattgacaacgtcaaggccaagatccaggacaaggagggcatccctccagaccagcagcggctcatctttgctgggaagcagc

SEQ ID NO: 10059 - DNA, 435 bp, Zea mays
  unsure at all n locations
  Clone ID: LIB148-012-Q1-E1-C7
accacgcgtccgcaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcacaaggctagacctgccggtgaaggtgccgtacgacttcatcgtgtcgctgatgaaggatctcggangggact

SEQ ID NO: 10060 - DNA, 436 bp, Zea mays
  Clone ID: LIB148-012-Q1-E1-C8
atcctcccctcccccgtgcgaatgcgtctcctccctcggccggccgctcgtccgctcgctctcccccgcacgaatctccaggtgatggcggcgcgccgctgccactgacgtcgccagcggtggcggcggcgagcgcgcgatcgcgggcgatggccgccgaggccagcatggagcgcgcgcgcgacggccggcgccacgagcaccagcagaagcagcagcggcgcagccaccggcggtcggcttcggcgtccgtgacctcgtccacgaaggaattggcaacaaggtccgggtccgccttcggcttcagcgtctcggtcccaggcggcggcggcggcggcgcaggagtcggagcggcggctgcggcggtccccgcccgtggaggcgcggcgggagcgcgagcggcgtcgggcgcgcgagcagccgcggtgcggggagg

SEQ ID NO: 10061 - DNA, 411 bp, Zea mays
  Clone ID: LIB148-012-Q1-E1-C9
ccaccacgactatatctgccacgtgcgcctgctcaacaaccccgacgccgtctgcgccgagatccagcactcccgcgaccgctgccgcgtcccgctcaccctcagggggggcatcaatcacagcggcgtccgctacggcgggcccatctccttcctccgcaaggagccgctccccaacttgcagcaagctgctccgcgcctacgacctctacaacgagacgtccgataattcccaagcatgcaaacaaactttctctcgctctctttttttttaacaaaaacatcccatatacatatagcacatttgtttccgtttgtttatgcccgcatgcatgctatcagacatccttcctaagaaaaatttatgttatttccatctcgcattattttagtatctaccattcaagtttt

SEQ ID NO: 10062 - DNA, 452 bp, Zea mays
  Clone ID: LIB148-012-Q1-E1-D1
cacgcgtccgaccaagcgtccgagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctggga

SEQ ID NO: 10063 - DNA, 414 bp, Zea mays
  Clone ID: LIB148-012-Q1-E1-D10
ataccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggt

SEQ ID NO: 10064 - DNA, 426 bp, Zea mays
  Clone ID: LIB148-012-Q1-E1-B8
aatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaacaggatggccatcgaccacgccgccagcaccgagtccaagatcgacgacctcgcggagctgga

SEQ ID NO: 10065 - DNA, 438 bp, Zea mays
  Clone ID: LIB148-012-Q1-E1-A4
aaccatagcttgctcctcgatccatcaattgcaagaggagcaagataccaccaccgtagcaccacacgcaggtacgaagaaggcgacgaacatggcaaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaaggtacaggcctcatcgtgtggtgccgcgtgtgtgtatatattacacacatgcattatacattggtcgtc

SEQ ID NO: 10066 - DNA, 312 bp, Zea mays
  Clone ID: LIB148-012-Q1-E1-A5
ccacgtggctctcctgctatcgctgctggtcgccgtgctagcggtggccgcggatgtcgccaacgccggccacgccaagcccctgacgcctggcgggcgcgtggtacaccacaaccacggtaagttcacggccgggccgtggtaacccgcccacgcgaccttctacggcgggcgggacgggtccggcaccacggctggcgcgtgcgggtacaaagacacgcgcgcgcaggggtatggcgtgcatacggtggccgtgagcacagtgctgttcggcgactgcacggcctgctgcgggtgctacgaggtgcgctg

SEQ ID NO: 10067 - DNA, 434 bp, Zea mays
  Clone ID: LIB148-012-Q1-E1-A6
accacaggcacacaagaacaaatacctcgctaccaacaatggcctccaggtcctccatcctacttgcaacgtcgatgctggctgcgctgtttgcggttggtttgtgcaccaccccgctcaccttccaggttggcaagggatccaagcctggccacctgatcctcacccccaatgttgcaaccatatccgacgtggagatcaaagagcacgggggcgatgacttctcctttacgctcaaggagggcccgaccggcacctggacgctcgacaccaaagccccgctcaagtaccccctttgcatccgctttgctgtcaagtccggtgggctacgcatcgctgacgacgtcatccccgctgatttcaaggccggcaccacctataagaccacactcagcatctaatcagcctctgatgatgaattaaatttcaaaaga

SEQ ID NO: 10068 - DNA, 316 bp, Zea mays
  Clone ID: LIB148-012-Q1-E1-A7
aaagcagataagaataaatacctcgctaataaaaagggggggcgatctcttcgatcgatcctggcttacgtatgcatgcagcgtagttcgtcgtcgatcgtatgcactaacgtgcatttcattcgccgtcgttcgagatcctacgtcgtgcaagagatatgcagggcgttagctaaatcgatctcctacaaggagatcttcctttagctggctgaagtgctagcggtgacgcacacataggtcttcctaggaattagttagccagactgaatggtgaaaggcacgttgcctgtgtgcattcattatgctgggaggt

SEQ ID NO: 10069 - DNA, 331 bp, Zea mays
  Clone ID: LIB148-012-Q1-E1-A8
gacccacgcaaccgaggacgtaagaagtcgtctaattcttggatcgaattagacgacttcctcgtatctcacttcattagcacgcgcacgtgtcatcggcaggatctaagcatgtgacttgagtgactcatggtccgattggtaagcgtcttgaaggttcgcgtggtcatgggcatcaaccttgccgaacgcaaagcaagagggagcattacgtatgtcgtccgacagcatgtcacgattacgctgaaagaaggcgtgaccgaaacatgcgtgcacgacatcagggaccaagacaaatatccgattggcatacattttagtcaaacattga

SEQ ID NO: 10070 - DNA, 399 bp, Zea mays
  Clone ID: LIB148-012-Q1-E1-A9
ccgggtccccccacgcgtccgatagtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctaca

SEQ ID NO: 10071 - DNA, 313 bp, Zea mays
  unsure at all n locations
  Clone ID: LIB148-012-Q1-E1-B1
tccgctctgattctcgtcgtcgccttggcgacgtgtacaaacaagtctgttgatgcccgcgtggtccaccccatcgtcaccctcgaggccgatggctcatctcccacctctggcgatggtcgtcgcctgatcagctccaccaaccaagatgaacttggagcgtttatgccaacagatgcactacaagacgttgtgctccacgatgacgacactgcctgnggtgactacgccagagcaactcttagatgcatccctgcggattacagcggtgaaggcagcgatggcggagatgaagctagacaatgcaataaaa

SEQ ID NO: 10072 - DNA, 416 bp, Zea mays
  unsure at all n locations
  Clone ID: LIB148-012-Q1-E1-B10
acaggaggaagtggcaacgtctatactggaaccggtgccgatgcaggcgtttctggtggaggatccggtggcgccgacggtggtattggagctaacataggtgctggtgtcttcggaggcgtcaaatttggtggcggcgccggaggaagtgtangaggaagtggcagtgctgctgcaggtgcttctggagggagtaaatcatcggggggtggctcagattttggatatggttcagcgagcaaggagttatagaggatgatgaccactcaccaccgttagatcgatatgattcgtcccaaggaatttattcctgccctttttgttatcgcgtgttgttttattaccacgcaccagtcaatagtgtggaggcaatatacattgattccccttgactggacaatacaaagataacctta

SEQ ID NO: 10073 - DNA, 424 bp, Zea mays
  Clone ID: LIB148-012-Q1-E1-B11
agaacgcgtgggacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcacgcactcgtggttggcatctacgacgagccgatga

SEQ ID NO: 10074 - DNA, 383 bp, Zea mays
  Clone ID: LIB148-012-Q1-E1-B12
cacgcgtccgataaatcgttctacactcaaacaatatcgtcacggtcaccctcaacgatgcagatgacatcgaagcgaggtaggcatctctgatctaggagcaatgtcgtggtaagcttacgtgaggaagcagctgatatgtgacatcaagggccagcaactcacggcggcgacgatctgctgccacaactgattcctctgggagcagagcatcgcgttccccgacttcatgaccgaagacatgggcaacatcatgaatgacttcgacgagccagagcacctcgcgccgacatgcctgttcctcggacctagcaagtacatggtcatccaatggtaacctggtgccgtcatccgtggcaacaacggattaggatgcatcaacg

SEQ ID NO: 10075 - DNA, 381 bp, Zea mays
  Clone ID: LIB148-012-Q1-E1-B2
acaaacctccggacaagtcatcgcgacaatcgtatgcctcggtaatagcatcatgggcatgggcgccgtccatgatgagctcctcgcccgcggttcttgcgggccccctaacgtgcgactcggcccgaccatcaccagtaactacaagggcaagtggcacaacgatatggacacgtgattcggtcagcgcaacggtgacgtggcaccggaaaacgaacgttcgtgcggcatcagaaacgtgaagttgctaccctataacggcattacagcttgcagcatagtcccgatcttcagcgtccggaaaggttgccagccatgctgccaggtgagatgcaaggtcatgcctgaatgttcgatcaatcgagtcaccgtgttgatcag

SEQ ID NO: 10076 - DNA, 419 bp, Zea mays
  Clone ID: LIB148-012-Q1-E1-B3
caagcgtccggaaccagcagcctccaataggagccagccagagaaactaataaaactctcaccgccgccatccgagagaacaagccaaccgaccccgtccccaaggcaatccgtcgccgacgtaccaccgccaccgcaggagcgagatggagatgaacaggatcctcttcgccgtcctcgtcgacatcgccgcctcggccaccgcagtgctggcctccaccgaggccgccgccgcgggcgccccaactgcctcagagtcgtccgccgaggctcccgctggcgctggcgctggcgctgccgctggcgccgccgccgcggggccctccgccatcaacggcgcgcccgcactcgcggccgagccagctgcgctcctcttctcgctcctcgcctactacctctactaagcgtgtgcgtgctta

SEQ ID NO: 10077 - DNA, 434 bp, Zea mays
  unsure at all n locations
  Clone ID: LIB148-012-Q1-E1-B4
acaagcgtccgcccacgcgtccgcccacgcgtccgctggactcgcgccactccttgtaccagggcctgtacgcccgcagcgtggcggacgcccgcatccgccccgcgctccgcctgctgaagcagaacctgtcgttcctggtgtccgtgctcgcggaccgcgcgcagcccgtggcggtgcgggaggtgatgcgcgcctccttcgaggcgttcctgatggtgctcctggcgggcggcaacgagcggagcttcgtgcgcgccgaccacgccacggtggaggaggacttccggagcctgaggcgcgccttctccacgtgcggggaagggctggtcnccgaggacgtggtggcgcgggaggcagagacggccgaggccgtcgtggagctcatggcacgctccacggactacctcatcgacgcgttcagcgtcgccacg

SEQ ID NO: 10078 - DNA, 447 bp, Zea mays
  unsure at all n locations
  Clone ID: LIB148-012-Q1-E1-B5
cccacgcatccgaccatgcacgcgcgcacaaggcacgcccagcaacacaaaagttccaaggcctccccttcctctagcagtggcgaggcaggaaggcaggccgggtgtcctgcctcccttgcgcgcgctctcacgacccatcccgtcgtgcgtcatcgagctccggcgggcgggccatgcacgcgtccagctagctcacacagcgccgtctcgaccggctgccggtgctccacccggcccgcgtccacatcacggcgggcgggcgcgcgcgtgaacggtttcctctccgcatgaccctgtgatggtcggtgggttcctgcggcgcggccacagcctcgacaggctcctgtcgangangcgccgggccttttcgccaagcccctcgttctcgtcctcctcctccacgccgtcgtctccgcgtggcagcagcgtcaggagcggcatgat

SEQ ID NO: 10079 - DNA, 425 bp, Zea mays
  Clone ID: LIB148-012-Q1-E1-B6
acggccggccagccagcgcgcgagaggacgtacggacgaacagctataggcggaggcgatggacggccaacgacgacagcaatggccgaggtctcgctcgggggctgccgccgcgcctctcctcctcctgctgctcctgtcggtgtccttgggggggcatggtgatcacggcgcggcggctgcgggcgtcgcccctgcagccggcaacggcatgacggagctgcagaagcacgtggcgttcttcgaccgcaaccacgacggcatcatcaccttcgacgagacctatcaatgtctgcgggacgtcggagtcggcgatgtcacggccaaagccagcgccgcgttcataaacggcgccctcggccccaagaccagacctgacaattccaactcctcaagcacggatatctacgtagagaacattcaga

SEQ ID NO: 10080 - DNA, 200 bp, Zea mays
  Clone ID: LIB148-012-Q1-E1-B7
ccacgcatccaatggccgtcgagcgagcgtaccacttgacgtaccgtccactacatctatgcagtcgcgatggcagggtactgaccatatcagttgacgaagtcatgctcggaggcgggtgcttcgctctcagccttgtgcaggccatcgctgtctccttggggcggcatgctcactgaggagctgcggctgtcaacctc

SEQ ID NO: 10081 - DNA, 431 bp, Zea mays
  Clone ID: LIB148-012-Q1-E1-A2
gtgatgctgtggctactcaaggacaagctaagcgagatggaccacgacggagacggcaggctaagcctggaggagttcgtcgcccaatctcacatcatcatctccggcgcgcgtcacgacgacgacggtggccatgcccatgaccttgagcgtgccgaagctgcgaagaagttcacggaactggacgccgacaaggacaactacttgacggtggaagaagcgcgctgcgtactgcagagcctcgttacgggggagttctcctatgctacctcacatgccaagttcttgatgaaggctgatgtgaaccatgacggcaaactgtcgctggaggagatgctagacgactacatatccttctacagcaccgtgtatatggatgatcattacgccagtgaaggtgaagtagatagtgattcccgcgacgagctatg

SEQ ID NO: 10082 - DNA, 402 bp, Zea mays
  Clone ID: LIB148-011-Q1-E1-G9
aaaagaaacaatccttgcacccctcccctgcgtcaccccaacatatccggccagcccaacgaaaatgtcgcgcgccacagctgcggtcctcttctacatccgtcgccgtcggggccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgctccatcgtcgtcgtcgtctacgaagtctggtccagctgccgcgccgaccaccgccggctctacaccgtcttcttccacggacgaggagtttagcccttcgccgtcgg

SEQ ID NO: 10083 - DNA, 359 bp, Zea mays
  Clone ID: LIB148-011-Q1-E1-H1
aaggcaggcccgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcac

SEQ ID NO: 10084 - DNA, 423 bp, Zea mays
  Clone ID: LIB148-011-Q1-E1-H10
ccacgcgtccacagacccgtccgcatgatggcatgtatacacactgcattgagagccttgttccttctagcgctcttctgcaccgtgcatggtgagaatgcaaactcatcggacatcgattcagaagcgtccgggcccggtgggtccttcgtcatcaccacgttgggcgcctctggcaatggcacgatggctatcacgaacgctgtgcaagaggcgtgggcatcagcgtgccgcggcaccgtgaagcacacgatcgtcatccccaagggcgacttcctcgacggaccactcaacttcagaggcccatgcaagggcgacgtgaccatccaggtgaatggcaatctgctggcgaccacggacctaagccagtacaaggatcattggtattggatcgagattctactcgtggacaaccttgtcatc

SEQ ID NO: 10085 - DNA, 329 bp, Zea mays
  Clone ID: LIB148-011-Q1-E1-H11
ccagattgccctcctttcttaacactaatttgcaccatttacagaatcagctttagcttacagggactaaccaagtctgaaaaatatcagttaatgatgcaaagccagcatcgatgcatcataaacgatgactgaatgagccatgcgtgtgtgtttttataagctgagacgtagtaaaatgtagaagatcccatacagcgctgcctgatcagggttgggagcttgcatctgaagtggcagcaggaggcggcgaaggcttgcttctttggcggctgaacaagttgtgcttgtgccaagcggcagcgacgatcgacaagccactgaaccta

SEQ ID NO: 10086 - DNA, 454 bp, Zea mays
  Clone ID: LIB148-011-Q1-E1-H2
gacccaggcctccgagcgctccccatccttcggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttccctgacatcagcaagccgttcatcac

SEQ ID NO: 10087 - DNA, 423 bp, Zea mays
  unsure at all n locations
  Clone ID: LIB148-011-Q1-E1-H3
accaggcaaacgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcncgcgcattcccgatgcgtgggcgtgctctgattgggcacggcggtggcagtggcacaccttcgtcttccttttg

SEQ ID NO: 10088 - DNA, 431 bp, Zea mays
  Clone ID: LIB148-011-Q1-E1-H4
cacgtgtacgggaataatcacttaggatttcaggaaagaatggcattttaagagttacatcatggcgtgaatcaatatagttgccagtttgttaaattagtttcataaaatgttgtgctctgaatttggaaattttccgagatttgttcattgcttagttgaactatatgaggccgtttcttgggcggtgattcctgaagcattcacaggttactataagaaagaaccatgacgtgttgatatttctatgaaatattgtattttcatataatagtgttaaagcttctctttgtctgtgaatctataggcaggtcaatacttcgtcattaatttgtacccgatttcttgtcattcatttcataaaaacatgtagttttgatgtatttggtcataactaacaattatctatccttctgaactaaactagtatc

SEQ ID NO: 10089 - DNA, 373 bp, Zea mays
  Clone ID: LIB148-011-Q1-E1-H5
acggaggattccgatgatttcgaggttgcaactaattgctcgttagagctggactgcgtgaggccatctagtgccccaaaagcttcaggtttatcaaatggagggggcacagctgtaaaaaagatccaagtcaagggttcaaaaggttcagacgttaggggagtgaatcctggaaaaaggtcatcgccattacagaagaagccgagtggaccctcaccgacgctaatcaagaagggcggaggtgaaggaaggaagactccaaatggtaaaacaggaaccaagaagtaagcaatccagatgaaacttggttttgctgtgaccaacttcaccttggttagggacagataaacatgttgatactatcgggtgatac

SEQ ID NO: 10090 - DNA, 425 bp, Zea mays
  unsure at all n locations
  Clone ID: LIB148-011-Q1-E1-H6
ctgtncattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaaggaacacgagggccggccgat

SEQ ID NO: 10091 - DNA, 422 bp, Zea mays
  unsure at all n locations
  Clone ID: LIB148-011-Q1-E1-H7
actggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccnacaagaagcaggacgacaag

SEQ ID NO: 10092 - DNA, 420 bp, Zea mays
  Clone ID: LIB148-011-Q1-E1-H9
aaggctccccaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccagcgcattcatcgcttcagctcgatataatcgctgctccgtcagcaacccacatatgattcgatcaatcttcctcctctaatttctccaaccc

SEQ ID NO: 10093 - DNA, 312 bp, Zea mays
  unsure at all n locations
  Clone ID: LIB148-012-Q1-E1-A1
gtcgaagcgaagcttccggttcatcacgttcangatcaacgagcagacgcagcaggtggtggtggaaaggctggggaagccggcgaaaactaagacgacttcaacggctccatgcccgagagcgagtgccgctacgccgtcttcgacttcgacttcaccaccgacgagaactgccagaagagcaagatcttgttcatctcctggtcnccggacacctcgagggtcaggagcaagatgctgtacgcgagctccaaggaccggttcaagagggagctggagggcatccagctggagctgcaggccaacgacccc

SEQ ID NO: 10094 - DNA, 363 bp, Zea mays
  Clone ID: LIB148-012-Q1-E1-A10
aggacgtaagaagtcgtctaattcttggatcgaattagacgacttcttcgtcactctcttcattaacacgctaagatgtgatctgcaggatatacacacagacgtgatttaggtagcgactgattggcaggccacttgaaagttcgcgtggtccggagtatcaaccttgcctaccgcgacgcaagaggcaacgatccgtatgtcgtcctacagcttggcaagaggaaactgaagagaaacgtgaagaacagatgcgtgaaccccatatgtcaacgggtacatagtctgagcgtcagagatgccagcctaccactgaatctggacgtgttcgacaaagacaccttcagcagagatgaccccatg

SEQ ID NO: 10095 - DNA, 440 bp, Zea mays
  Clone ID: LIB148-012-Q1-E1-A11
ccacgcgtccgacaacgcgtccgcccacgcgtccgcccacgcgtccgcgatcgagcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaaaggatctggaggcataactgtgaagaagaccggacaggcgctggt

SEQ ID NO: 10096 - DNA, 420 bp, Zea mays
  Clone ID: LIB148-012-Q1-E1-A12
agaacacggacgagaaggacgtcacggacatcaacgtcaacgattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcaagcacaaaggttgcctca

SEQ ID NO: 10097 - DNA, 435 bp, Zea mays
  Clone ID: LIB148-011-Q1-E1-G8
cgcgtccacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctc

SEQ ID NO: 10098 - DNA, 433 bp, Zea mays
  unsure at all n locations
  Clone ID: LIB148-011-Q1-E1-F3
cccaggcgtccaagcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcggnggtgatggtatggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacatangaaggagcangagcatgccgggttggtgccatgtaaaaatct

SEQ ID NO: 10099 - DNA, 426 bp, Zea mays
  Clone ID: LIB148-011-Q1-E1-F6
aggggaggtgtccgggatcacgctgctcaactccaagttcttccacatgaacatgtacaagtgcaaggacatgctgatcaaggacgtcaatgtgacggcgcccggggacagccccaacacggacggcatccacatgggcgactcgtccggggtcaccatcaccaacaccgtcatcggcgtcggcgatgactgcatctccatcggccccgggacctccaaggtgaacatcaccggcgtgacctgcggccccggccacggcatcagcattggcagcctaaggcggtacaaggacgagaaggacgtcacggatatcaacgtcaaggactgcacgcttaagaagacggccaatggcgtccgcatcaaggcatatgaggacgctgcctccgtgctcaccgcctccaagattcactatgagaatatcaagat

SEQ ID NO: 10100 - DNA, 428 bp, Zea mays
  Clone ID: LIB148-011-Q1-E1-F8
acaaacaggcggaaggagaacatcgatcggtcgtggctgtttccacagccggaccgaatagcggcgcggccgggaaatggggagaaaaggcaagtggttcgacaccgtgcagaggatcctgatcacctctgaacctgatcccgtggagacgcagaacgatgatgccgccaagctcgatcatcacgagaaggctgcgaagctgagagacaataagtcggccatcaggaggatatggcagttcggcaaatcaaactcgtccggtgcttccgcctccgcgacggcgccggaggacgcggaggttcttcagtttccgaagtcgccaaggtcggacaacgagtaccatgtcgtccaggacctcaccgaggaggtgccgttcatggagacgagaggcgaggaagaagaagaagaagacggcgagcgcatgaacc

SEQ ID NO: 10101 - DNA, 422 bp, Zea mays
  unsure at all n locations
  Clone ID: LIB148-011-Q1-E1-F9
acccacgcgtccggccgtcttctcgtctcgctcccctctttgcgccgcccccagatccggcaccgcccgctgctcgaacccgcaccccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaaatggatggtaagcgtatanagctacagatttgggatacagcggggccaagaacgcttccgtactattaccactgcgttctaccgtggacctatgggtat

SEQ ID NO: 10102 - DNA, 416 bp, Zea mays
  Clone ID: LIB148-011-Q1-E1-G1
accacgcgtacggggatcaggagagcgccatgctgttttttttctcaccttcacaggaactccgacgtgcaacggcggccttcaccacgaactcctcttctgggctgatgatggtgcggcagagagtcagggtgatggttatttttttggagatgaactgcagcaggtcttgcggtgatttggaggcagcctcacggcagtatggaatggactcccccggaatgatcgctgtggcctgctatttatacactaccggaatttggctctttgccgagtgccaaattctttgtcgagtgttttatttcgggcactcgacaaagagctctttgccgagtgccacgcaaaaaaccctcggtaaaagaaaacactcggcgaaaaagctctttgccgagtgttttatttttgacactcggcaa

SEQ ID NO: 10103 - DNA, 301 bp, Zea mays
  Clone ID: LIB148-011-Q1-E1-G10
atgctgggatcaaacgacctgaacaagtacacggcgagctggatcgaattgtctcacgttaacaacatcgggatcaccggctcgggcacgctggacggccaggggaccgccgtttatagcaagagcaagaccgacaacgtgaaggcgatgcccaacacactggtgctgtttcacgtgatcaacgccactgtcgccggaatcaaactactcaactccaagttcttccacatcaacatcgacaactcagagagcatcaccgtgaaggacgtgaacgtcaccgcgcccgccgacgttgagaaca

SEQ ID NO: 10104 - DNA, 329 bp, Zea mays
  Clone ID: LIB148-011-Q1-E1-G11
ttcacgggccaacccacacgtccatgctgggatcacacgacctgaacaagtacacggccagctggatcgaattgtctcacgttaacaacatcgggatcaccggcgcgggcacgctggacggccagcggaccgcggtgtatagcacgaggaagaccgacaacgtgaaggcgatgcccaacacactggtgctgtttcacgtgatcaacgccactgtcgccggaatcaaactactcaactccaagttcttccacatcaacatcgacaactcagatagcatcaccgtgaaggacgtgaacgtcactgcgcccgccgacgttgagaacacggac

SEQ ID NO: 10105 - DNA, 421 bp, Zea mays
  unsure at all n locations
  Clone ID: LIB148-011-Q1-E1-G12
cgtccacgacgtcgtcattacgctgggcttcctcacggcgatgccgccggatccaccggcccctgctgctccacctgccgccgcctcggagccgaagaaagacaaagcagaatcggatcattcagactcatcgtcatcttcttcggacgacgaagaggacgaagaggaggaaaccgaggagcaatgataagggcatgcaggtgtgttcctaggcttcagatgtggaaggccggccacgcagatgaatgtggcttcatgcacctattctgtaaggagctcaatatgtagaccgtggattaattaatcctttgggggctagctacatggtgtggttgcggttgcggcagtgtaaatttggggtgttcataattttttntttttttgactgtcaacgggggaaaagctccccacctggattttc

SEQ ID NO: 10106 - DNA, 329 bp, Zea mays
  unsure at all n locations
  Clone ID: LIB148-011-Q1-E1-G2
cccaggcctccaaagcacctaactctagctagctactagacgacagctagagctagctccctcaacgacgacgcagtagtacatatggagaaagcggccggcgtgagcccggcgaagctggccctggccgccgccgccgtgctgctgtgcctgctgctgctgctggccgccgggccccaaggggtctccggcgccgacgggaggaggaagacggcatccccctacgataagttgatcagctgcanggtgctgggcaactgcgacaagaacaaaggcccggaggccacccgccccgggaagccggtcaacaggtacacccgcggctgcag

SEQ ID NO: 10107 - DNA, 442 bp, Zea mays
  Clone ID: LIB148-011-Q1-E1-G3
cccaggcctccaagacgatcaagtgtcggcatctcaaataatcaatacaatgtggaattcattgaaaggacggccagttctgggccgtatataccaagggaaggagccaccacaatttgttgctcttttccagcccatggttatcttgaagggtggaatcggatctggatacaagaagctcatagaagaaaaaggtgctatgggtgagacttatactactgaaggcatagctctaattcgagtatctgagacatctatctacaacaacaagactcttcaagtagatgcggtagcaacgtctttaagctcaacggagtctttcgtactgcaatctggaaatgctatgtttacatggtttggcaattctagcacatatgagcaacagcagtgggcagcaaaagttgctgaatttttgaagcctggcgttgcagtgaagcactgc

SEQ ID NO: 10108 - DNA, 431 bp, Zea mays
  Clone ID: LIB148-011-Q1-E1-G4
ccaggcctccagcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcat

SEQ ID NO: 10109 - DNA, 396 bp, Zea mays
  Clone ID: LIB148-011-Q1-E1-G5
accacgcgtccgcccacgcgtccggttgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgca

SEQ ID NO: 10110 - DNA, 431 bp, Zea mays
  Clone ID: LIB148-011-Q1-E1-G6
acccacgcgtccgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgat

SEQ ID NO: 10111 - DNA, 425 bp, Zea mays
  Clone ID: LIB148-011-Q1-E1-G7
acccacgcgtccgcccacgcgtccgcccacgcgtccgcccacgcgtccggcaagggagagaaaggaaggagggcaggaggagaggcggaacaacccgtctccctccatctctctaccttcttctcctgcgcccctatccatcgctcgcaccacccactgaccggccggcggcatccttattaccataacatcacgggacggtggcgcgatgcaaggaggcccactgagcccggatgagtactgggtgatatcgccgccggcgctgctgcaccagccggcgtccaccatcgtcgtggccatcgaccgggaccggaacagccaactggccgtgaagtgggtggtggaccacctcctctccggcgcctctcatatcgtcctgctccacgtggccgtcccattacacacgacccaatggttcccatggt

SEQ ID NO: 10112 - DNA, 424 bp, Zea mays
  unsure at all n locations
  Clone ID: LIB148-011-Q1-E1-F2
accacgcgtacggttttacccgccattttcctctcctctcctctccctccatctaaggagaggagagatatgcagctcacgagctccaccaaatgctgacctcccaaagctgtggtcgcgattcaaacaaaaaggaaatgatcaggcgacaacccggcatggatcggttcctgcagctgctggccgccggcgtggccgtgctactgctagtggcaacgcgggccatggctgacgacgacattgtaaaagtcngcgtcaactggggatcgcagctctcgcaaccgcttctccccggctccgtggtgaagatgctcaaggcgaaacgcatcgccaaggtcaagatgttcgacgccgactcctggcccgtcggagcgctcgtcgactccggcattgaggtcatgctcggcatccccaacgacatgct

SEQ ID NO: 10113 - DNA, 240 bp, Zea mays
  Clone ID: LIB148-011-Q1-E1-D9
attcagtcgtccgttaggtgcgtccaccatcggtgcacagaacggtggccacgatgacgatcaacaacctcctcctcgtcttcgccctggtttctgcggtccttggtgcggcgacggccgccgccaacgcgttcagcagggcgttcagcatctgggtggagatgaaccagcagtgctacgcgctgtacgtccaggactgcgtcagggaccgcggcaacgagcccctgtacaaggagctgt

SEQ ID NO: 10114 - DNA, 385 bp, Zea mays
  Clone ID: LIB148-011-Q1-E1-E1
aggacgcgaggggccttggtgacgccggcgcaggcgtcgacgaagtcgccgtcgatgaagtcggtggagaagacctggagcttgtcgccgaggcccttggcgaagacctcggcgatgaacatccgcgcgtagccgtggatccgcctcgtcacgggccacacgcacaccaccgggttgtcgggcctgggcgtcaccgtgttctccacccggtacaagaacccgcggcccgccaccggcggctgctgccccaggaacttgaggttgctctcgaacttggtctccggcaggtccgtgtcgatccagttgtccctgaggtacccggcgctccacaggggctccccgggcccgggcgccggcgacctgcgcggcttccacacgcagatga

SEQ ID NO: 10115 - DNA, 422 bp, Zea mays
  Clone ID: LIB148-011-Q1-E1-E10
aagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctgccggccagcaacaccattgtcccttgtggttcctgagttcttccttgtttatccatgcatggaaaccg

SEQ ID NO: 10116 - DNA, 197 bp, Zea mays
  Clone ID: LIB148-011-Q1-E1-E11
acgcgtccatactggattacaagcagtacatctagtacattatatgggtgtgcaagtcgcatgacgacatgttcctcaacggctccttcattaatcagtccagatgcggggaagagggggtctaggacatgttcgacctcatctataccaggggttgtcattacgccgtagtcgatcaccatctattctggtgcgct

SEQ ID NO: 10117 - DNA, 414 bp, Zea mays
  Clone ID: LIB148-011-Q1-E1-E12
agcgtcgccgagccatgacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaagcggcggcgggctggaccccgacggcgacccagaggttgggctgaacgggaaggcgatcgaggagatcgtgaacg

SEQ ID NO: 10118 - DNA, 444 bp, Zea mays
  Clone ID: LIB148-011-Q1-E1-E2
cccaggcctccgaggacgcgaggtgcgattcaaccgcggcctcgcatccggtgcggaggtctgcaattggggggaggctcctctccgccgttggaaccgctgcggcgtcgcagcctgtgcgactttcctgctggttcctcatccctcagggagagattttgcattctttggcattactgtttgatggcagacagtagtgctccttctctgtggaggcattggggcaaaaggcagttgaactgaacgggcacatcaatagtctctggcctccaagggaaattgggaaattcagattgaacgtggctgcatcatttttcctttcattggtcttttcagcaacagcgatccattctcgtaggggggagagagagagagagagagggagagaaatcaaagaggagagtgatcatggagcatgtgatcggagggaaatataagcttggg

SEQ ID NO: 10119 - DNA, 398 bp, Zea mays
  unsure at all n locations
  Clone ID: LIB148-011-Q1-E1-E3
aaaaaagcagggcacttcgtagccgcaagcattcttccttccttctccattccatcggtgaccatggattgaagacattgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcncggtccacaacaacatctagctcggcggcctcttcaagccacgggaagacgatgcgct

SEQ ID NO: 10120 - DNA, 449 bp, Zea mays
  unsure at all n locations
  Clone ID: LIB148-011-Q1-E1-E4
cccaggcctccgaccaggtggaaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcatcctcaccacctcctcctacgccgcgctcaacggcgttctgtactgcaagatccacttcgcgcagctgttcatggagaaggggagctacagccacatgatgaagaagagcccgtcccaggatacgctgccggacatggcagccgacgagcaaccgccggaaccggcgccaccgcaagacggggaaggagaggacaactangangaanggaccgccaccaatatatatcacacacacacacacacactcacac

SEQ ID NO: 10121 - DNA, 391 bp, Zea mays
  Clone ID: LIB148-011-Q1-E1-E5
aggcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagcagcagctggggtgctgacgtgctgtgggtggttctgttgtccatggcgcggaagcatcagcatgttgccatatttaccacagcgtgcttgccgtggatgactgggactgcggtaaacccactgtttcgggctgcataccttgccaaggctggagattgggaggtcacgctggtggtgccttggctgtccaagggggatcaggagctcgtttatccaaacaagatgaggttcagtttgccggc

SEQ ID NO: 10122 - DNA, 445 bp, Zea mays
  Clone ID: LIB148-011-Q1-E1-E6
tccggtcgacaacgcgtccacgggagcacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacaccttttgtcctctttttctttgttccct

SEQ ID NO: 10123 - DNA, 435 bp, Zea mays
  Clone ID: LIB148-011-Q1-E1-E8
cgcgtccaacattatggagcaatgacagaatcagttattcgcaacttcacccgccacattctaaggggtctagcatttttgcatggccaaaagattatgcatagggatatcaaaggagcaaatctgctagttgatgttcagggtgtagtcaaattggctgactttggaatggcaaagcatttaagtactgcagcccctaatctttcactgaagggaacgccatactggatggccccagagatggttcaagctacactaatgaaagatgtaggctatgatctcgctgttgacatatggagtcttggctgcaccatcatagagatgttcgatggaaagcctccttggagtgatcttgaagggccagctgcgatgtttaaggtgttacataaagacccaccaattcctgaaaatttgtccaatgaaggcaaagaattt

SEQ ID NO: 10124 - DNA, 103 bp, Zea mays
  Clone ID: LIB148-011-Q1-E1-E9
attctagatcgcgagcggccggccttttttttttttttttttttttttttttacaagaacagagagcattccaattatatgaatattcatgcacacggggggt

SEQ ID NO: 10125 - DNA, 388 bp, Zea mays
  Clone ID: LIB148-011-Q1-E1-F1
aacacggccgagatgcacgagtccctttccaatggagccggcggcaccccgccccttcccaacggtcgggcagcggctgccggggcggcgcggtcgcgcctgggccgcgacgggccgccctccgagctggacgtgatgaaggagaagttctccaagctcctgttaggcgaggacatgtccggcaccggcaagggcgtgccgtccgcgctcgcgctgtccaacgccatcaccaaccttgcggcgtccgtcttcggcgagcagcgcaagctggagcccatggcgcccgacaccaaggagcgctggaagagggaagtcggatggctgctctccgtcaccgacctcatcgtcgagttcgtgcccacgcgccagaccgcggagaacggaacta

SEQ ID NO: 10126 - DNA, 372 bp, Zea mays
  Clone ID: LIB148-011-Q1-E1-F10
aggcaagggacgtaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatggga

SEQ ID NO: 10127 - DNA, 398 bp, Zea mays
  Clone ID: LIB148-011-Q1-E1-F11
aggaacatgccccccggcatgccgcaggtgctcatcgtcacgggcctcacctggctctcctggttccccttcatcctcttcgacaccgactggatgggccgcgagatgtaccacggcaggcccgacggcagccccaaagaggtggccaggttccaggagggcgtccggcagggcgccttcggcctgctcctcaactccgtcgtcctcggagccagctccttcctcatcgagcccatgtgccgcaagctcaccgccaaggtcgtgtgggtcatgagcagtttcctcgtctgcgtcgccatggccttggtcaccgtcctcagctcctggtcgctccgcgacatcgggggcaaagtgcaagacgccgccgccgtggataagggcctcaagaccaccgcgct

SEQ ID NO: 10128 - DNA, 450 bp, Zea mays
  Clone ID: LIB148-011-Q1-E1-D8
ccgggcgacaacgcgtccagccccacgcacgccctcgcgctcaccggcgccccgcccctcccccacgctggccgcacccgcaatggggtgcgcggcgtcggccgccaacggggccgggccccggcggcgggggtgggcgcgggcgcggatgcggcggtacagcgaggcgtccacctcgggtctgccgccgccgccgccgccgccgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggccgacgccgacgccgccgacgccgatgactccgtcagggtcagagcgacggcgcgtcagctgagcaacaggtgcga

SEQ ID NO: 10129 - DNA, 97 bp, Zea mays
  Clone ID: LIB148-011-Q1-E1-C11
ggggctcccacggtcacctataactccatcagatgggtaatcatctgtaaaatataatataaaaaataaaataaaatatgatataaatagggggggg

SEQ ID NO: 10130 - DNA, 384 bp, Zea mays
  Clone ID: LIB148-011-Q1-E1-C12
agacacccacaaggactccgccgccggcaggacacaacacatctatcgcatagtcagcttaaaacatagtgatgatgcggtgacgcatccatcctccacgcttcttgtcttcgccttaattaatgattaattgttatgatcatgtcggccatccgaatgccgtatgtatgcatgcacatcgcgactaattaatccctgttgatttattactccgtgaaatgtactttctccgtacacacagcacactgctcttcggctaagatgaaactggtataaaccaatgttgcattctgcataaggcccctgacatggatgcgcgcctccactctactcgcgttcttggcacctttggctaccattcaccacaatatgccatgactggac

SEQ ID NO: 10131 - DNA, 444 bp, Zea mays
  Clone ID: LIB148-011-Q1-E1-C2
cccaggcctccgacttgttcatcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcaaggcccagccgtgtggagcaagaactccctgcacaaga

SEQ ID NO: 10132 - DNA, 421 bp, Zea mays
  unsure at all n locations
  Clone ID: LIB148-011-Q1-E1-C4
agcatcantcatgtctggtcgttcgtggacaataatggcgcctctcctggcgtcgatgctgctcgtcgggctcgccgtgggctccgaggaggangaggacngcggcggcananagaagccccacgtcaaccacggcaagtttaaggcggagccgtggacggacgggcacgcgacgtactacggcgggcgcgacgggttaactgacaccacggacggccgcgcgtgcggctacaaaggcgagctggggaaagactacggcaccctgacggcggccgtgggcccgtcgctgtacaccaacggcaccgggtgcggcgcgtgctaagagctcaagggccccaagggcaccgtggtggtgacggccaccaacgaggccccgccgccggtgagccggcagaaggggcaacacttccacctcaccata

SEQ ID NO: 10133 - DNA, 418 bp, Zea mays
  Clone ID: LIB148-011-Q1-E1-C5
cgcgtccacgaagccgaaggcctcgtgccttctcttcctccctggcatggaggaagtatctgtttcgcctatgatcgttgccgccgtattgctggacaacaatggcgccgatgcggtctcctgcactgccatccctagcgtaacactaagcctagaggagaaagaaaatatcaatggggatgttcccacgatcacctcggccgcaagcaacgatgaggatgcgttgttcagtgtcggagaatccaccaaggacgatggccatcgcttgacgatggaatgcaccactcccgtctcctccagtagcccttccactcgcaagaagcgcggggcgttcagcctcttcagggcgatgttcctgtccttcggccggagcgacgacagcatgaagattacagacgacgacaccacgatccccaag

SEQ ID NO: 10134 - DNA, 426 bp, Zea mays
  Clone ID: LIB148-011-Q1-E1-C6
acacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgac

SEQ ID NO: 10135 - DNA, 430 bp, Zea mays
  Clone ID: LIB148-011-Q1-E1-C7
cgcgtccagacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggcta

SEQ ID NO: 10136 - DNA, 432 bp, Zea mays
  Clone ID: LIB148-011-Q1-E1-C8
accagcatctcgccggagacgctgggcaacatcgcagcgtcgcacgggcaactgcagacgaacgagatcctggccaccatcccggcggcgcaggcgcatggccagctgccggcggacctgccgccggacgtgctgggtaagctccctgacgtgcaaagccagctgctggcgaacattacgcccgagatgatgagcagtctcgccgccgtgcagcagcctgcggctgctggccagcctggggcggcccctgctctcccggccgacatccctcagatccctaagatgcccgacctctctgggctggccaatatctcgttcccagttatgccgtcggagcccatgatgccacacctgccgcccggacttctcgttgtacaggtacgatgtcgccatccctaagttcatcaccaacatggtcgacggcaatggcgc

SEQ ID NO: 10137 - DNA, 359 bp, Zea mays
  unsure at all n locations
  Clone ID: LIB148-011-Q1-E1-C9
acggacgcgtgggcggacgcgtggggcgaaggtctgggccagcttccagggcgccggcttctggcgcagcccgtcgcagcgcgaggagaggaggtgctagctcctgatcgacccccgccgccacatctctccgtgccggtttcttggacccgatcccgatccgtcgcatgccgcatacaatcctcatagggaaaagatgaacgaactccagcgattggttgatcgatcggctgcagattgctgcgacggcgacgaccggtttcattgattgctcgcgtgtttttcctttttccganatattttcttgcattgggtgngaaggaggaaggaactggtacctctttcaatgttgttcttga

SEQ ID NO: 10138 - DNA, 371 bp, Zea mays
  Clone ID: LIB148-011-Q1-E1-D1
accacgcgtacgcccacgcgtccgctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggattcagtgcaaaggcaagtgcaccgagcagaagggcatcacggcgc

SEQ ID NO: 10139 - DNA, 422 bp, Zea mays
  Clone ID: LIB148-011-Q1-E1-D10
acccacgcgtccgagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaaaggccccaagggcaccgtggtggtgacgggcaccaacgaggccccgccgccggtgagcgggcagaaaggcgagcacttc

SEQ ID NO: 10140 - DNA, 228 bp, Zea mays
  Clone ID: LIB148-011-Q1-E1-D12
acgcaaacctccagaacatggtgtaggcaatcaaaattgagcaagtcgatagtacaagagtgatgatacgcttaccattgctagcatgacgatcgctaccagtgccaccacaaggaccgcctcggggcgtgggcggtattggcgatcgtatcagcggtcgccgccgtgcgagatttcgtcgcggtgctagccgccgccacatcaggagagctaaccacgatggggttg

SEQ ID NO: 10141 - DNA, 434 bp, Zea mays
  Clone ID: LIB148-011-Q1-E1-D2
ggcgctgtagatttcgatcttcggtgagcggtgcccaagctcctttccatcggtgctcgcccgcactgctgccaccgagatcctgtcggcacccgcctccgcgcgctcccgctgccgcacgggaccaacctgttcgcctgttcatccactcagcgacattcacgcccgcatctcgccgtgggcagcaccgcactcaccaccgccgtcgcagtgaggtcacgagtcagctgaagagcaagttggtacctggaatctcaagtcccaggtcaagaacaggtaccgcaggatgaggcgcatggaggatgctgtggcgagttcgtgagaggtctaggccatcgtctcccagtcaactttgggttgctggaccgttgtctccttataatgaaattatttatttattttgtatagaactcctgttatatagtaaagatgtg

SEQ ID NO: 10142 - DNA, 345 bp, Zea mays
  unsure at all n locations
  Clone ID: LIB148-011-Q1-E1-D3
cacatgctgaataaaaataaaggcagagaggagaggaggaggaggctttgtcatgttgaccgaccggaggagaggagggatggaggtcatgggggaggaggacggtcncgccggctatcgtcatcgccacagccgcaacctcgaaggaggaggaggaggaggtggagtcgcccaagaaagaagcggctctgtcgccggcgccggagcctatcgtcatcgccgccgccttaacctcgaaggacgangaggaggtggaatcgcccaagaaagaagcggctctgtcgccggcgccggcgccggaggccatcgttgccgtatcagcagtggaagacgtggtggcggaca

SEQ ID NO: 10143 - DNA, 429 bp, Zea mays
  Clone ID: LIB148-011-Q1-E1-D5
acggacgcgtgggctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagtttttttatttgcttttttttgcagacaaatacaaaccacacacatatatatat

SEQ ID NO: 10144 - DNA, 133 bp, Zea mays
  Clone ID: LIB148-011-Q1-E1-D6
ccctctcgtgctgttcttcctcaacttcgccatccgttactcgctctcctgcatcgcctgtcacaatatcaacatcattactgtctttactatcttcacggcttacggggttggtcatctattctctcagtcg

SEQ ID NO: 10145 - DNA, 409 bp, Zea mays
  Clone ID: LIB148-011-Q1-E1-D7
acgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgaaca

SEQ ID NO: 10146 - DNA, 400 bp, Zea mays
  unsure at all n locations
  Clone ID: LIB148-011-Q1-E1-C10
acgaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacncgatgggggacgcggagatcgacgtggcgccgctggtggaggcggcgaacgc

SEQ ID NO: 10147 - DNA, 415 bp, Zea mays
  Clone ID: LIB148-011-Q1-E1-A6
atccatcagggatacaagattagacatcactacctctctagctcgccaccatcaatggactctatgttctccatcagtgctcgccaccacggcactgggtacatggtttgtgattggttcgtgcactaccccgctgcggatcagcgtctgcagacgttccaaatttttcaccctggtatttacccccaacattgccaccatctccgaagtggagatcaaggagcacggtggcgatgacttctcctttgagctcaaggagggcccggccggcacctggacgcttgacacaaatgccccactcaagtaccccctctgcatccgctttgccatcaagtctggcggctaccgcatcgccgatgatgtcatccctgaaaattttatagccgacaccacctacaagaacaacctcagcatc

SEQ ID NO: 10148 - DNA, 420 bp, Zea mays
  Clone ID: LIB148-011-Q1-E1-A7
cgcgtctacacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatga

SEQ ID NO: 10149 - DNA, 427 bp, Zea mays
  Clone ID: LIB148-011-Q1-E1-A8
acggagccccgcctccgcctcaccgttcagaagcttgacgactccttcttcgacattgaaatcgcgcggtcggccacggtgtgggagctcaaggtgaccatagagaacttgttctccgccctctatgacgacacccagaagaccatctcttggaatcacgtgtggagtcacttctgcttatgcttcaaggacgagagactgacggatgacaaggcaacattgcgtgggtttggtataagagatggtgatgtggtacatgcacttccttaaacagccataggttcttggatgcatttttccttttagtgccgactaattctgctctgtcttgtgagataagccagaatattacttaccctgcttcatttaccaaatagaagttcctggatgcattttgccttttagtgccgactaattctgctctgtc

SEQ ID NO: 10150 - DNA, 187 bp, Zea mays
  Clone ID: LIB148-011-Q1-E1-A9
tctctccatcgcactcactcatcgttacgtctcactcgtcgtggcttcccttctcctcctcggggtcctcgtcgtcggcgcggtcattgtgcgggatgtaggcgagacctttcatgactcgtgtatcaagacccagttccccactatctgcgtccacagcctcgccgctaatctgtacagccacaat

SEQ ID NO: 10151 - DNA, 287 bp, Zea mays
  Clone ID: LIB148-011-Q1-E1-B1
gacccacgtgtccgaacacgcgtacgcccacgcgtccgcccacgcgtccgcggacgcgtgggcggacgcgtgggggcttgcgctcaagttcgcagtgttcgactaggagatcctgaactcccctgaccgtgcgtgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgaga

SEQ ID NO: 10152 - DNA, 314 bp, Zea mays
  Clone ID: LIB148-011-Q1-E1-B10
agcaaaccgtgaggtgaatcatcagcctccacttaaagccagcacatccaaataacaccgggagacctcagccctcaggcaagccgaccgccgacgtaccatcgcgccaagccgagaagaaagatggagatgatcaaaaggatcctcatcgccgcgctcctcgtactcgctgtctcggccaccgcagtgctgggctccaacgatgccgcagccgccggcgctccagccgcatccgagtcctctgcgtcagttgaagcccccgctggtgccgccggtgatggaggaggtagaggaaccgccgctgcgcgctccga

SEQ ID NO: 10153 - DNA, 231 bp, Zea mays
  Clone ID: LIB148-011-Q1-E1-B11
agaaaaaaaaaaaaaaaaaaaaaaaaaaaaaaaaaaaaaaaaaaaaaagggaggacgctcaaaagagataaaaacttacatactcttgcatgcaacgtcaaaagctcttctggggggtcacccaaaaggatttcactgaccttcgctttaaagcatcttcactggtaataccttggggtacccaaatttaatcccctggcagtacatttccctttcgctaactggcaataa

SEQ ID NO: 10154 - DNA, 408 bp, Zea mays
  Clone ID: LIB148-011-Q1-E1-B12
actcggcacccggtatccctgctcctcttccttggcggccgagcggggctccctctgacgactccgcgcttcctctggtgcacggccgcctctattgccgtcgcctggggcttctgctgcgttaccatgggccaaacagcgaggaaaatgccgagagagaggtagagacagtttggtcgtcgagtcacatggagggtgccctggtggccggggaatccttcacctgcggggtgctacatcgccgggctgctgcatcgtggtctgcctctactaccagggctgactccattgccggacagccaaaactctcggtcgagtctctgaaggccgtctgtccctgttccttccggtcaagaacaggtaccacaggatgaggcgcatggaggatgctgtgatgagttcgtgagt

SEQ ID NO: 10155 - DNA, 427 bp, Zea mays
  Clone ID: LIB148-011-Q1-E1-B2
atacgagaaactttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagc

SEQ ID NO: 10156 - DNA, 190 bp, Zea mays
  Clone ID: LIB148-011-Q1-E1-B3
gcatcgtgcacctcccatgactgatcagtcaagagagttcaccgactgggacgaaagccctccggagcatccggttcacctgcggcaactcatcgtgcggcttctctagggcccatgaccgtcgtcgaaacttgtaatcacacgttaagccccttggatgcaatggtattgctcgctgcagcatccatca

SEQ ID NO: 10157 - DNA, 435 bp, Zea mays
  Clone ID: LIB148-011-Q1-E1-B4
atctctccactctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccaaagaggccaagagccgggtggacgagttcgcggcgaggaaccacgagggccggccgatggagtccatcctcggagcctg

SEQ ID NO: 10158 - DNA, 423 bp, Zea mays
  unsure at all n locations
  Clone ID: LIB148-011-Q1-E1-B5
ctcnccgtccttcggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagca

SEQ ID NO: 10159 - DNA, 432 bp, Zea mays
  Clone ID: LIB148-011-Q1-E1-B6
aggaagcagttcggccgctcgtccaagaagagcgatgtctggtgcctcggcctgctcatcctcgagatgctcaccgggaagccgccgacctacgacctgcccaaggcggcgggggcggtgccgtcggccgaatcgttgtcgtcaccgcagaagccgggtccggcggcgggcaacggcacggacctggtgaccgtcgtggggtcgacgccggagggcgagtggctggacaccgtggtggacccggacctgaggggcgaggaggaggaggacaaggaggagatggtgaagctgataagggtcggcatggcgtgctgcgagagtaacgtggacagccggtgggagctcaagaccgccatcgacaagatcgaggagctcaatgcgaacgagcgccccgcccccgacgacgagcaggccttctactcgacggtgaac

SEQ ID NO: 10160 - DNA, 419 bp, Zea mays
  Clone ID: LIB148-011-Q1-E1-B7
gttggtcgtgaattggcgccgtctccccctgccagccggattccctgctttgttctcaggcaacattttgttcactagtgtggtagctttgttgattggagtgcgcaatgggaggctgtgcgggaaaggtacgtcgtgatgacgaagaaaagcttgattttaaaggtggaaatgttcatattataacaagcaatgagggctgggaccagaagattgcagaagcaaacagagatgggaaaactgttgttgcaaatttcagcgcttcctggtgtgggccatgccgtgtcattgctcctgtctatgctgaaatgtcaaagacttatcctcaactcatgttcttgacaatagacgttgatgacctgatggacttcagctcttcatgggacatccgtgcaaccccgacattcttcttcctcaag

SEQ ID NO: 10161 - DNA, 312 bp, Zea mays
  Clone ID: LIB148-011-Q1-E1-B9
acccacgcgtccgcccacgcgtccgcccacgcgtccgcgatcgagcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccga

SEQ ID NO: 10162 - DNA, 441 bp, Zea mays
  unsure at all n locations
  Clone ID: LIB148-011-Q1-E1-C1
cccacgcctccgaggagactatacccgttccatcttcacccaagatcaagcgtcaaacatcagggagacctggttcggtggcatccacaaagcctgcagcagctgcatccacaccaaaacctggcggtagcccaaagaaaggtgaggtcaaacctgctgtcgacccagttcaaactccagccacaagtgcagattcaccaaaatccgagcctagtgccccaccactttctgagaccgaagaagtagacaacatggcaatcgatgaggtcagtggtgatgctgcaganggcgcggaagagcttgaccctgcgctcgaggagacgccgatggaggagacgattcgtgtgacgcgcgccaagctaaggaagcgcaacgccaccgaggattctgctgggaattagctgcatgccgttgttttccctgcacattgtattgatcttt

SEQ ID NO: 10163 - DNA, 413 bp, Zea mays
  Clone ID: LIB148-011-Q1-E1-A5
acgcgtccgcgacatccgatttctctccctctccctcccttcccttcctctgcttccggggaggaggagaggaaagagacgaagggcgcgccgggaaggaggaccaggagggggaggcacacaacgcttcctcttgcacgcgggagtcctcaagcctcctccttggccttggctccaattcggggtgccataacacgacctctgccggcggccggccaccggcacccatgtcgcccttctacctcgctcgcggtgcttccaagctagtgagaaggattacctcggagacatcagtcgagctcaagattctctctgaaaaatggcggcttctcctcgctggcgtcatttttcagtacattcatggtttggccgctcatggggttcattatttgcaccggccggggcccaacctt

SEQ ID NO: 10164 - DNA, 71 bp, Zea mays
  Clone ID: LIB148-010-Q1-E1-H1
ttccaaaaccttttcccccccttaaacttttcccttttcctggcaagggaaaaaaactttccccggcaaaa

SEQ ID NO: 10165 - DNA, 364 bp, Zea mays
  unsure at all n locations
  Clone ID: LIB148-010-Q1-E1-H10
acttctggctgttgtacctgatgctcagagtagacgctggctgctgctccgcaaggaaactgactcccccgaccgccgttcatgctcctggctggctggctcgctggccgcctcgacgggaacgctgccgtagaatgacgactggggctggtgttgttgttacagtatggtccttttttctttcttctttcccctttcatccattaagctctgtgatgtagctgcccgtggtgttgattcatgaaatcatgctagagattttttcctggcagtaagtgcgtgcctgtaaaactgtcgaactatttggacgaaagttgtacactgcagtatgatgtaaccatcaaaatctnccctacattcgcct

SEQ ID NO: 10166 - DNA, 443 bp, Zea mays
  Clone ID: LIB148-010-Q1-E1-H12
cgggccgacccaagcgtccactgaccacctcctcttatgccgcgctcaacggcgtcttgtactgcaagatccacttcgcgcagctgttcatggagaaggggagctacaaccacatgaacaagaagagcccgtcccacgaggttctgccggacgtggctgacgaggagcaaccgccggtaccagcgccaccgcaagatgagaaagaagaggacaactaagatcggagcgaccaacaaccacccatgcatatatatcacgcagactgaagtctacacgtttgccatatttctttacgacgacgacgcttctttattccctcctcccttttttttcctcttaatctctctgtgagaccggtttatcatcacgctgcaatcaagtgtgccagatgccttcgttacgtctgaggctcacgacaatggaaaatctgacatggacctgtc

SEQ ID NO: 10167 - DNA, 263 bp, Zea mays
  Clone ID: LIB148-010-Q1-E1-H2
tcactaaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaacaatgtcaccgagttcatcgcgggccccaag

SEQ ID NO: 10168 - DNA, 405 bp, Zea mays
  unsure at all n locations
  Clone ID: LIB148-010-Q1-E1-H3
acccacgcgtccgggaagcccaggcggcctgacatgctcactgacacttttgggtttggccggatcatacatgatggcctcatgttcaagcagaacttctccattaggtcctatgagattggggctgataggacggcatctatagagacaatgatgaaccatttgcaggaaacggcacttaatcatgtgaagaccgctgggctgctaggtgatggattcggctccacaccagagatgagtaaacggaacttattctgggtggttagccagatgcaggctatcgtcgagcgttatccatgctggggtgatactgttgaagtaaatacatgggttagtgctaatggtaaaaatggaatgcgtanggattggcatatacgtgattcctatgacaggcacacaatactg

SEQ ID NO: 10169 - DNA, 291 bp, Zea mays
  Clone ID: LIB148-010-Q1-E1-H4
caacggtcacgtgggctagaccagaacatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtgaacaatggcgagccgcctcagcattgcgcgaccccggtgaccgtgcaggaggcttgccgcggcgcgtccgaaacgcacccc

SEQ ID NO: 10170 - DNA, 410 bp, Zea mays
  Clone ID: LIB148-010-Q1-E1-H5
accaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccacgtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcac

SEQ ID NO: 10171 - DNA, 190 bp, Zea mays
  Clone ID: LIB148-010-Q1-E1-H6
ggttacttcaaggatcacacaaaagccccacagattgtctagactggtcctgctatctcctgcaggttttcatgaggattccaatgtggtattcagtatggtacagaagctcatcttgtttgttggtccagtgcttgcaccacttattcctggactttacataccaactcggttctttatgatgcttctg

SEQ ID NO: 10172 - DNA, 134 bp, Zea mays
  Clone ID: LIB148-010-Q1-E1-H7
agctcagcctcctgcaccaaccgaacctcgacaagctgccgagctagagcatggactctaatgaacggtttcaggacgactagtatatgcccatcggtacgctggaggaccatctcctgtacgtgcccccaatc

SEQ ID NO: 10173 - DNA, 189 bp, Zea mays
  Clone ID: LIB148-010-Q1-E1-H8
gacccaagcgtcaaggttacttcactgctcatacaaaagctccacagattgtcgagactgatcatgctatctcccgaatgttttcatgtcgattccaatgtggtattcagtacggtacataagctcatcttgtatgttggtcaactgcttgcaccacttagtcgtggactttaaatccgaattcggttc

SEQ ID NO: 10174 - DNA, 411 bp, Zea mays
  Clone ID: LIB148-010-Q1-E1-H9
aggcacccggtatccctgctcctcttccttggcggccgagcggggctccctctgacgactccgcgcttcctctggtgcacggccgcttctattgccgtcgcctggggcttctgctgcgttaccatgggccaaacaacgaggaaaatgccgagagagagaggtagagacagtttggtcgtcgagtcacatggagggtgccctggtggccggggaatccttcacctgcggggtgctacatcgccgggctgctgcatcgtggtctgcctctactaccagggctgactccattgccggacagccaaaactctcggtcgagtctctgaaggccgtctgtccctgttccttccggtcaagaacaggtaccacaggatgacgcgcatggaggatgctgtgatgagttcgtgagtggtc

SEQ ID NO: 10175 - DNA, 318 bp, Zea mays
  Clone ID: LIB148-011-Q1-E1-A1
cttcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcacccgcgagggt

SEQ ID NO: 10176 - DNA, 427 bp, Zea mays
  unsure at all n locations
  Clone ID: LIB148-011-Q1-E1-A10
acttcgagaaccccgagaagagcatagactccctccacctcgacggctacgccttcttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggctgccgctgccgccatcctacgcncccgcgcgctaaagacgacgaaggcgccgttttcacctcgtgttctgaccatccagtctaactaa

SEQ ID NO: 10177 - DNA, 349 bp, Zea mays
  Clone ID: LIB148-011-Q1-E1-A11
gccaacccacgcgtccacccacgcgtccgcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccatcaagaggaggaagccgtggagaagac

SEQ ID NO: 10178 - DNA, 190 bp, Zea mays
  Clone ID: LIB148-011-Q1-E1-A2
aatctgagaactttcttattcattctactagtgtggttgttcgttttccgtttcgcctacgctctttctctgtcctctcccggtctccttcccatggcttcttatcggggtctagggggtcctttcttcctagtgtccagggttcttcgcgctcgcctcctctgatcgtcgtcctctttcacgtctccat

SEQ ID NO: 10179 - DNA, 338 bp, Zea mays
  Clone ID: LIB148-011-Q1-E1-A3
cccaggcctacgaacgcgtccaccacgcgtctgcgacatccgatttctcaccctactcatcagaacctagctagctaggcgtagaacgaatgacgaggcagggcggcagcaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaagtggtgtgccggcacttccgcgcgtccaaggagacgctc

SEQ ID NO: 10180 - DNA, 398 bp, Zea mays
  Clone ID: LIB148-010-Q1-E1-G9
cagaactagctagcaattcaaacagcagacaacatgccagtccgacagtcgttgaacatacctggcatggtggtcaatctggacgatcttcctttgactgcagctgagaagaagctaatgcatgcgtataacgagaagcctgtcctttctataccacagcatgagttttacctgggtgataactacttcgagatcgacattgacatgcacagatttagctacatctcaaggaaaggttttgcaacatttttggacaggctaaaagcatgtgttctagatgttgggctaactattcatggaaataaagctgaagaactgccggaacaaatcttatgctgtgttaagttgaatgggatagattacaccaaataccagcctcttttgactcaagctgcctg

SEQ ID NO: 10181 - DNA, 432 bp, Zea mays
  Clone ID: LIB148-011-Q1-E1-A4
ccggcactgggaacgcggtggggaagaaggttgacgccgtcgtccacactctcagctaaccagtgcctgggccgcggttggccacggtgggcgaccctggtggttcaccggtgcactgcgaatctaggcgggtcttcctggggctcgatctgggtctcatggttggctaatttctcaccggagcatttgggggacgggccgtgcgcctccaatttctcgccgtcgacgtgttctccgccgcgggactacagcgtgccatgggcgggactcctgggagcttaatccgcgcgcgaggtcacgagtcacctgaagatcatcctggtacctggaatctcaagtcccaggtcaagagcaggtaccacaggatgaggcgcgtggaggatgctgtgatgagttcgtgagtggtctaggtcgtcgtctcccagtcaactt

SEQ ID NO: 10182 - DNA, 419 bp, Zea mays
  Clone ID: LIB148-010-Q1-E1-F11
gcgggtcgacgcaagcgtccacatcgcgtcgtcttctttctatatacatatatagacctaataagaacaaagacgtacgataacctgcttattttgcgacccatcccgttcccacgcaaaggcgccgagcgtgatctccgtccgtgccgccatggcctcgcaccgggcgctgctgcagcagctcctcgccgccgcgctcgtcgctgcgctggcctcagtcgcatccgccgacgacgccatcgccatgcccaccagcctggctctcgtggagcatagcccgcgggggtcctacgtctgcgacaagccgggctctgaatacaaggccgtcgacgacgaagaggaccccgcccctgtctgagccgtatcgggttcactaggatagatcccagggacgacatccctcctttgactgacgccgc

SEQ ID NO: 10183 - DNA, 231 bp, Zea mays
  Clone ID: LIB148-010-Q1-E1-F12
agatccagcgagcgaacatggcccgtgctctcaccctcagcgtcgtcctcgtcggcatcgcctccgctgtcgtgtccttcgctgcggatgacgcaccggcagcctcaccaaagcattcggcatccacatggtcaaaggcatgcaccacgtcgcgcgacaactccgacaatgtcaccacagggtctttagaggatggtgcagctaccctgacataagattcactgacggagg

SEQ ID NO: 10184 - DNA, 336 bp, Zea mays
  Clone ID: LIB148-010-Q1-E1-F2
aactagcctattggttaaggacttccgagtagcacctccaagtcctgggttcgattcccctcgggagcgaattttcaggcttggttaaaaaaatcccctcccagtattatattgagaagagaccgaaacatggtcccggccgagaaaatcctcgaaccctagccctcaatcactagcaggccatcaccgcccactctgcaacgggccaacggcccagccggagggtggtgtgcaagatgtaatccgggagcggatggggcacaacaagagattttttttaaccaagccagaaattcgcccccaaggggggatcgaaaccgggacctgaaggaactg

SEQ ID NO: 10185 - DNA, 341 bp, Zea mays
  Clone ID: LIB148-010-Q1-E1-F3
acgcacgcgtccagttctagatcgcgaacggccccctttttttttttttttttttttttttttttttttttttttttttttttttttttttttttttttttttttttttttttttttttttgtttttttttttttttttttttttttttttttttttttttttaacccccaaaaaaaagcaattaagccacaaaaataaatgggaaacaaaaaacccatatataaaacacatgaaaaaaatgatggaaaccgttttcaaaacccccacaaaatttgagtttaaaatccaaaaccgtgattcaaaaaaaagggccataaaaaaccggttcacaatgaaggaa

SEQ ID NO: 10186 - DNA, 167 bp, Zea mays
  Clone ID: LIB148-010-Q1-E1-F4
agcttctacgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtc

SEQ ID NO: 10187 - DNA, 403 bp, Zea mays
  Clone ID: LIB148-010-Q1-E1-F5
aaatcatgtctggacgatcgtggacaataatggcgcctcacctggcgtcgatgctgctcgacaggctcgccgtgggctccgaggaggaggaggacggcggcggcaaaaagaagccccacgtcaaccacggcaagtttaaggcggagccgtggacggacgggcacgcgacgtactacggagggcgcgacgggctaactgacaccacggacggcggcgcatgcggctacaacggcgatctggggaaacactacggcaccctgacggcggacgtgggcccgtcgctgtacaccaacggcacctggtgcggcgcgtgctatgagctcaagggccccacgggcaccatggtggtgacggccaacaagcaggcccagccgccggtgagcgggcaaaagggccaacactt

SEQ ID NO: 10188 - DNA, 201 bp, Zea mays
  Clone ID: LIB148-010-Q1-E1-F6
acccacgcgtcaagctagctagcgatggctggagcctgagcactgctcatcgtcctcgcggctgccgtcgcggtcctggccgcgcggccggcgtctgcaggcgggggagccgcggcggtggcggagatctgcatgaagactccgtcccccgacctgtgaaccaggaccgaggggaagcatgccaacaggtacaaggtggtg

SEQ ID NO: 10189 - DNA, 324 bp, Zea mays
  unsure at all n locations
  Clone ID: LIB148-010-Q1-E1-F7
agcgaccgggacgacatactggcagcggtggacgacgccatcggggacggcgtcgacatcctgtcgctgtcgcttggccacgaggatgccatcgacttctcggacgaccccgtctcgctcgccgggtacacggcgatcctcaacggcgtgttcatctgcgccgcggcgggcaacaccggcccgtcncccgcgaccctcgtcaacgaggcgccgtggctgctcaccgtgggcggccaccaccaccgaacaggaggttcttggccttcgtaaagctaggggacacggtccatattgacggcgattccctcaaggaccctaacacaa

SEQ ID NO: 10190 - DNA, 372 bp, Zea mays
  Clone ID: LIB148-010-Q1-E1-F9
ctgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgctatccattggtaacgcacaacagtaaaacgacagacatccgacagct

SEQ ID NO: 10191 - DNA, 326 bp, Zea mays
  Clone ID: LIB148-010-Q1-E1-G1
aaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaagtgacgctggagtgcaagcacttcggcaccgggaagctcgagcgctccatcgacggggtgaccgacgggaacggcacgtacacgatcgaactc

SEQ ID NO: 10192 - DNA, 402 bp, Zea mays
  Clone ID: LIB148-010-Q1-E1-G10
acccacgcgtccgcccacgcgtccgctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcaatgcccttcgcggcggacaaggcaagggaggccacaacccgggtggacaagttcccggcaaggaaccacgagggccggcc

SEQ ID NO: 10193 - DNA, 417 bp, Zea mays
  Clone ID: LIB148-010-Q1-E1-G11
ctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtgga

SEQ ID NO: 10194 - DNA, 379 bp, Zea mays
  Clone ID: LIB148-010-Q1-E1-G12
gacgcaagcctctactgcgcgccgcgtcatctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacagcgacctccccgactacgtcatctatcgccgcgtctattgcgacacctgccgcgccgggttcgtgaccagtgtcaccgagtacatcgcgggcgctaaagtgacgctggagtgcaggcacttctgcaccggcaatctcgagcgctccaacgacggggtgaccgacgggatcggcacgtacacga

SEQ ID NO: 10195 - DNA, 339 bp, Zea mays
  Clone ID: LIB148-010-Q1-E1-G4
gcattctcttcccttccctgagcaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccatagggagaagaaagataagaagaagaagaaggagaagaaccacggcgagggccatgaccatggtgatggtgacggcgg

SEQ ID NO: 10196 - DNA, 398 bp, Zea mays
  Clone ID: LIB148-010-Q1-E1-G5
cgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaag

SEQ ID NO: 10197 - DNA, 200 bp, Zea mays
  Clone ID: LIB148-010-Q1-E1-G6
tccggctcgaccaagcgtcaagtcccatccatgtgcgctgaaacatactcactaacatgtctgtcttcatcgtaaggatgtagcagtgcctccacagcttcggccacaacatcgatgcgcagcagcacacgaaaggctatgtacagcacgagacgggctaggagcagctcatgatggaccattgggaccacatggagggc

SEQ ID NO: 10198 - DNA, 402 bp, Zea mays
  Clone ID: LIB148-010-Q1-E1-G7
cggacgcgtgggctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgactggatttggtgtttctgggggaagtacgcttatccatgagttctattcaagggaagtacaaagccccatccatcttacagtcgacaccggcttcactaggggggaagcttccatcaaagcct

SEQ ID NO: 10199 - DNA, 420 bp, Zea mays
  Clone ID: LIB148-010-Q1-E1-F10
tgctcgactaagttaagaaacttcataaagaaaagcagctacctttctttggtggacaaaggcctgggtagcaactaggacagggttgagtcagtaccacttgtctcactggcctagaatgttcgaggtgatcaggtggaaggagacgggctcacacagagatgggaggtgtcgtagaacgtagacacgccagagttcctctcatcggagctcctacttcaaaagtacatggattttgcagcggacgaatgctcgcttggtgtagaagccatggagctctttggaccaaggtgacaaggtgaccatctgatcgaccggatcggccatcacacaggtcgcataggtgtattgccatatcaagcctatattattgttgtattacattggacgcatagggaagggaaaaatccagtggattgt

SEQ ID NO: 10200 - DNA, 335 bp, Zea mays
  Clone ID: LIB148-010-Q1-E1-G8
gacaaaacatggctgtgaatgtgagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaataccatgggcgcatgcggcaacatccccatcttcaaggatggtcggggttgtgggtcctgcttcaaaatcaagtgc

SEQ ID NO: 10201 - DNA, 410 bp, Zea mays
  Clone ID: LIB148-010-Q1-E1-D12
acccacgcgtccgggaaactcatatgcagatgcaattcatgaggcttttcatccaaaagatcacccaaaacccaaaccagattcaacgatggaatataggacgacatttataagagctaagtatgagacacaagattttttgaacccatctttgcgcatatcatcaagatcatcttttacagcgaccagttctgtgaagagtgtagatagcactttctcgaacacttcaacgaaggatatctctgaagatacaggagaacttgttggagagctgaatattagagtcgtgataggtactaacttggtcgttagagacatgctaacaagtgatccataagtcgttttaacactcggacggcagacagctcaatcgacagttaataaacgtgatcgtaatccggtacggaatg

SEQ ID NO: 10202 - DNA, 310 bp, Zea mays
  Clone ID: LIB148-010-Q1-E1-D4
agctcggatctcgcatcgatgaagaacgtatcaaaatgcgatacctggtgtgaattgcagaatcccgcgaaccatcgagtttttgaacgcaagttgcgcccgaagccttctggcggagggcatgtctgcctgggcctgtaacctgttaatggatcggattctcggtgccaattcgtgatcttgaccggtctaagaagatggggacttgcgtctttgtttcattggttattatttctactagtgtgtatatggtaaagtcgtgtgctgtgaacctgctatcaaaaaaaaaaaaaaagaagggaaccacccg

SEQ ID NO: 10203 - DNA, 272 bp, Zea mays
  Clone ID: LIB148-010-Q1-E1-D5
acccaggcgtccgcggacgcgtgggcggacgcgtgggcaggaaggcaggccgggtgtcgtgcctcccttgcgcgcgctctcacgacccagcccgtcgtgcgtcatcgagctccggcgggcgggccatgcacgcgtccagctagctcacacagcgccgtcgcgaccggctgccggtgctccacccggcccgcgtccacatcacggcgggcgggcgcgcgcggtgaacggtttcctccgcgcatgagcctgtgagggtcggtgggttcctgcgg

SEQ ID NO: 10204 - DNA, 128 bp, Zea mays
  Clone ID: LIB148-010-Q1-E1-D6
aggagatcgccgaggtgtacattgagtcgctgccaatgaaagggaagacgagcctaggcgacgccatctaccgtatcatcaccgaagacacgttcgaccccgtggagttcttggacgggatggacctt

SEQ ID NO: 10205 - DNA, 406 bp, Zea mays
  Clone ID: LIB148-010-Q1-E1-D7
ggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcatctgcacgaggtgatggccagcaagagcaagatatacttcgccatggagtacgtccggggcggcgagctcttcgcccgcgt

SEQ ID NO: 10206 - DNA, 206 bp, Zea mays
  Clone ID: LIB148-010-Q1-E1-D8
tactccccttcgcctgttcctcgaccacctcaacgagcttctgctccgacgacgacgacgcgccgccacagccacatggcggacgacgccgtcgccgccggagcggccgtttgctgcgcatggccgggctcgctgtcttctagcaggaatcagtatcagcagcccgacgacgccggctggcggagcagcagcatcgacgatcacta

SEQ ID NO: 10207 - DNA, 423 bp, Zea mays
  Clone ID: LIB148-010-Q1-E1-D9
cgggccgatgcgagcctccagccggtctcgcgtccgcccacgcgtccgcgcgagcagccaacgatccctcgatgggcgccatggctcgttccgtctccctcgtcgtggcgccgcctctcctcgtctctgtcctcgtctcagccgctgccagtgcgcggaccgtgggggacaccgtgcaggacgcgtgcagcaatcacccagttccccaagatgtgcgtggacagcctcgccgccaagccggagaggcacacggcgacgccgcgcacgctggcggcgctgttcgtggcgatcccggccgagaagggatgcgggatggggatcttcgtgcaccggcacgtgcagcgacagggaggacagggacatagtcaggtgccacgacagcggcgcctgacacgtggaggaggccgtcggccaggtgagcgg

SEQ ID NO: 10208 - DNA, 405 bp, Zea mays
  Clone ID: LIB148-010-Q1-E1-E1
cggacgcgtgggcggacgcgtgggttcagctacagggagggtgaccctaccggccctacaaaatgggccacattgcagaaggactgggatgtctgtgacagcggcaccgagcagtccccgatcgacgtcgcgaaggtggaggtctctgaggatttagacccgctgcagcagacctacgaggctggcgacgccgtcatgcacaaccggctccacgatttcatgctgaactggacaggagggaacggcggcctgacaatcgaagggaagaagtacaagctgaagcaggtgcactggcacgctccctctgagcacaccgtcaacggcacccgctttgacgcggagatgcacatggtccacgaggactccaccgacgccaagtcgaaagccgtcgtcgcggtgctgttc

SEQ ID NO: 10209 - DNA, 416 bp, Zea mays
  Clone ID: LIB148-010-Q1-E1-E10
agcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgct

SEQ ID NO: 10210 - DNA, 410 bp, Zea mays
  Clone ID: LIB148-010-Q1-E1-E11
acctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaaga

SEQ ID NO: 10211 - DNA, 421 bp, Zea mays
  Clone ID: LIB148-010-Q1-E1-E12
ctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcgtccctg

SEQ ID NO: 10212 - DNA, 373 bp, Zea mays
  Clone ID: LIB148-010-Q1-E1-E2
gcttcggtagggcaaaatactttctttgacgttttaaaatatgttgctgcccattccccttctcggaaatcaaggctgcaccctcatcaggaaccacagcagcagcaaccacatgtgcatgtggagctgcatcagcaaccacaagtgcaggtggagctgcagcagccgcaaccacatcaacaagcatcacctgttatgcgcagaggagcatctattgctgctcggcaagcagaaatggcacagcaatctctggagactatacccgttccatcttcacccaagatcaagcgtcaaacatcagggagacctggttcggtggcatccacaaagcctgcagcagctgcatccacaccaaaacctggcggtagcccaa

SEQ ID NO: 10213 - DNA, 327 bp, Zea mays
  Clone ID: LIB148-010-Q1-E1-E4
agcaaaacatggctgtgaatgtgagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtcggggttgtgggtcctgcttcaaaa

SEQ ID NO: 10214 - DNA, 251 bp, Zea mays
  Clone ID: LIB148-010-Q1-E1-E6
aaacaagcagcacctgttatgcgcagaggagcatctattgctgctcggcaagcagcaatggcacagcaatctctggagactatacccgttccatcttcacccaagattaagcgtcaaacatcagggagacctggttcggtggcatccacaaagcctgcagcagctgcatccacaccaaaacctggcggtaccccaaagaaaggtgaggtcaaacctgctgtcgacccagttcaaactcaagccacaagtgc

SEQ ID NO: 10215 - DNA, 356 bp, Zea mays
  unsure at all n locations
  Clone ID: LIB148-010-Q1-E1-E8
cgcgcttggatccccttccatccttgacgccattggcccttccatccttggtgccctccgtccaacggcagcgatcccattccattggccagccatctccgcctcccttccacaagaacacctacgcgcctcccttccatccaccatcttcacgcttggatccccttcgaggcattagagcttgccatctaccttaggtctacaacangcacagattacagcangcccaccatctatttaagaaatcctccttgtgtaacacccgtgggaattccacaggcaaggccgccacccgcccactccaacctcatgcacaggcaaccgtgaagcatccacaagcaacagttaaacgtaat

SEQ ID NO: 10216 - DNA, 425 bp, Zea mays
  Clone ID: LIB148-010-Q1-E1-E9
acccacgcgtccggccctttccccacctcgatctcgcgctaggttttcgccacaccgctctcgtcctccgcgaagatgccgaagaacaagggtaagggaggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgtcgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttcccgaaacgctcaagctcaacga

SEQ ID NO: 10217 - DNA, 403 bp, Zea mays
  Clone ID: LIB148-010-Q1-E1-F1
agtctaagcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgtctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaagtgctacaacctgttcaagagcaactgccaagac

SEQ ID NO: 10218 - DNA, 416 bp, Zea mays
  Clone ID: LIB148-010-Q1-E1-D11
ctagcgttgtgctattttgcagtttctcataatgaagctgcattaaacttgttgaggaaatctttgaataagaatgagagtccaaatgacataatggccctcctgttagctgctaagatatgtagttccaataatcttctttcttctgagggtgtagagtatgcaaagagagcagtcagagatgccgaatcatcagatgggcatttaaagagtgtggccctccatgttctggggagttgcctgtccaggaagtctaaggttgcttcatctgatcaccaaaggtctgtcttgcaggctgaggctttgaagtcactcaatgaggcaatttctcttgaccgtcacaacccagaattattatttgaattggggatagagtatgctgagcagcggaatatgcatgctgccttgaaatgtgc

SEQ ID NO: 10219 - DNA, 415 bp, Zea mays
  Clone ID: LIB148-010-Q1-E1-B12
acaaaatagtggtagcgctacaagtttaagttcttctaccggacttatggggccatgtttctccatgaatggggtttctggatcagcaactatggtgcctaaagttgatgctgctacaagttcagctatagctgcgcccttggtagcttcagatgttaaaccctctcagccggtcagtaattcagctaccaagatgattatgtcaagcaaatccactgctaaggaatttaaactcaatccttgtgcaagggttttctctccatcttttgcaagttctaggcaagtacttgcagctatggcccctgttgacacatactacatttcacactctgcccctgaagtaccaatgggcgtacctgtatatgagtcaaagtctgtgcctggcgtttcacctctaaccaacaaggttcattgt

SEQ ID NO: 10220 - DNA, 389 bp, Zea mays
  Clone ID: LIB148-010-Q1-E1-B2
tgcgtgcgttcgtccatccacagacaggcgtccgggcacaatgtctttcaccggaacgcaggacaattgcagggcgtgcgacaagaccgtccacttcatcgacctcctcacggctgacagtgccatctaccacaagacatgcttcatgtgcagccactgcacatgggtcctcgcgatgtgcagctactcctccatggacgcgtgtgcctgtactgcatgagccacatcgagcagctcttcaaggagatcgggagcttctcacatgaacttcacgccacgtggcacgtcatcagacaatggtgaactgacaagggcgtcaagcaagctgtcgtctgcattttctggtagccaggataagtgcgcagcatgccagaaaacagtgtacccgc

SEQ ID NO: 10221 - DNA, 267 bp, Zea mays
  Clone ID: LIB148-010-Q1-E1-B4
ccacacgtcggcccacgcgtccgattaggtccaaaatgacccttgccaccaccattagcagcagccggggtgtgacgctggtactgctcggtctccgcctgcggcttctggttggtgttgcgcaggcggtattggagttggtgcctgctgatgatattatcgccgccgcagctgctggaacggcggtggacgatggcgagccgcctcagcagtgcgcgaccccggtgaacgttgaggatgcgtgccgcggcgcgttcgagacgcacg

SEQ ID NO: 10222 - DNA, 72 bp, Zea mays
  Clone ID: LIB148-010-Q1-E1-B5
acacgcctctgcactgattcgtaatacaagatcgtctgtgaatgtgagaaccatgtggtcgtccactccggc

SEQ ID NO: 10223 - DNA, 325 bp, Zea mays
  Clone ID: LIB148-010-Q1-E1-B6
aggctcatctcccacctctggcgatggtcgtcgcctgatcagctccaccaaccaagatgaacttggatcgttatgccaacagatgcactacaagacgttgtgctccacgatgacgacactgcctggggtgactacgccagagcaactcttagatgcatccctgcggattacagcggtgaaggcagcgatggcggagatgaagctagactatgcaataaaatcatgcagtgctcagggtaacccgatgatgtcgtcgctaaagacatgcaaggagagctacgcgtcgctggtatactccatcaataacacgcggaacacgctcaaa

SEQ ID NO: 10224 - DNA, 248 bp, Zea mays
  Clone ID: LIB148-010-Q1-E1-B8
aaaatcagacaagaaagagattgagaagcagggagaaaaaatggcactggcccattgaggaagcttgagaaccagttaacaagaattgccaacatattcttggacaatcttgttaacagagttttaaggtttcccagcagaaaattttccaatccaagaagaaggccttgaaacaacaaaatcaaaatattaattagcaagggttaaagaaaaaggaacattggcaaaagtattgagaaagggattct

SEQ ID NO: 10225 - DNA, 420 bp, Zea mays
  Clone ID: LIB148-010-Q1-E1-B9
acccacgcgtccgggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtatgactgcaagatccttcccaactcgctggtgatggacttcgtgaacaacggggaggtgtccggggtcacgctgctcaactccaagttcttccacatgaacatgtaccagtgcaagaacatgctgatcaaggacgtgaccgtgacggcgcccggggacagccccaacacggatggcatccacatgggcgactcatccgggatcaccatcaccaacaa

SEQ ID NO: 10226 - DNA, 198 bp, Zea mays
  Clone ID: LIB148-010-Q1-E1-C1
agcagacggggaagctgggcgtcaagtcggacatctactcgctcggcgtgctcctgctgcaggtggtcaccgcgcggccacccatggggctcacgcaccacgtcgagaaggccatcgacgcgggcaccttcgcgcagatgctcgacatcaccgtcaaggactggcccgtcgaggaggcgctcggctacgcaaagctcg

SEQ ID NO: 10227 - DNA, 413 bp, Zea mays
  Clone ID: LIB148-010-Q1-E1-C10
acccacgcgtccgcaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcatgaaggtctatggcatgacgctcatgctcatggtcctctgttccgtcgcgt

SEQ ID NO: 10228 - DNA, 424 bp, Zea mays
  Clone ID: LIB148-010-Q1-E1-C11
aggcggcggcatcggcgccggcgacgcgctgcggcggacgcttgcgcagcgcaagccgaccaaccggtacatcagctacgcggcgctgcgcgcggaccaggtgccgtgcaacaagcgcggccggtcctactacaccaactgcgcggcgcagacggccgccaacccctaccgccgcggctgctccgccatcacgcgctgcgcccgcagcatgaactgagcgccaaggcggcggccggcggtctgatctgcctgctggctggctgggcagggggcacgcagctggcctggctcgatcgcacaccatgcattgacgtcgtcgcggccggccgccatgccgttggacggtggggtcggacgatgaccgaggatgaagcggcggcgcgacgatagtatatacaaacaccaatgaccaaccatactacca

SEQ ID NO: 10229 - DNA, 424 bp, Zea mays
  Clone ID: LIB148-010-Q1-E1-C12
agttcgctcttcctggtccaagtgatcttgccaagttacgagcagcaagcagagatcagatcatccatcggcaatgtcgaacatcgggcagtccttccaggccggcaaggcggaggcccagggcgagtaccaggcggagcacgcggcgcagtgcgtcaaggacaccgccggagccgcggccgacagcgcgcagctgcagcagcaccgcgccaccggcaccgttgagcaggtggcgcagacgggccagggcgtggcggcaggcgtcaaggacacggtggcgggcgcggcggttggcgtcaccaacacggtggcgggcgtggcggcgggcgtcacgaacacggtgaccggcgcggtggcgggcgtcacgaacacggtgaccggcgcggccgcgggtgtcaaggacaccgtgaccggcggccactga

SEQ ID NO: 10230 - DNA, 154 bp, Zea mays
  Clone ID: LIB148-010-Q1-E1-C2
acccacgagtccgttactaatcaaattcttgttgggatatattcctccaattcccctcctcctcccaacaaggcaacaacaatctgttccggccgccaaacagaacccaaaaaaaaaaacacactgaacccaataatccgatcccaagaaaact

SEQ ID NO: 10231 - DNA, 181 bp, Zea mays
  Clone ID: LIB148-010-Q1-E1-C4
aaaaatctgccttcttcggaattgccctgaaccagatgggattggcatgcgttcaaagatattcgataaatgaagcagcagaactgtttgaggaagctagaacagttctggaacaagaatacgggccttatcatccagatactttaggagtgtacagtaatcttgctggaacttatgatgc

SEQ ID NO: 10232 - DNA, 185 bp, Zea mays
  Clone ID: LIB148-010-Q1-E1-C6
acccacgcgtccgatcgtcgactgctgctgcgttctgttccgtttcggaaaatgtccttggaaaccttccggttgaaaaccccccggttaaattacggcaacggcaagatcaattcggattaccgctacgacacaaccgaactcttccccccggagaatggcggcggcgcggtgtgtgtggtgcc

SEQ ID NO: 10233 - DNA, 410 bp, Zea mays
  Clone ID: LIB148-010-Q1-E1-C8
agctgtgccacgagaacggagtgatgcacagggacctgaagccggagaacttcctgttcgtgaacaagtcggaggagtcacctctcaaggccatcgacttcggcctctccgtgttcttcaagcctggagatcggttcaccgaagtggttggcagcgggtgttacatggctccagaggttctcaagagaagctatgggccagagatagacgtgtggagcgctggtgtcatcctgcacatccttctctgcgggttccctccgttttggggaggctccgatgagaaaattgcacagtcgatactccgtggggtaattaacttacagaaggatccatggcccaaggtctcccagagcgcaaaggatcttgtcacgaggatgcttgacccagatccttgtacacggttgacggca

SEQ ID NO: 10234 - DNA, 416 bp, Zea mays
  Clone ID: LIB148-010-Q1-E1-C9
cggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctaggggagccaggcgagagctacgacgccttcacggactgcttccccgccaacgagtgccgctacgccgtgttcgattttgacttcgtcactgacgagaactgccagaagagcaagatcttctttatctcttgggccccggatacatcgagggtgataagcaagatgctgtacgcgagctcca

SEQ ID NO: 10235 - DNA, 338 bp, Zea mays
  Clone ID: LIB148-010-Q1-E1-D1
atttgtgtcacaatgcaaggccgctgatgctttgccatgtggtgaagtttcagacagatcgattcagctagcttctttccatgattccatccacggagctcagctagctcggcatggacttcagccctcaaagaaagagcgccgaacgcaaccgcggcagcttcgaacacgatgacagtgatgatgacatcagagctgaatccaacgcctctaataagccatctgcgcattcgcacgacagcaccaaatccaagcccaagacgagccatggcggttcaacccgaagtatctccgaaccgacagcgggcaacaataatgctgacgccaccaacttggac

SEQ ID NO: 10236 - DNA, 419 bp, Zea mays
  Clone ID: LIB148-010-Q1-E1-B11
cgttgcggtcgtccacatccttttctctcctcctcgccggcccaacctgattgttcttcaaccaagaggaagaaaggaaggaagggaccggtagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctgggggggccaggagagagctacgacgccttcacggcctgcttccccgccaacgagtgccgctacgccgtgttcgattttgacttcgtcactgacgagaactgccagtagagcaagatcgtcattatctcttgggccccggatacatcgacggtgagaagcaagatgctgtacgcgagctc

SEQ ID NO: 10237 - DNA, 404 bp, Zea mays
  Clone ID: LIB148-010-Q1-E1-D10
atccatcaacgaaacaggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcaccacctataagaccacactcag

SEQ ID NO: 10238 - DNA, 267 bp, Zea mays
  Clone ID: LIB148-009-Q1-E1-H4
agtggccatgtagatgatgggtgcccaggcatcacattccacattgctgataatcctgcatcaacagcttggaccacatgactagcttttcggtggtgggaatgacctctactgcctgcgattctatgttggggtacctcacttgcgtgatggtgaaggtcttgtggctctcgaagatgctctcgtttccagcactttgcctcacggccacttgcgtgctcaaggcactcagtcgctctgcctcagctgtccagtccaccgtgatat

SEQ ID NO: 10239 - DNA, 390 bp, Zea mays
  Clone ID: LIB148-009-Q1-E1-H5
gtcgaggggccgcgtcacgacgtcaaagttcgaggccgcctgcggcgggcccgtgcgcgatggctcttgcagctgcagcttcctccaacgcaaatatcatggagcatcatccatagcaccatctccttggccgtgacgcccgtgatcgtcctgatctgtgccgtgtcttcccgaccgcagacacctcggcgccgtacatgacatgcctgccgggcttgcagaactattcgtcaacgttgcggggctgccctgagcacacaagagctctctctccgacggtaacgcactcgattatgtcacgcagccggagcaggcagctgggacatgcacgtctcctgcaggagccgcattttcgcctggcccgccgtatcacccaccttgacctccgcc

SEQ ID NO: 10240 - DNA, 428 bp, Zea mays
  Clone ID: LIB148-009-Q1-E1-H6
gaataactctctctcccgtcgccgggatcccgccggtgacaatggtgaggtggctgccgccgccgccgccagcggacggcgagatacccttcggacacgacgccgtcgccttgtccttcttcgtggcgtgtgtggccgccaccgtcgcgctcgcgtcgtccatgtgctcggcatgcggtcgcaagccgaaggcggccacccgtgcagacccggccgcttcggaccagtccaccgggacgggctcgggctccgtctccggcggcggcggaagccaggaggctagcgccgcggaggcggaggaggaagtggtgagactgtcaccggagctggcgatgcacggcgccatcgacccggtgacgctgccgtcgtcgacgtcgaagcggcgcctgtccatcagcgtgagcaagaagctgagcatgaacatcccg

SEQ ID NO: 10241 - DNA, 295 bp, Zea mays
  Clone ID: LIB148-009-Q1-E1-H7
tctcctatcccgtcgcccggatccggcgcgccgccctcctcagcgttgctacagccacctcaacatcagggagcacagatcctgtatcgacgtggccggcgtcaccgtggcggtctgcgccgctgttttctgctgcatcgtctgcgtcacggcggacgtctccgtgctctccacgtgtgcacgcgcacgctgcgatgtgctgcaaggccgcccgcttgcgcacagtccacaggcactctgcctcggtcggtcacgggagggggatatagtaactcgtctaggaccacacaggcgt

SEQ ID NO: 10242 - DNA, 332 bp, Zea mays
  Clone ID: LIB148-009-Q1-E1-H8
ggccgacgaccgcgtcgagccacaatgcgccggtccccctcccccgccaccgtggcggccctctcggcgcgcgccgcggggcaccggccgccggcgggcggcgccctgaacccggacttcaatacccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactccctccccggggacgc

SEQ ID NO: 10243 - DNA, 120 bp, Zea mays
  Clone ID: LIB148-009-Q1-E1-H9
ctaaaccacaaatcctcttcacctggattacaaatatgtaactgagaaaggaaaggaaaacaaaaatgtaactgcgtggctgtaccaaattctgagtgctggattcttgctattgtcacc

SEQ ID NO: 10244 - DNA, 171 bp, Zea mays
  Clone ID: LIB148-010-Q1-E1-A1
agggatgctcttgtcatccacgatggcactcatgcatgcgcgggcgcccatctgcatcaagttcatgtctcgtaccgataatgtaaagctacatgccttcttagctacactgcctgtgacatagctccgtgcatgtatgcaatgtatcataggagggaacccattccgtat

SEQ ID NO: 10245 - DNA, 408 bp, Zea mays
  Clone ID: LIB148-010-Q1-E1-A10
agcctgcgcaaactgtacagccgcgtctgatgttgctctggacatgagagcacccccttttcagcagctatcggcagggcagagaagtgactcttgtgataggctgacagcagagacaaacttgtacacgagatcaaccaacggcatcgctgccactgcagcacgagtggcagcaactactcacataaatgtcggcgttgttccgtttggcatgtcaaacatgtattagggactggatcatggacgagtcatggtgaatcctctgtgcggttgatgggtctatgctgccttcaagtggcgatacaccgacaacttgaagcggccactcaaacctttggatggatgctgcaagtttagagtgcagtagacagtgttttttctgtgtggtcatgaagagacgaacaccgc

SEQ ID NO: 10246 - DNA, 413 bp, Zea mays
  Clone ID: LIB148-010-Q1-E1-A11
agtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatctcacgagacacctacaactccat

SEQ ID NO: 10247 - DNA, 422 bp, Zea mays
  Clone ID: LIB148-010-Q1-E1-A12
agccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgttggcatctccgacagcctgcgccccgccaacccgctaggctactttcaagacgtgccgctcc

SEQ ID NO: 10248 - DNA, 182 bp, Zea mays
  Clone ID: LIB148-010-Q1-E1-A2
taacctcgtcgcctcctccattgaccatcaattaaccctccccgatcgccatatctatcatgtgcagtcatgggtgtctgtgcatcgatgcctactacgcttgacgggatatcaccaactgacgctaccatctccacacgtaacgttggacctaacaccatctagtatccacattgaggttg

SEQ ID NO: 10249 - DNA, 389 bp, Zea mays
  Clone ID: LIB148-010-Q1-E1-A3
agttcctctggtcttctctgcctgcctgagctcaccgcacctcgcctcctcagcgcgtttcctccgttaatccggtagaaaatggccgatgccgaggatatccaacccctcgtctgccacaacgggactggcatggtcaaaggtgggttccctggcgaacacaccccgatggccgttttccccaacatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaagagca

SEQ ID NO: 10250 - DNA, 138 bp, Zea mays
  Clone ID: LIB148-010-Q1-E1-A4
agggcatgcaaggtcacgacgatgcccgttttcatccgggataccgcataggctgtcgcccatgggcaccatagccaggacctcggctcacaaaaaggtcctccgattctcaaaggccgttttgctcggcatcacgta

SEQ ID NO: 10251 - DNA, 392 bp, Zea mays
  Clone ID: LIB148-010-Q1-E1-A6
ctccccccagcggcgaggagagccggcggccacaggaaggagaaatggcttccgcacacaacgctctccgggtgtttttcatcctagccgtggtaagttgcctatgcacaagcaaaaggacaagagccaacaaggaaaaatccgcggcaacccccggtggcgctgctggaggcagcggcgggacgttcgacatctccaagctcggcgcgaccagcgacggcaagacggactgcacaaaggcagtccaggacgccttgacgtcaacgtgcgaagcgaccggaagcgccacggtggtgatccccaagggcgactacctggtcggccctctcaacttcactgggccatgcaaggggagcaacatcgccatccagctggaatggaacctgctggga

SEQ ID NO: 10252 - DNA, 63 bp, Zea mays
  Clone ID: LIB148-010-Q1-E1-A7
ccctcaagtaccccatcgagcacgggatcctcagcaactgggacgacatggagaagatctggc

SEQ ID NO: 10253 - DNA, 349 bp, Zea mays
  Clone ID: LIB148-010-Q1-E1-A8
aggtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatcgggcaacaagacaatggcggtcggaagaaacgcaaccggaagttcaaccggtttggaaagggactcccctgcatccgaaccaatttactaacatgcataaattaaatatataatcactcctcgtaacctctctccttctcacgtactctcaagttcccaacgaatatataatccgctgggttgtatttt

SEQ ID NO: 10254 - DNA, 441 bp, Zea mays
  Clone ID: LIB148-010-Q1-E1-A9
gggccgacccaagcgtccacgccaacgccgatcgccacgccggaaacatactcgtccgcaagcacgacggcggcggaggcggaggcatgtcgctggttcccatcgaccatggatactgtctgccggagagcttcgaggactgcactttcgagtggctctactggcctcagtgccgggagcccttcagcgacgagacggtggagtacgtgcggtccctggacgcggaggaggacgtgactatgctgaggctccacgggtgggaggtgtcgcgcgagtgcgcgcgcacgctgcgcgtcgccaccatgctgctgaagaagggtgtggagaggggcctcaccgccttccacatcgggagcatcatgtgcagagagaccctgaccaaggagtccgccatcgaagagatcgtccgtgaggcggcggaacggggaggaggatgcgaga

SEQ ID NO: 10255 - DNA, 338 bp, Zea mays
  unsure at all n locations
  Clone ID: LIB148-010-Q1-E1-B1
acccacgcgaccgcctcgatccgcagcgaggcccttgtgcaggcaagcggcggcgtccccgaagccccgaggaggcggcacttccaaggccggcgagcaagcgacgcccgtcgacgtgcgagtagcgacggcgacgcatgaggcgcgatgttcgatcgagcgacgtcacggaacgggcgacatgcncgcagcgatgatcgcgcgtgacatcctctgatccggcgcatttttcttttcgtttattatgttttatgcctaacacatgtattatttacgctaaaaactgtacgtttttatgctttaacacagagttcgtatatcagtttacggcatgcaca

SEQ ID NO: 10256 - DNA, 426 bp, Zea mays
  Clone ID: LIB148-010-Q1-E1-B10
agtgcgcagcatctacaccgtgggcaaggagctcggacgtggccagttcggcgtcaccagcctgtgcacgcacaaggccaccggggagcgcttcgcgtgcaagaccatcgccaagcggaagctgtccaccaaggaagacgtagaggacgtgcggcgcgaggtgcagatcatgtaccacctggccgggcagcccaacatcgtggagctcaagggcgcctacgaggacaagcagtcggtgcacctcgtcatggagctctgcgccggcggggagctcttcgaccgcatcatcgccaagggcaagtacacggagcgcgccgccgcgtccctgctccgcaccatcgtggagatcgtgcacacctgccactccatgggcgtcatccaccgcgacctcaagcccgagaacttcctcctcctcagcaaggacga

SEQ ID NO: 10257 - DNA, 373 bp, Zea mays
  Clone ID: LIB148-009-Q1-E1-H3
agttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgcaggcgctctgcctccgcgggccaggccacggagatatacgagctcctcgtggacgacaccggcgtcgtcgaggtggatgccggcgccgccaatgcggtggcgctgcccgtgaagcccgccttgcagctggagggaaaagggga

SEQ ID NO: 10258 - DNA, 411 bp, Zea mays
  Clone ID: LIB148-009-Q1-E1-F9
acagaacgatcctgtttgtgattcattattctagactgtttgctaaaggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagccacgtgtgctggaggaacggcaagttcgcgcaggacatgatcctccggctcaggaacgtcgagagcggggagatacagctgcagctgcagtgggtgaacttccctcctggtcctgctcctgctgctgcaacaaccaggtgacctgatgatcgatggtagctgctgttcctgtcgccattgcctcctgct

SEQ ID NO: 10259 - DNA, 435 bp, Zea mays
  Clone ID: LIB148-009-Q1-E1-G1
acacggggtggtacaagggcatcgcccgggagttcgtggacgcccacaacgagctccgcgcgcgctacggcgtgccgcccatgaagtgggacaggaagctggcgcggcaggcgcggcgctggtccaaccgcatgcgcaaggactgcgagctcgtccacagcggccacaagtacggcgagagcctgttcaggagccacgacgactggaacgccaccgccaaggaggccgtcttctggtggggcaaggaggagtccatctacgacaggaacacggagcagtgcacaggcggcagggcgtacaaggagtgcggccacttcgcgctcatggtcggcaagaggagcaccaaggtgggatgcgcacgagcagagtgcttcaagggaggcgtcttcatcacatgcaactactatgccacggacctcaagaagaagaacaaga

SEQ ID NO: 10260 - DNA, 417 bp, Zea mays
  Clone ID: LIB148-009-Q1-E1-G10
ccccatcgtcaccctcgaggccgatggctcatctcccacctctggcgatggtcgtcgcctgatcagctccaccaaccaagatgaacttggagcgttatgccaacagatgcactagaagacgttgtgctccacgatgacgacactgcctggggtgactacgccagagcaactcttagatgcatccctgcggattacagcggtgaaggcagcgatggcggagatgaagctagacaatgcaataaaatcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcgg

SEQ ID NO: 10261 - DNA, 418 bp, Zea mays
  unsure at all n locations
  Clone ID: LIB148-009-Q1-E1-G11
gtccggcgacttgtacggcttcggcgtggtgctgctggaaatgctggtgggacggcgcgcgctggagccgagccgggcggggggccgcgacggcagcctggtggactgggcgcggcccatccttatccggcccaaaaagttggagcggatcctggaccggcggatgggcgaggtctgctcggagatgggcctgcagcgcgtggcccgcctcgcgtacgactgcctcagccagaaccccaaggtccggccctccatggccagggtcgtcaccacgctcgaggcagtcctcgccgccggtgccggtgccgccgacgccccgccgcggtgagaccggaggttgatgtangtagtanggtcggcatacggattaattaggtgcgtacgggtatatgcttgggcggaggaggcatgtttaatt

SEQ ID NO: 10262 - DNA, 403 bp, Zea mays
  unsure at all n locations
  Clone ID: LIB148-009-Q1-E1-G12
gaccgacccgtccaattcataaaattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacatattggttgggatggtcctggctccacgaacaacaacaacaataacaacagcaacaacaatagtggcggagcacctagctggatgaaggattaccactcggcaccgcttgactcgtcctcttttaggagtgagagtgggggcacggctgctgcaaatcnctgngcttctcaagagatagtcatggatggagcaagcgtcggagaaacctccttcaaggacacgaaaagcg

SEQ ID NO: 10263 - DNA, 437 bp, Zea mays
  Clone ID: LIB148-009-Q1-E1-G3
agccttaccctcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcaaggcgatgttcctgtccttcggccggagcgacgacagcatgaagaagacagacgacgacaccacgagccccaagaagagagccatcgcgg

SEQ ID NO: 10264 - DNA, 98 bp, Zea mays
  Clone ID: LIB148-009-Q1-E1-G4
gacccaaacgtccagccttggtctcgtgcccgaaggacgcctgccttcggttcctcactggcatggatgaattagtcgtttcggcgacgatcactgcc

SEQ ID NO: 10265 - DNA, 332 bp, Zea mays
  Clone ID: LIB148-009-Q1-E1-G5
aacagaactagctagccagccagccagcaggccagcttgctcgccgcgcccgtccttcgtccgcgcctccgttccgttccgttctgtctcgcgcgccgccgccgccgcattcagggatggagatggacaacatcaccggcaccgtcatcgtcgcagcctcggtagacaacatggagctcgcagcggaggctcccgcaccaggacctaggacgcgctcatccacgatcacgcctggcgtagtgtccgccatccgagcagcgatcatcgccatcgtctgataatagaatgagtgagtcgggtgtcgtcgattaccccgtcgactcggaagaaac

SEQ ID NO: 10266 - DNA, 144 bp, Zea mays
  Clone ID: LIB148-009-Q1-E1-G6
cagccagcaggcagcttgctcgccgcgcccgtccttcttcctcgcctccgttccgttccgttccgtcacgcccaccgccgccgccgcattcagggagggcaatgcagcagatcgcctgcgccgtccacgacaccgcctcagcgg

SEQ ID NO: 10267 - DNA, 321 bp, Zea mays
  Clone ID: LIB148-009-Q1-E1-G7
agcatgacgctgcgcgttgcgtgccgccgcggcttcgccgaccagcacgctaagatcgactcgatcatggacctgtgggacaacgtgttcgacacgcactgccggttcgacgtgcacgtcatgctggtgctcatccaggtcagcatctgcgtcagctaccgcatctgcatctccatcatcatggcgcacatcaatccgcatgccgcgtcgtctgcctccgcgctcttctccgcgatcgtgctcgtcatcggggtcatgatgcctttcaagctggggctcaactcgatgatcacgctgacgctgctcgcgccgctcagcatc

SEQ ID NO: 10268 - DNA, 429 bp, Zea mays
  unsure at all n locations
  Clone ID: LIB148-009-Q1-E1-G8
cacccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaagaagtctggtccagctgccgcgccgaccaccgccgcctctacaccgtcttcttccacggacgaagagtttgagccttcgccgtcggcatccaacgccgaggtggcgtcncctgccgctgatgggcctgctg

SEQ ID NO: 10269 - DNA, 407 bp, Zea mays
  Clone ID: LIB148-009-Q1-E1-G9
agaccatgtagagaagataaaagcatttccaatggaaacgactataccattccgagagcggctgaagatacttggcaaggtggctaatctggaggatcttcctttgagtgcagcggagaggaagctaatgcatgcgtataacgagaagcctgtcctttctagaccacagcatgagttttacctgggtgataactacttcgagatcgacattgacatgcacagatttagctacatctcaaggaaaggttttgcaacatttttggacaggctaaaagcatgtgttctagatgttgggctaactattcagggaaataaagctgaagaactgccggaacaaatcttatgctgtgttaggttgaatgggatagattacaccaaataccagcctcttttgactcacgctgcct

SEQ ID NO: 10270 - DNA, 388 bp, Zea mays
  Clone ID: LIB148-009-Q1-E1-H1
aagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcaggacatgatcctccgcctcaggaacgtggagagcggggagattcagctgcagctgcagtgggtcagcatccctcctgctgcag

SEQ ID NO: 10271 - DNA, 337 bp, Zea mays
  Clone ID: LIB148-009-Q1-E1-H10
tctggctgttgtacctgatgctcagagtagacgctggctgctgctccgcaaggaaactgactcccccgaccgccgttcatgctcctgtctggctggctcgctggccgcctcaacgggaacgctgccgtagaatgacgactggggctggtgttgttgttacagtatggtccttttttctttcttctttcccctttcatccattaagctctgtgatgtagccgcccgtgatgttgattcatgaaatcatgcgagagattttttcctggaagtaattgcgtgcctgttacactgtcgaacctatttggaccaaagttgtacaccgcagtatgatgttacc

SEQ ID NO: 10272 - DNA, 395 bp, Zea mays
  Clone ID: LIB148-009-Q1-E1-H11
acggacccatccacgcatcgacctagcggccgtcgcggtcatgcacacattcaaagcaggcaagcaatctaggctcagcatgattcacaacgcaatgcaggagacgcccaccatcagcatcgacggccacgacatcatactcctggacctggagggctcatataccctgcacgacgtgtactactcgctgaacgtgcacgtctgccactgcatcgccctcctgtactacgacgactacccgcccggctactacaacatggtgtccaccaccctgttcatcgacaacgccaagtccgcctccgccgtcatccgctactccagcgccagccgcaccgcgccggcgaccaacatgaacaagccatcggacaggctggccatcgccatcaaccacacca

SEQ ID NO: 10273 - DNA, 234 bp, Zea mays
  Clone ID: LIB148-009-Q1-E1-H12
gcgagctcctgacatgggaggatcactagcccgtcccacgaggttctgcccgtcgtgggtgcacaggcgctgccgtcggtgttagagtcaccgcatgtttacattcgtcatgaccccttcgttcagtacgcctctgtgccatgcatgcacatagatcatgctcactgaagtctacacgtttgccatatctcgttacgtacactacgcttctttatcccctcctccctttttttt

SEQ ID NO: 10274 - DNA, 371 bp, Zea mays
  Clone ID: LIB148-009-Q1-E1-H2
aaccccatcgaccggtgctggcgcagccgcgccgactgggcgacggcccggaagcggctggcgcagtgcgcgcgcgggttcggccacaggaccgtccgcggcgcagacggcaagctgtacgtggtgagggacccgagcgacgacgagatgatcatcccgcggcagggcacgctgcggcacgccgtgatccaagaccggccgctgtggatcgtgttcgcacgcgacatggtgatcgagctgcggcaggaactgatcgtgaaccacaacaagacgatcgacgggcggcgcgcacaggtgcacatcatgttcgcacaaatcacgctgcataacgtgcagaacgtgatactgcacaacctgcacatccacgactc

SEQ ID NO: 10275 - DNA, 394 bp, Zea mays
  Clone ID: LIB148-009-Q1-E1-F8
gcgtccagcggtagcaccgttcgcgggcgccgcacgcttggacgttgtggagggtaggtccatggaatccgccgatgcaccggaggcggcggccgatgctcccgctcctagccccgactccgcctcatccccagactcgtcatcggaggcgccctctagcagcagttcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctctctcgtttgttttttatttttcttaatgcaagttatataatttgttatacccaata

SEQ ID NO: 10276 - DNA, 369 bp, Zea mays
  Clone ID: LIB148-009-Q1-E1-E2
aatgcacagcggctgcaccttcaaccacagatacgtgaaatccaacccgcgggaggtggagaacgccacctggatgctgacggtgttccactgcttcggccactacttctgcctgcacttcgaggcgttccagctcgggatggcgcccgtgtacatggccttcctccgcttcatgggggacgagaacgaggccaagaactacagctacagcctcgaggtcggcgccaacgggaggaagatggtgtgggagggcaccccaaggagcgtccgcgacagccaccgcaaggtgagggacagccacgacggcctcatcatccagaggaacatggcgctcttcttctccggcggggaccggaaggagctcaagct

SEQ ID NO: 10277 - DNA, 192 bp, Zea mays
  Clone ID: LIB148-009-Q1-E1-E3
aaatcgccagcaggagctatggggcagggacatccgccgccgccgtggcaccatggtcattgcgattcgctagcgtctgattgagggtcgtggcctagtgatcttcgcaaaggcacgcggatggttatcatgccctcaccatgcggttctggggcccaaacggtaatgaattgtcaggacgcacccctcaat

SEQ ID NO: 10278 - DNA, 438 bp, Zea mays
  Clone ID: LIB148-009-Q1-E1-E4
cccacgcgtccgcccacgcgtccgctgcacgcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagccccaacacggcgcaccaccccgtctccgtgcccaccacacctaggttgtccttatcgtgctcgtcgttcggccacatggtgaccccgcccaccgacacaccgccgatcacgcccaccaag

SEQ ID NO: 10279 - DNA, 73 bp, Zea mays
  Clone ID: LIB148-009-Q1-E1-E5
accttgtcaccacacgcaggtaccaacaaggcgacgatcatggcgaggctgtccttggaacgggcggtggttc

SEQ ID NO: 10280 - DNA, 416 bp, Zea mays
  Clone ID: LIB148-009-Q1-E1-E6
agcgtggaccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggtgagtgagcagcaagcagaacgatcctgtttgtgattcattattctagactgtttgctacaggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccgacgagagcca

SEQ ID NO: 10281 - DNA, 433 bp, Zea mays
  unsure at all n locations
  Clone ID: LIB148-009-Q1-E1-E7
acgcaggctgctcatcgccctccctccgcgcccccgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcataagtccttaaaatcctaaagancaattgaacccttgcttgacaatctctaaggttttgctttctatctgctccctgcttactgatcccaaccagacgaccctcttgtccctgagattgc

SEQ ID NO: 10282 - DNA, 361 bp, Zea mays
  Clone ID: LIB148-009-Q1-E1-E8
gccccggcccaacggcccccgaaccaattggccgttcggaaccgggcggggccccccggcgcaacagcagcccgagtacccggaacaagcggacctggaagacgtgctgcggacggtgggaacgttcccgcccatcgtcttcgccggcgaggcgcgcaccctcgaggagcgcctcgcggaggccgccgtcggccgggccttcctcctccagggcggcgactgcgccgagagcttcaaggagttcaacgccaacaacatcagggacaccttccgcgtcctcctgcaaatgtccgttgtgctcatgttcggaggccagatgcctgtcgtcaaggtgggaagaatggcaagtcagtttgcgaag

SEQ ID NO: 10283 - DNA, 422 bp, Zea mays
  Clone ID: LIB148-009-Q1-E1-E9
agaaagacctgtacggcaacaccgtcctctcgggtggcacaacaaggtcccctgcaatccctaacaggaatagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagaccgcaataactgt

SEQ ID NO: 10284 - DNA, 183 bp, Zea mays
  Clone ID: LIB148-009-Q1-E1-F1
acgagcgccggcttcggaatgcctccctttgcctgatgtttttgtgggggacaaagggaggccagaagcggtagcaccgccgccgcgtcatggttcgccggagacatacacaaagacaggaagcaaaacatgcaaaattgccaccgcttctcactcaattttatgctcgaatgtgaatctcat

SEQ ID NO: 10285 - DNA, 406 bp, Zea mays
  Clone ID: LIB148-009-Q1-E1-F10
gactccgcgctctcccctgctcttgcgctctacatggaaggcgagaccggcgcccaaatcaacggaatcactgctccgcgctctccagacgcggacgggattgcggcctcgatccgcgctctccgggttcgcccagatcgacggcgtccgcgccgcgcttgcccagattgacgaaatttgcagtctccagacgcgagtctggcgctcgctattcgtggaaggcgaggagagacgacgcatcggctctcgatccgcgctctacatggaaggtgaggcagattgggggagtggctcgtggccgtcgcctcggcggcgtcctccgtgccgtccggcgaggtgtcgtccaagcacggcggcgacgactacgtgattgtgggcgggcccaacggcaacgccgtcgcgcgcc

SEQ ID NO: 10286 - DNA, 402 bp, Zea mays
  Clone ID: LIB148-009-Q1-E1-F11
cggacccttgggcaacacacacatccgtgaaagaaacaagcacatgaaaacaaatacatcgctagctcgccaccaacaatggcctcaaggtactctatcctgcttgccacaacgacactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttc

SEQ ID NO: 10287 - DNA, 239 bp, Zea mays
  Clone ID: LIB148-009-Q1-E1-F12
caccctccctccctcacacacttattatggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctg

SEQ ID NO: 10288 - DNA, 436 bp, Zea mays
  Clone ID: LIB148-009-Q1-E1-F2
agtgcctctgaacgcgggcaacgtgctggtcgtggaggacaacgagccggcgggcaagtggatggacctcatctaccaggccctgaacaggccgccgccccaccaggacggccagtcctccggcgacgagctctcgccgccgccgtccacctcctcctcccactaccccagccggccgcaaggtgccgcccgcgaccccagcaacgccgccgccatccccaagacctccagcggcggcatgctctgcgcgcagaagccgccgccgccgctcaagatggtcagcaagtgctaccgcgtcgacaacgcgctggtgaagacgtgcacctgcatgtccgacccgtccaacatgcagctccgggcgcgtgagatgcgcgagttcctctgccgcgtccaggccgccgccgcctcgccgggccgcggcgccgacgacgacgcg

SEQ ID NO: 10289 - DNA, 351 bp, Zea mays
  unsure at all n locations
  Clone ID: LIB148-009-Q1-E1-F3
agggaattctcgattagttgtcataaaaaatgctgggcacgcggtcaatatcgagaagcccagggaagtgtgccggagcatcattgagttcttcaaggagccggtcgctggagctgcaaatgcggacgacaaggtgtagtagcttccaccaatggcggacgtggacaggtcttcgctgggcatcggcagacggcgcacccgcttgtggcacgcaaacacaaggcagatacgtggcattgtacatctacatccctctgccattgttctgatgtacttaaagggtgtatgtagagtcattgcagtagcgattcatanagcatgtaacggggaacagagggaaacatagtggct

SEQ ID NO: 10290 - DNA, 402 bp, Zea mays
  Clone ID: LIB148-009-Q1-E1-F4
actggtgccggcgtttctagtggaggatcctccggtggcgccgatgctggcgctggcgctaccgtaggtgctggtgtctcgggaggcgctaaagttggtggtggcgttggaggaaacgcgggaggaagtggcaaggcgtatacaggaaccggtgccgatgcgggtgtttccggtggaggatccggtggcgtcgatgctggtgtctccggaggcgccaaagttgacggcaacattggaggaaaagcgggagggagtggaaatgcatatactggagctgatgcaggtacaagtgtttcaggtggaggatccggtggcgccagtgcaggtacaagtgctaccgtgggtgctggtgtctccggagggtgcaaatttggtggtggcgtaggaggaaatgcaggagga

SEQ ID NO: 10291 - DNA, 333 bp, Zea mays
  Clone ID: LIB148-009-Q1-E1-F5
ggggaaggtgggcggctactggttcaaccagaaggccaacaaagagctcgacgacatgaactcgatctctagcagcatcggagatggagctaaatggatggtcaacaaaatcaaagggaagatgcagaaaccgctgccggagttcctcaaggagtacgacctcccagcaggcctgttcccgcaggacgcgacgaactacgagctgaacgaggacaccaagctcctgacggtgtacatcgcgtcgccgtgcgaggtgggctacaacgactcgtcggtgctgcgcttcgccaccaccgtgacggggtacctggagaaggggaagatgacccacgt

SEQ ID NO: 10292 - DNA, 423 bp, Zea mays
  unsure at all n locations
  Clone ID: LIB148-009-Q1-E1-F6
agggaggagaggaggcgaggtgagagaggacgaagagggcgcatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataagcttctganggaaggcgattccatgttcaaagaagagttcctggcctactcatccananggaacatcttgcaca

SEQ ID NO: 10293 - DNA, 407 bp, Zea mays
  Clone ID: LIB148-009-Q1-E1-F7
acccacgcgtccgcccacgcgtccgggccgccaccgaggtcgggtgcctcgtcgtcaacgcgcccaccgccaacaccatcgccgcggccgagcacggcatcgcgctgctcgcctccatggcgcgcaacgtctcgcaggcggacgcggcgctcaaggccggtaaatggcaaaggaacaagtacgtgggggtttctctggtgggaaagaccctggccgtcatgggcttcgggaaggttgggtcagaggtagcgaggcgagcgaaagggcttgggatgcacgtgatagctcatgatccctacgcccctgccgaccgggcccgtgccctcggggtagagctggtttctttcgacgaggccatcgcaagagccgacttcatcttcctccacatgccgctgataccgacgacg

SEQ ID NO: 10294 - DNA, 352 bp, Zea mays
  Clone ID: LIB148-009-Q1-E1-E12
acccaggcgtccgcgtggacgccgtcagcgacgctgatatcctcgcgcatctcttgctggtggtgctgctgcccgctgagctgctcgctctcggcgcgctcctgttcgtcagtatattcaggtgcttacataggctcacacgccggttcatcactccgttcgttcgttcgtaagccgtctacatacacgattcttttgtcccacacacacacatacacatacacgtctgcaaagtacatgcgacattgcagctgcttcgcatgtatgtatgatgaatgaaatgaaaactcaaacacattctctaattctttggttccgtccaaaacaaaatcattcggaatcaccatcaacc

SEQ ID NO: 10295 - DNA, 441 bp, Zea mays
  Clone ID: LIB148-009-Q1-E1-C6
aggcagactcgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggcggcgctggagggcacggaggcgggctactgcacggcgtccgggat

SEQ ID NO: 10296 - DNA, 390 bp, Zea mays
  Clone ID: LIB148-009-Q1-E1-C7
agcctgcagcgtcacctgcgccaaggagaagaacccgcgcctcatcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaacggctggccacgcatgcgataaccatctgatatggacggaactatatattgtattcctattaatctggcattttctaagctaattgtttttttccaaatataccgtcgatggaactccaaatgtaatgtcacgcaaatgtgtgtttttcatcgattgaatgggtaataataaaaacgcatgctggcagttactact

SEQ ID NO: 10297 - DNA, 419 bp, Zea mays
  Clone ID: LIB148-009-Q1-E1-C9
aaagggcagacgggcgagcaggatgagagagatcatcagcatccacatcggccaggccgggatccaggtcggcaacgcctgctgggagctctactgcctcgagcacggcatcgagcccgatggcaccatgcccagtgatacctcggttggcgtcgcacatgatgccttcaacacgttcttcagcgagaccggttctggcaagcatgtgccgagggccatcttcgtcgaccttgaacccactgtcattgatgaggttcgcactggctcgtaccgccaactcttccacccagagcagctcatctcgggcaaggaagacgcagctaacaactttgcccgtggccactacactgttgggaaggagattgtcgatctatgcctggaccgtgtgcgcaagcttgcagacaactgcactgggctgc

SEQ ID NO: 10298 - DNA, 206 bp, Zea mays
  unsure at all n locations
  Clone ID: LIB148-009-Q1-E1-D1
acactgaacgtaccatggtattttatgagaacanagaaaatctttccaaattatgggatattctacccgtgtatgcatggattgacaaaaatgttggttacggccaaggaatgattgatttaggctcacaaatgatatttctacaaaaggatgaaccaaatgccttttggggctttgaaaaattgatccttaaattgcaaggaaat

SEQ ID NO: 10299 - DNA, 412 bp, Zea mays
  unsure at all n locations
  Clone ID: LIB148-009-Q1-E1-D10
agaccagcagcagggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgnacacgccgccagca

SEQ ID NO: 10300 - DNA, 423 bp, Zea mays
  Clone ID: LIB148-009-Q1-E1-D11
cccacgcgtccgcccacgcgtccgcccacgcgtccgcgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagc

SEQ ID NO: 10301 - DNA, 413 bp, Zea mays
  Clone ID: LIB148-009-Q1-E1-D12
aaacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgac

SEQ ID NO: 10302 - DNA, 254 bp, Zea mays
  Clone ID: LIB148-009-Q1-E1-D2
acccaaacgtccagcctgccgcgacgcgtgccagcaggctccaaacgcgcacaccacatcaaactgcaagaggtcgagcacacccctaacgccggccaactgacgaccttcaaacgcgccaaccctacagacatgtgtagatgattgcgacgatcgtcacctccactctaccccatgtcctcatctaggctacagcagtgtcggccaccactgacgacgcagccgacggcgatctaacatcgtccgagtcatct

SEQ ID NO: 10303 - DNA, 436 bp, Zea mays
  Clone ID: LIB148-009-Q1-E1-D4
acgatgggatccctcgctaataacatcatggtcgtgggcgccgtccttgcggcgctcgtcgccggcgggtcgtgcgggcccccgaaggtgccacccggccccaacatcaccagcaactacaacggcaagtggctcaccgctagggccacctggtacggtcagcccaacggtgccggcactcctgacaacggcggtgcgtgcgggatcaagaacgtcaacctgccaccctacagcggcatgacggcgtgcggcaacgtccccatcttcaaggacggcaagggctgcggctcatgctacgacgtgagatgcaacgaaaaacctgagtgctcgggcaatccagtcacggtgtacatcacttacatgaactacgagcccatcactccctatcacgtcgacttgaacggcaacgccttctgctccctggcaaagcccgggc

SEQ ID NO: 10304 - DNA, 298 bp, Zea mays
  Clone ID: LIB148-009-Q1-E1-D5
acccacgcgtccgatcgatcatgacatgatggcgtgcacagacaatgcgatgagagccttgttcctcctggtcctcttctgcatcgtgcatggtgagaaggaagagtcaaagggcatcgatgctaaagcgtccgggcctggtgggtccttcgacatcaacaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttc

SEQ ID NO: 10305 - DNA, 428 bp, Zea mays
  unsure at all n locations
  Clone ID: LIB148-009-Q1-E1-D6
acccacacgtccggtcggccccagccgagataccggagtacgagctgaaccccggagaggtccagttccggcgaggctgtgacgttacaccgggtgtgtaccacatcgcgaaatggaatggcacaaaggtttccgtaaaaatacttgacagagacggttgctccgatcaagaagccgcaaactctttcaggcatgaattgactgtgctggagaaggtccgacaccctaacgtcgttcagttcgtcggagccgtcactcagagcatacctatgatgactgtgtctgaactccatgaagagaaagacttatcagtctgtatccagaaaaaaggaaagttaaagcctcagaaggtgctaagatacggccttgatattgccaagggcatgacctacctccaccagtgcaangccggacccatcatccactgc

SEQ ID NO: 10306 - DNA, 269 bp, Zea mays
  Clone ID: LIB148-009-Q1-E1-D7
aatcgattcgcacgccggtggacggcgtctcactagccaacaacgcgacgatcgggttaaaattctcatctaccggccagggcaattctgtggctcgattgatcggtctgtcgtaaggcaattgatcaagctagatatatatataggagattcgtcgaacgagctactagcgaaatgggttccgccgtcctcttttactgcatctggatcgccgtcatcgtcacattgtcctcgtccatggtcgctgtcggggacggagacccggggga

SEQ ID NO: 10307 - DNA, 412 bp, Zea mays
  Clone ID: LIB148-009-Q1-E1-D9
gagcagcaagaaaatctattcatttgacacgtctccatctcattgagcatttaattatttttgggcaggaaagaacacataccagagatgaggttgttggtttaatttgattctaagtcctaatgaagaagattgtgagctccggcccggcggtgccgccctctgggttgtgcatgtagtacgtctcggagtccttggaaccgacgaggcggtcgaaatgcgcgcgcatgtaggtgagctcgccgtcggacgggtgggacatatcggacggcagcacgccggcgcccatggacgtggagtggagcatccgcatcacgcagtcgtcccgctccgtcgcctcccgccgcgacgcgtgcccgacactctcgccgttcacctcggccgtccagaccggctcgtcgagcagcctcct

SEQ ID NO: 10308 - DNA, 293 bp, Zea mays
  Clone ID: LIB148-009-Q1-E1-E1
aaactgccctagcttgctcctcgatccatcaattgcaagaggagcaagataccaccaccgtagcaccacacgcaggtacgaagaaggcgacgaacatggcaaggctggccttggtaccggcggtggttctgtgcctcctgttaccaacagggccgcagggggccatcagcgccgaggggatggtgtcatttgacaatttgatcagctgcaaggtactgggcaactgcaacaagaacctgggccccgaggcctcccgcccagggaaacccgccaacgactacacccgcggttgc

SEQ ID NO: 10309 - DNA, 419 bp, Zea mays
  Clone ID: LIB148-009-Q1-E1-E10
aggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtggctacgtacg

SEQ ID NO: 10310 - DNA, 410 bp, Zea mays
  Clone ID: LIB148-009-Q1-E1-E11
gccacgcgtccgcactgaagcacagcgagcgagctgtccggccaaaaccctcagggccgcctccacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgacggcatggccggcgcgcaggcgctggtggcgctggcgggggccggggccgcagcgcccgccgtgcggacctacaacattcacgggt

SEQ ID NO: 10311 - DNA, 431 bp, Zea mays
  unsure at all n locations
  Clone ID: LIB148-009-Q1-E1-C4
aacaaatgcactgcattctattttagctaataggtttattctttggaaaagaaaatgatgtgctaattagcttagttctggggacttcaggggttccatgccggcctaacctattggaacgacttgttagttgttattccattgcatccaaagtccacatgttattttgttaagctccataatgctgtggcatcgtgttgcgaaaacattaattgggagaacattagtacatgaatacttgatcttcatagttcagttttcgtgcatgtgcacttgttagttgcgaaaatgaactaatttcccttggngaaatangtatcccttggaaaaatggttttgccanactaccccttanaggaactaattcctggcatatggtgctcagtgggcagtgcatcaggactcgaaggaagcatagcatcatcggtttt

SEQ ID NO: 10312 - DNA, 419 bp, Zea mays
  Clone ID: LIB148-009-Q1-E1-B1
gggtcgaggacgcgtcagcttgcaatcacaacgaacaaaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaagaaggaccagctcctggccctgatcgaaaagcatgccgcg

SEQ ID NO: 10313 - DNA, 408 bp, Zea mays
  Clone ID: LIB148-009-Q1-E1-B10
acccacgcgtccgcccacgcgtccgaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagatccgacctgcaggaggaggcaacagctaccgtaataaccaaagcggaagcacaagaggcttcagctgaaggtggcgattaacctacctaaccatatta

SEQ ID NO: 10314 - DNA, 425 bp, Zea mays
  Clone ID: LIB148-009-Q1-E1-B11
acaactggcggcgcttcgccgccttcgtgcgccgcatgaacggcgccgggtcgtgccgggacgccccggagcgggaggcgcacggcgtctcgcaggccaccgggtcgctggtgcacgaggccgccgtcgcgctgcggagctgaccggccgggccgggacgggaccgaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcagtgcagctccggcgtagatgagattgtattgtgaccaagccgggagggaaagcagggatgggaggacaaagatgttttgtcacgtttcaggctccggccatcgccggagtttgt

SEQ ID NO: 10315 - DNA, 404 bp, Zea mays
  Clone ID: LIB148-009-Q1-E1-B12
tactaatcaaattcttgttgggatatattcctccaattcccctcctcctcccaacaaggcaacaacaatctgttccggccgccaaacaaaacccaaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcg

SEQ ID NO: 10316 - DNA, 294 bp, Zea mays
  Clone ID: LIB148-009-Q1-E1-B2
agtacgatatcagcgcattatcgggatggttcacaaaatggtagacaccgttgtatttctcgccgtgggctcactggcggttctgggcggctacgatgttatagatatcctggacgacatccgcatctgatccagatatcagaatctcctgcaagacaggatcgtagcgggagaggcaactgatctacggtcggctacgcaactgctcgtacgcgatcaagttgacaaaccgctggtttcacctgtaggcgataaagtcctgcctgccctggagaaacatgtcattctcattta

SEQ ID NO: 10317 - DNA, 390 bp, Zea mays
  Clone ID: LIB148-009-Q1-E1-B4
attcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtatctgagaaagtggtggtggaggagccggctgcggcggccgacgttgagcatcagaaggctaatgaggtgctcgctccagacgcggccgtcgccgagcccgaccacaaggaggaggaagccgtggagaagaccgtcgtcgaggaagagatgccaacggcagcagcccatgcagaggaaaaggtcgccaccgccgccgag

SEQ ID NO: 10318 - DNA, 404 bp, Zea mays
  Clone ID: LIB148-009-Q1-E1-B5
acccacgcgtccggtgcaacctccgtggacgaagcattcgcctcgccttgatctccaaccccttccttccttgcttaggagagagagggaggagaggagaggaggaagaagatggagagggcggccccagtgaggagttcccacacctccacggccggcctactcgcgtggcctcaacccgatggcgccgcgtcgcaggcaccacgtcggcctaaccagccgacggaggaattcaggaaggtggtgttcggggggcaggtcaccgaggaggccgacggtctcaacaagacgaagatgacgacgacggcctccgcacccaagtcgaaggagacaacagggatcggcatgtttaaggccgagagcgccgccgccgccgtcacaactgcatcccgtgatcgccaagc

SEQ ID NO: 10319 - DNA, 409 bp, Zea mays
  Clone ID: LIB148-009-Q1-E1-B6
gcacgcctctacagtgacgtcgtgagcagtacaggggcatgatggacgccgcgcgcgccggcgaggccggcagcggatgtggcgtcgaggagtacctgagtcgcggcctccgagcgttccaggcggcgcgaccgggcggcggcaaggagctggaggaggtcgaggacgcgctgctcgccatgcacatcaaccgggagagggcggacacctccgccgacgatctcggcgacctcgacctcgccatcgaaggcgagtatcgcgacttccccggcgagcacgtcacgatccctgccgggtactcacgcgtcgtggaacacctcgtcgcggcgcttccgccggataccgttcgcctcggccaccgcctccgccgcctcgactggagcgagactcccctgcgacttcacttcga

SEQ ID NO: 10320 - DNA, 339 bp, Zea mays
  Clone ID: LIB148-009-Q1-E1-B7
gtctcctctcctcgccccgctctatacgatcgatggccgcgacggcggcggaggagatggagaggatggtggaggcggagtgggaggaggggatgaggaagaggaagcggtacgggctggtggagtaccgggcgctgccggcttacctgcgggacaacgagtacatccaccgccactaccgctgcgagtggccgctcccgcaggttctgctctccgccttctccatccacaacgagaccctcaacgtctggacgcatcttatacgatttttcatctttctcgctctgaccatatacacagcaacacaagttccaaatgcagtatatatccggagcttgc

SEQ ID NO: 10321 - DNA, 412 bp, Zea mays
  Clone ID: LIB148-009-Q1-E1-B8
acttccacaaccagggcgggaagccggagcagttcgaccccagcatgaacccgtcctacgccagggggctgcaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccaaaaccttcttcgacgacttcggccgcgccatggagaagctcagcttgttcggcgtcaagaccggcgccgacggcgaggtcaggcggcgctgcgacgcctacaacagcggccccgccgtcgccgccaccatacccaagatgtgacgacgctg

SEQ ID NO: 10322 - DNA, 404 bp, Zea mays
  Clone ID: LIB148-009-Q1-E1-B9
aggacgcatgggacgcgcgcacgcacgtatggtcgaacaatattaggagagaagctcagagaccggttcctggccttccaaaaaagaagtagacataagatagatctctccgcctctcctcgcccaacctcctccaacaagtaacattgaccgcaaacggatcatcgtccggtgcggtcaatgtaattaactaagcttctcaatcatacatagcttggcaaatgcctgagggctagctagacaaggtccgttgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcggataca

SEQ ID NO: 10323 - DNA, 411 bp, Zea mays
  unsure at all n locations
  Clone ID: LIB148-009-Q1-E1-C1
agcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttcnaaccccacctcatgatcctcggccatggccactgatgagtgtaaatggtttgttggttggtcgtcctcgtctcagccgatctactggacgacacg

SEQ ID NO: 10324 - DNA, 211 bp, Zea mays
  Clone ID: LIB148-009-Q1-E1-C10
gtgggacgtattagagcaggtgctgataaatcaccggcatcgagatcagtcagatggacgattaccttcggctttacgtgcatctgaactctacttgtatcgtgctccagcatcaagcgcatctaggactataccgtatgactacgtcggttggagtctcacatgggaccttcactaggttcgtcatcgattcaggttctgacatgcatat

SEQ ID NO: 10325 - DNA, 94 bp, Zea mays
  Clone ID: LIB148-009-Q1-E1-C11
agttctaaatcgcgagcggccccctttttttttttttttgattttaaaaggaaatatcatatatattccatcacaagattacagaacgacttga

SEQ ID NO: 10326 - DNA, 429 bp, Zea mays
  Clone ID: LIB148-009-Q1-E1-C12
agcacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacaccttttgtcctctttttctttgttccctctttctcc

SEQ ID NO: 10327 - DNA, 433 bp, Zea mays
  Clone ID: LIB148-009-Q1-E1-C2
ctctacactaatccatgatacaacatggctgtgaatgtgagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaatgacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgttacact

SEQ ID NO: 10328 - DNA, 380 bp, Zea mays
  Clone ID: LIB148-009-Q1-E1-C3
ctcgacaactccgtcggcgacctctcctggctcctccgcgtctcctcctcggccaacgacgacgacgacgacttcgacgcccacatcgggctcccgcccatcgcgcagaacgagcccatcctcttcctcatctgggagcagatcgcagtgctctacaccggcaacctcgaagcccgcgccgacgccgccgccagcctcgtctcgctggcgcgcgacaatgacaggtactctaagctcatcatagaggaagatggcgtgccgccgctgctcaagctcgtcaaggaggcgcatctcgaggggcaggagaactgcgcgctcgccatcggcctcctaggccgcgatccggagtgcgtcgagcagatggtccaagccggggtgtg

SEQ ID NO: 10329 - DNA, 426 bp, Zea mays
  Clone ID: LIB148-009-Q1-E1-A9
atggaacacaaaatcaacccttcaacaaaagaacaacccctgaaaacaaatggacctggcccgggtcggttgcaacaaaggattccaataacttcgaggtttgcaacgaattgctcgtcagatctggattgcgtgagaccatctagtgccccaaaagcttctggtttaacaaacggagggggctcagctgcaagaaagtcccaactgaagggtgcaaaaagttcagacatcagaggagggaatcctgcaaaaaagtcatcgcccttacagaaaaagctgagtgctccctcaccaacggtaactaagaagagcggaactgaaggaaagaaaactccaaatggaaaaacaggagccaagaagtaagcaactcagttgaaacttcgttttgttgggaccaacttcaccatggccggggacagataaaca

SEQ ID NO: 10330 - DNA, 259 bp, Zea mays
  unsure at all n locations
  Clone ID: LIB148-008-Q1-E1-H4
actgcaaaggggtcctctccatgtgcaactactcctccatgacggtgtgctgtactgcaagacccacttcgagcagctcttcaanggagacggggagcttctccaaaaactcacgccaggtggcaagtcatcagacaagggtgaactgacatggggcccaggcaagctgtcgtctgcattttctggtacccaggataagtgcgcagcatgccagaaaacagtgtacccgctggagaagttaactctggaaggcgagtcc

SEQ ID NO: 10331 - DNA, 424 bp, Zea mays
  Clone ID: LIB148-008-Q1-E1-H5
atttgtgtttgttgttgccgccgctgcttctcccgttgccaagcctccatccaattggatagtcgcttcgtgcggtcccgtcccctcgccggccggcggagctcacggcttgccgctgcattgccatcgtgtcacttgtacacaatccaccaatctgattggattcggggggatgcttgggcaaattcgagaatttgctcaggcattcgttccgattgcggctagctagctgatcgcttaatcactcgacacgggcaaatttgcacggcgacgacgatgggcatcttgtgttgtttccagtcccacaccagcgatcacgctgttgcttcgtccccggctacctcttcgtcctctgccccctcgtcgtgccgaaacaacgatcgccgtgctccccccgagcggcaggcccccggcgaggagaaga

SEQ ID NO: 10332 - DNA, 426 bp, Zea mays
  Clone ID: LIB148-008-Q1-E1-H6
cgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgct

SEQ ID NO: 10333 - DNA, 161 bp, Zea mays
  Clone ID: LIB148-008-Q1-E1-H7
gcgtccaggtgtctttggagtctgcggaggtgctcactctgctggggatacataactagactatcaaccatgcagaatcacgtgatctgagctagcagggcactggctctgctcgcgcgagtttgagtagcgctcgtggcacctgcagtgccacctcaagt

SEQ ID NO: 10334 - DNA, 432 bp, Zea mays
  unsure at all n locations
  Clone ID: LIB148-008-Q1-E1-H8
cgcgtccagcggcagccagcaggggaggaggacacgaatcgtagtcggcctcccgcccgccccggcaattgttgttgctgctgcgcgcanggcngttctggattgcggtctgccccacccacgaacaatccatggctccatctccgcctcggcgtgctgcgctcctcctcgccacggtgcttctgctggcggcggccgggtccacccccggcgccacggctgctggcatcttccaggtgcgccgcaagttcaccgccggggtgggagggggtgctggcgccaacatcagcgcccttcgcgcccacgatggcacccgtcacggccgcctcctcgcagccgccgacctccctcttggcggcctcggcctccccactgacactggcctctattacacggagatcaagctcgggacgccacccaagcactactacg

SEQ ID NO: 10335 - DNA, 423 bp, Zea mays
  Clone ID: LIB148-008-Q1-E1-H9
ataaaaaatcaaaaaaaaaaaaaaaaaaaaaaaaaaaaaaaaaaaaaaaaaaaaaaaaaaaaaaaaaaaaaaaaaaaaaaaaaaaataaaaaaataaaaaaaaaaaaaaacaaaaaaaaaaaataataaaagggggggcccccccaaaggttctaattttattttcctttcaatgcaatttcttctcttttcaaaagtttcccaaattttcatttaaggggctttttttttaaaactttttaaggggaaaacccttgggtttcccaatttttaccccttttaaaaaaatccccttttcccaacttggtttaaacctaaaaggccccaccctttttccctttcctaaaattttccaaccttaaagggcatttgtgaccctcttttttaggcgacttaaactccgttggttttgggattttcccc

SEQ ID NO: 10336 - DNA, 371 bp, Zea mays
  Clone ID: LIB148-009-Q1-E1-A1
agcctccccagcatgcatggatgtgacgacgtctcctcctcgctgtctctctgcagctgcaactgcaagcatggcaattacttcagacaagatctgcgccatggcggcaacgacgacggggatgcagatgatgcacgcggcggcgttgccgctgtgcctggctgtgttggcagcatctacgcgggtcgcgctgggcaactgccgcgacgactgcatggctgcatgcaacggctggaccaacgtctgccagctcacctgtgccagcgcatgctacagagaactcgggatcagaaccttacgtacctcggctgtattagctaaagcagaatgccctgcatcagcaccacatgcaacacaagagcgaagcgccg

SEQ ID NO: 10337 - DNA, 425 bp, Zea mays
  Clone ID: LIB148-009-Q1-E1-A10
accacgcgtccggctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgacggggagagagagtgacatggctgcgcgcattccgatgcgtgggcatgttttttgattcgacacaccttttgtcctctttttcattgttccct

SEQ ID NO: 10338 - DNA, 363 bp, Zea mays
  Clone ID: LIB148-009-Q1-E1-A11
atccacccggcttggtaacgccacgcatgaaaggtaagggaaaccttgaccggcaagggccagctgtgtggagcaagaactcctgcaccaaaaaatatgactgcgagatatttctcaaatcgctggtgatagacatcttgaacaaaggggaggtgtcctgggtcatactgcgcaacaccacaatcttccacaagatcatgttatagtgcaacgacgatatgatgatcgacgtgatcgtcatggcgccccgggacaaccccaacaccgatggcatccacataggcgactcatcagggatgattatcatcaacaccatcattggtgtcgtcgacgactgcatcatcatcagcgccgggaggacca

SEQ ID NO: 10339 - DNA, 291 bp, Zea mays
  Clone ID: LIB148-009-Q1-E1-A12
ggctccacgggggtgacagtaagccgggacatggcgcgcggtggcctcgcccgcctgctcgccaggctcatcatcttcctcctgctcgccgccggaccttccctcgccgagtcagaggcggaactcgctcggggcgcgtcagaagcgtgacgggacgctcagcagcatttcctgccgcgcccgctcatcatcgagctcccgtcggcgcgggccggggccgagctcgacgcctaagccgacggcgacgccgtggtaacagtcgacgtacgctgcgccagctggcagctcgcg

SEQ ID NO: 10340 - DNA, 427 bp, Zea mays
  Clone ID: LIB148-009-Q1-E1-A2
acccgctcttccaagttaggaggggagcacccatcagccaagagctatccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagaggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaa

SEQ ID NO: 10341 - DNA, 275 bp, Zea mays
  Clone ID: LIB148-009-Q1-E1-A3
ctgcctcgctcttccccctcctatttaccgcccgcgtcgaccgccgccgcacgccttcccacccccgcgcctgcctctgcctgcctgctccccgacgccggggggccccacaacgatccggccccggccccgcgcggtcacagcaagccgggacatggcgcgcggctgtatcgcccgcctactcgccacgctcctcctcttcctcctgctcgccacgcccctcgcagacggcgcttccgatgcagaggctgccggcctcgcgcatggcgcgtccg

SEQ ID NO: 10342 - DNA, 365 bp, Zea mays
  Clone ID: LIB148-009-Q1-E1-A4
acggacgcgtaggtgcctccactgagctggccccctcagagcaacgtatttcctctacagtgtcgccccctcccggtctccgcctaccacatgctgtttgcgagggcttcttacagcgctcaaaaccgtactttcatcttactgcacatctttaatgaagatctagacttctcatcggacacttcgttcacctctccaacactcacgtctctaatatcatgactcctgaaccggtaatcgagcagtaggctccgctaccccggagggccagacaacgtcccgacccacccttacttctcagctctaacatgggacatgatcacgtctgtgtgcacaccaccttaaagttctccttatggtgatca

SEQ ID NO: 10343 - DNA, 293 bp, Zea mays
  Clone ID: LIB148-009-Q1-E1-A5
acggaggagtacgtggcgccagagatggtgcgcggcgagggccacggcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgaagaagaagctcgggtacgccggcggcgccgacgaagtccgggcccaaccgtt

SEQ ID NO: 10344 - DNA, 378 bp, Zea mays
  Clone ID: LIB148-009-Q1-E1-A6
gcgtccagagtgactagcatccatggatgtgacgacctctcctcctcgctgtctctctgtatctgcacctgcaagcatggcaattacttctgacaagatctgcgccatggcggcaaccaccacggggatgcagatgatgcaggcggcggccttgctcctgtgcctggctctgttggcagcatctacgcgggtcgcgctgggcaactgccgcgaccactgcatggctgcatgcaacggctggaccatcgtctgccagctctcctgtaccagcgcatgctacggagaactcgggatcagatgcttacgtacgtcggctgtattagctatagcataatgcgcctgcatcagcaccacatgcaatacactagcgaagcgccg

SEQ ID NO: 10345 - DNA, 388 bp, Zea mays
  Clone ID: LIB148-009-Q1-E1-A7
aagtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcagctccgacgacgcggtgcggcggacgctggcgcagcggaagccgaccaaccggtacatcagctacgcggcgc

SEQ ID NO: 10346 - DNA, 431 bp, Zea mays
  unsure at all n locations
  Clone ID: LIB148-009-Q1-E1-A8
agagacaccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggccgacgctggcgcagcggaagccgaccaaccggtacatcagctacgcggcgctgcncgcggaccaagtgccgtgcaacaagcgcgggcggtcctactacagcaac

SEQ ID NO: 10347 - DNA, 396 bp, Zea mays
  unsure at all n locations
  Clone ID: LIB148-008-Q1-E1-H3
aagacgcatgggctccttctcgcccgggaacgtccagctcggctgtgggaacaggacaaacccatcaaccatggcgaactccgcgtccgggatgggcgttagcgacgaatgcaagctcaagttccaagagctcaagtcgaagcgaagcttccgggtcaacaagttcaagattaacgaacaaacgcaacaagtggttggggacaagcttggggaaccgggcgaaaactacgacgaacttcacggctccatgcccgaaagcgagtggcgctacgccgtcttcgatttcgactttcacaccgacgataactgccagaagagcaggatcttggtcatctcctggtcccgggacacctcgagggtcangagcaagatgctgtacgcgagctccaaaggacg

SEQ ID NO: 10348 - DNA, 304 bp, Zea mays
  Clone ID: LIB148-008-Q1-E1-G11
cccacgcgtccgggagaataaaaccgatgaatcatataattataagaagaaattgtatagaatgcaacactggtctccacatttccctctatggtgtaatatagagaactccacgacgctatacatggtgtgccaccaattaaccggagttaattagtagcaagaaggattaattagcgccgtgcatgcatccatgcggcgatgggctggccagtaataattataattaaggagaagacacgaagcgtatagtacgtttaatcatttaagccgacttgttgcggttgtggtgctccggcttgcc

SEQ ID NO: 10349 - DNA, 439 bp, Zea mays
  Clone ID: LIB148-008-Q1-E1-G12
tcgcgggccgatacaagcctctaaagggactcgtgatagcgacgaagcggtccatggagaagctcggcctcggcgtcgtggaggactggcgcccctggtccatcgacgccaaggaccaggaggtcgccgggtacgtgatcgagtacaagggcgtggtgttcgcgacggtgcgcgggtccgggcacatggtaccgatcgaccagccgggccgcggcttcgctctcttctcgtccttcatcaaggggcagccgctccccaaggccgcgccgatggtcgacggatgaagagccacggtcgttgggattccggagtttcacccttgtctcgtcaagtcaccatgcatattgtctccatttccacgttaactaccagaccgtgtacatactgactaaacgctcgatctgtgacctcaactgttgtatgaatgtttcgctgcagt

SEQ ID NO: 10350 - DNA, 431 bp, Zea mays
  unsure at all n locations
  Clone ID: LIB148-008-Q1-E1-G2
attcttctcacgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcacgacaacttctgctcgacgctgtgcgaaggcacgaaggggatggacctgntggtgtgcaaggagtcctgcgacctctcacagcgctccaacctggtgctgtacggccggattcagtgcaggggcaagtgcaccgagcagaaggggatcaccgcgccgcagatgaaggtgtgccaagaggcgtgcgacaaggactacgtggtcaaggcggctganggtcacaaggcctgcaacaacacctgcgccaagga

SEQ ID NO: 10351 - DNA, 291 bp, Zea mays
  unsure at all n locations
  Clone ID: LIB148-008-Q1-E1-G3
ctacgcggagctcatggagatggcgcgcaaagccgggctcaaggtccaggccgtcatgtccttccaccagtgcggcggcaacgtcggcgactccgtcagcatcncgctgccgcggtgggccgcggaggagatggagagggaccaggacctctgctacaccgaccagtggggccgccgcaactacgagtacgtctcgctcggctgcgacgccatgcncgtcctcnaaggacgcacgcccgtcgagtgctacaccgacttcatgcgcgcgttccgcgaacacttcgccgacta

SEQ ID NO: 10352 - DNA, 428 bp, Zea mays
  Clone ID: LIB148-008-Q1-E1-G4
actcgaccgggcgatcgggatggggttccaaaacaccggcggcgccgaaaagcaccaggcggtggcgctgctggtgcagtccgacaagtccatcttcctcaactgcaagatggacgggttccaggacacgctgtacgcgcactccaaagcgcagttctaccgcaactgcatcatctcaggcactgtggacttcatcttcggcgacgcggcggcggtgttccagaactgcatcctggtgctgcgccgcccgatggacaaccagcagaacatcgcgaccgcgcaaggccgcgcggacgcgcgcgaagcaccgggttcgtgctccagaagtgcgagttccaggcccaagccgcgctccgggactccgggcgcccgcccatccgcaactacctgggccggccgtggcgcgagtgctcgcgcaccatcgtcat

SEQ ID NO: 10353 - DNA, 407 bp, Zea mays
  Clone ID: LIB148-008-Q1-E1-G5
acccacgcgtccggcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcaaaatgaggaaggccgcgggaacgaggcgcacgccgcatccatccgcgc

SEQ ID NO: 10354 - DNA, 430 bp, Zea mays
  Clone ID: LIB148-008-Q1-E1-G6
acatccatcaccgaaacaagagcacacaaacaatacctctctagctcgccaccaacaatggcctctaggttctccatcatgctcgccacaacggcactggctacgttttttgtgattggttcgtgcaccaccccgctcaccttcaaggtcggcaaaggctccaagcctggccacctggtcctcacccccaacattgccaccatctccgaagtggagatcaaggagcacggtggcgatgacttctcctttgagctcaaggagggcccggccggcacctggacgcttgacacaaaggccccactcaagtaccccctctgcatccgctttgccatcaagtctggcggctaccgcatcgccgatgatgtcatccctgaaaattttaaggccgacaccacctacaagaccaccctcagcatctgatcatcctctt

SEQ ID NO: 10355 - DNA, 424 bp, Zea mays
  Clone ID: LIB148-008-Q1-E1-G7
cccacgcgtccgtcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcga

SEQ ID NO: 10356 - DNA, 435 bp, Zea mays
  Clone ID: LIB148-008-Q1-E1-G8
acgcgtccagctggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaagcccgacgcggcggcactggtggtgacggtgaccgacctgtgcccgcccaaggaccagtggtgcaagcca

SEQ ID NO: 10357 - DNA, 421 bp, Zea mays
  Clone ID: LIB148-008-Q1-E1-G9
acgtcaacgtgttcaacatgctcgaccagccgctcctcttcacatggcacgggatccagcagaggaagaactcgtggcaggacggcatgccgggcaccatgtgcccgatccagcccaacaccaacttcacgtaccactggcagcccaaggaccagatcggcagcttcttctactaccccagcaccggcatgcagcgggcggcgggcgcctacgggctgatcagcgtccacagccgtgacctgatcccggtgcccttcgacacgccggccgacgacttcccggtgctcatcggcgactggtacaccaaggaccacgccgtgctggccaagaacctggacgccggcaaggggatcgggcggccggcggggctggtgatcaacggcaagaacgagaaggacgcgtcgaacccgcccatgtacaa

SEQ ID NO: 10358 - DNA, 343 bp, Zea mays
  Clone ID: LIB148-008-Q1-E1-H1
aatcatctcatggctgaaggagcttgggcaaaaaacgccgtacaaatggagggagctcttcgcggtgaaaaaagagaaacagcacgaaattgaggataagatgcttgacaaattcacaaataagtttcaagcatagagagctgaaaaaccactgcaagcaaatcaaactatgtacaaaggtgcctccaagcagcaaaaggagtttctttggaggaaagtggacctagcactgtatccagttccaactacaagagcactatactgaagaatgctacgatacatgttaacaatcaatcaacattgcagtctgctatgcaaaagaatacttttgcgacgtcatctc

SEQ ID NO: 10359 - DNA, 416 bp, Zea mays
  unsure at all n locations
  Clone ID: LIB148-008-Q1-E1-H10
caactacaccagggccgacgacgggcagatgtacttcggcgctcccggagccccctgcgtggccaagctcgtcaaggtcgtcgcagcgcggccgtactctgtgtccatcatggagatcagcgagcccattttgccggccgcgttgccctcccccgtcgcggcgcccggccgccgcggcaagggtggtaagcgcaagatcaagccatcagcggcaacccatgaggattccaacatgatcccgcgcaagcccgtcgaagcagtggtggtgggtaagggtaaggtggccaaggataccgtgtccgagtcacctgctccaagccccgcccccgtctccgccccttagttgcgtgttgggcgccgctgcncgccggcccccggccaccatgcgtcgtgtctgcgcgcgcacgcacgcattg

SEQ ID NO: 10360 - DNA, 419 bp, Zea mays
  Clone ID: LIB148-008-Q1-E1-H11
agcagcagccattactatgtagagagcgcagagggccgtcacctggtccgctcgccgttgtgtccattcggggcaaacacagagacctcgggagcctgccgcacctccatcgagcggaacggaagaatggtgggagaacagagaaactccaccgccatggcccggcgccgcgcctcctctggtgcactggtaccgctgccatgtgccgtgcagtgcgttggtgggatcctgtcgtcgtggtgggaatccagcggccctgggtaattcgggtgtgcgcccacatttggcctcggtgaccagctacaggattccgccgacatctccagtgcaaatcatgtggtcattccgggtggattgatgccgggggaccctgggattgttcaccggaaaatctacacagcggcaaagcgactctgagc

SEQ ID NO: 10361 - DNA, 403 bp, Zea mays
  Clone ID: LIB148-008-Q1-E1-H12
ccccgggtgcccgccgcgtcgtactcctctcgtcactcctctgcgccggagcgctcggtttcttgcccggctcccatgccgccgcggtggcgcccggctacgtcgccgtctccgccgccagcttcgtgccgtcctcaacgtgcagctcccccgaccgagttccgccgcagcggcggaacggcacgtccgccgtgctgcggctgacgcacaggcacgggccgtgcgccccctcgcgggcgtcctcgctagcggccccgtcagtcgctgacactctgcgcgcggaccagcgccgggcggagtacatactgaggagggtgtcggggcgcgcgcctcagctgtgggactccaaggcggcggcgacggtgccggcgagctgggggtacgacatcggcacgctcaacta

SEQ ID NO: 10362 - DNA, 431 bp, Zea mays
  unsure at all n locations
  Clone ID: LIB148-008-Q1-E1-H2
aacaaggctaccctaggtggcctatcggcgattctcgtcgtggcggtggtcctccgtgtggtcgccaacgtcaaccgctccggcaagaaaggcggcgacaacttcacggtcccgggggaagcttcccttgccacgtccggcaagtcggtcaagtccctgtgcgcgcccaacctatacaaggagtcctgcgaaaagacactgtcccaagccaacaatgggaacgagaaacccaaggaagtgttccacagcgtgggcaaagtggcgctggaatccgtccagacggggtccaacagtccaagtcgatcggcgaggccaagggcagcgactccatgaccganagcgcgcgcgaggactgcaagaagctcctggaggacgccgccgacgacctgaggggcatgctcgagatggccggcggcgacatcaaggtgctg

SEQ ID NO: 10363 - DNA, 426 bp, Zea mays
  Clone ID: LIB148-008-Q1-E1-G10
acccacgcgtccgccttcccctgctcctcgagcacctcaacgagcttctgctccgacgacgacgacgtgccgccacatccacatggcggacgacgccgtcgccggcggagcggccgttcgctgcgcagggccggcgccggcctcgctgtcttctagcaggaagcagcatcagcagcccgacgacgccggctgcggcagcagcgacgaccactaccagcacgacgtgataatgctgaggcggtcgaggagcgggcgggcgttcgcgccgccgatctccgtgatcggcaagggcgggcggccgtggctctgcctgcgggcgcaccgcgagggtggacgcctcgtgctgcggcatatgcgcctgccgtcgcatgagctgctgcagccctgcaaggaggacggcaggttcaagctcctcatgcacccggg

SEQ ID NO: 10364 - DNA, 433 bp, Zea mays
  unsure at all n locations
  Clone ID: LIB148-008-Q1-E1-E4
acatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcncagcagtccaacctggtgctgtacggcaggatccagtgcaagggcaagtgcaccgaacaagaaggcatcancgcgccggccatgaaggtctgccangaggagtgcgacaaggcgtacgtggtgaaggcggccgaggtcaccaaggcctgcagcgtcacctgcgccaa

SEQ ID NO: 10365 - DNA, 425 bp, Zea mays
  Clone ID: LIB148-008-Q1-E1-E6
ggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgt

SEQ ID NO: 10366 - DNA, 365 bp, Zea mays
  Clone ID: LIB148-008-Q1-E1-E7
agtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtccatgtctaccgcaggacactcaagtctgatggtattgctggggctttaccgtggatttaacatct

SEQ ID NO: 10367 - DNA, 423 bp, Zea mays
  Clone ID: LIB148-008-Q1-E1-E8
acacggtcgacgaaccgtggtgttggaggatggcgtgcaatgggacagggtgagggcaccgcctgttgacacccttgcgcatgacctgcacacctctgactgcctgcatgagctccggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcgttggtgaagcggaaggagcataaggaggagggcaacgagggcgacgggttctacggcggcataaggaagctccgcggcaaggatgacatctccaagtggaggcagctgtggccaacagacgt

SEQ ID NO: 10368 - DNA, 426 bp, Zea mays
  unsure at all n locations
  Clone ID: LIB148-008-Q1-E1-E9
acaccgccacacactagtcggggaaaacgatcgaacgagcacaggcacgcacgcaccatggcccgcgctctcgccctcgcctccttcctcctcgtcgcctccgccaccgtggctttcgccgcggaggccccggcagcctcgccgaagcattcggcctccacgccgtcaaaggcgcccagcagttcgcccgacaagtccgagaaggcccccacggcgtcggctgagaatgctgcagagacgccgaaggcaaccccggccaaggccccggcggcggcctccaagtcagaggcatcgccttccgaggcgcccgactccgggtccagcgctgcgtcacctactagcgagagcgccgcgtcagagaaggcccccgccggtgcccccaaggactcgtcggccagcccttccgcgtcnccgtccgaagatgaa

SEQ ID NO: 10369 - DNA, 376 bp, Zea mays
  unsure at all n locations
  Clone ID: LIB148-008-Q1-E1-F1
agtcgtcgagcccatcctgctcgaggtcgaccagatctaccacctcgcctgccccgcgtcncccgtccactacaaatacaaccccatcaaaacaatcaagaccaatgtggttgggactctgaacatgcttggattggcaaagaggatcaatgctaggttcctcctcaccagtaccagtgaggtctatggtgatcccctccagcacccgcaggtggagacttactggggcaatgtcaatcccatcggtgtcaggagctgttacgatgagggcaagcgtacagccgaaacgttgaccatggattaccaccgtggtgccaaccttgaggttaggatcgcacgtatcttcaacacatatggccctcgcatgtgcattgac

SEQ ID NO: 10370 - DNA, 419 bp, Zea mays
  Clone ID: LIB148-008-Q1-E1-F10
acctcgtcccaccctccctccctcatacaaataataacagaaaggtcccgcccttttcctccgacatccacatggggggaggggaaaacacttacattcacccggcggaactaatggcctccgttccggctccggcgactacaaccgccgccgtcatcctatgcctatgcgtcgtcctctcctgtgccgcggctgatcacccgaacctccccgactacgtcatccagggccgcgtgtactgccacacctgtcgtgccgggttcgtgactaacgtcacctagtacatctcggactccaatgtgaggctggagtgcaagcacttcggcaccggcagactcgaccgcgccatcgactgggtcacccacgctaccggcaactacactatcgagctcaaggacagccacgatgatggacatctg

SEQ ID NO: 10371 - DNA, 423 bp, Zea mays
  Clone ID: LIB148-008-Q1-E1-F11
aaggcaagggcgcaaccaataatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtaccttaatttgggtctgaacatgtc

SEQ ID NO: 10372 - DNA, 402 bp, Zea mays
  Clone ID: LIB148-008-Q1-E1-F12
atccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggataacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcaagatgaagtgtgccaagaggcgtgcgacaaagactacgtggtcaaggcggctgaaggtcacaaggcct

SEQ ID NO: 10373 - DNA, 425 bp, Zea mays
  Clone ID: LIB148-008-Q1-E1-F2
acggcgttcaccgagttcaagaccgatgacatggccaacatcatgaaggacttcgacgagccagggcacctcgcgccgacatgcctgttcctcgggcctaacaagtacatggtcatccaacgcgagcctggtgccgtcatccgtggcaagaatggatcaggaagcatcaccgtgaagaagacagggcatgcactcgtggttggtatctacgatgagccgatgacgcctgcgcagtgcaccatggtggtggaaaagctgtgcgactacctggcttaacaagggatgtaactactacgtagcagctggcatgcatgtcgacgaccatggttttcaatttcgacttccaataatactgacaacaaagcaataggcttcctcccggcgtaattgctttggctcttctcctccacgcgataggatatcta

SEQ ID NO: 10374 - DNA, 419 bp, Zea mays
  Clone ID: LIB148-008-Q1-E1-F3
actatcaccattaattcatcctctgaccaaaggctacatggtcctctaccgcaactatttctgcaaacatcgagctgatctcggagcccggagctgcaatctgacaacagtgcgtgtcgcaacaggagatcgggtcaccggaatcgatagaaaggacgattagactatggtgccccgaattaccaatcgaattacacgccacagatcgcggcttgggatttgggacgtccccaaatcagaaccccggacttagcggcacagggccagggatgaaaacggtcggaaacggtatttattcggtaatcagttttttagtcgtttttctttgattgcgaataaatagaatatagaatctatcatacaaatttgtattcctgtttttaacattcagtttgtaaagattcataaaagataaacct

SEQ ID NO: 10375 - DNA, 251 bp, Zea mays
  Clone ID: LIB148-008-Q1-E1-F4
accaacgcatgcaagtggaaggcagcaacaaccgcctgatgggcctccaactcagcagcagccacagcagccaattcagaactgaagtcctgtcaaaatgttgggtattggtactgctccaactgctcggcaggagaatgcaaccccgtgggtcaccagccttccgtatttcttaatttgtggttaacagtaaaaactttgttgtattgcgtatcaacgtttgaagaaaaaccgtgagatataccggatgt

SEQ ID NO: 10376 - DNA, 416 bp, Zea mays
  Clone ID: LIB148-008-Q1-E1-F5
agctggtcctcgaggccatggattgcgtcctcatcgagatcttccaggtgtacggcgagatatgcaccggcatcgcgcggttcctcatcagcggcgttcagggcggaccggcgatgctgacgacccgcaaggaggtcatggcggcaggggtgaaggtgctctggcgggcggcggagcagagcgctcagctctcgtcctacttcgacctgtgccgcgagctcggcgtggccaacgcgcgcaagctcccgacatcattagttcgcttgaaagacgacgacgtccgggacctcgagcggatcctcatgagtgagagtgacatccagaacgaaagcggtgaggaggcggaggcggaggcagaggcagaggcagaggcggcggcggacgtgaaggacgcggggtcaacgtcgacgaacact

SEQ ID NO: 10377 - DNA, 427 bp, Zea mays
  Clone ID: LIB148-008-Q1-E1-F8
acagattgctgtcagctctaaaggttttctcgctgctgcagatgatagtggggatgttaagattgtcaataccattcagaaatgcctgtataaaagattaagggaagcccacacaagtatttgcagcagcgtgcaattcattccttggagaccttggacagcaattactgggggccttgactcaaagctggctgcatgggatttctccaaaggacgaacactgttttctattgattatggatcacctgaattgcaaaacggcagttcttccggtagtgcagggcaatgtttcaaccctgcttttgttcattccgtagcagtttctgaagaggatattttgggagggctctacaaggtttgtgctgttgcaaggggggatggtgctgttgatgtggttgatcttgagtatgaactggcccctgcgaaa

SEQ ID NO: 10378 - DNA, 420 bp, Zea mays
  Clone ID: LIB148-008-Q1-E1-F9
agtcaactcgttgctgggggcgggatcccggccgagcaccatgcgaggaaataacatgccgcggcacacgtcgccgttactttttgccttgttggcgaccctgctcagcgtcggcgacgcgttggtcgtcgacggcctgcaggtggggttctatggaaagacgtgcccggcggccgaaggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggt

SEQ ID NO: 10379 - DNA, 422 bp, Zea mays
  Clone ID: LIB148-008-Q1-E1-G1
aggcgctcgaccggtggatttccaacgccaacgggctaatccgtctccaaacaagttccgctccgggaactcctccgggttcccctcctccccaacaactccaacaaccggaatgaacctcagctcaagcctcactccggttcggtttcaacaaaatctccaaaactgagcatgattcccggtggtctgcctcatggaaatgggtgctcaacagcaagcactacaccactaaggtcatatcggcagtcatcgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcg

SEQ ID NO: 10380 - DNA, 201 bp, Zea mays
  Clone ID: LIB148-008-Q1-E1-E3
catccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtctcccacgtcatctcatccctgacggcttcactgaagttctatg

SEQ ID NO: 10381 - DNA, 418 bp, Zea mays
  Clone ID: LIB148-008-Q1-E1-D1
aggttaggaaggcggcggccagcggcgagagcgcgagaggaagagcaggaggaggggtcggccatgacggggaatgcgaagccgaagaagcacacggcgaaggagatcgccgcgaagatcgacgcggcgacgacgaaccggggcggcggcaaggccgggcaagcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactcctccgcccccgctgctgccgccgccgccggcggcggcggccgccgccgccgacgccaacaactccaagcccaaagcccggcggtccgcggcagcctcaaag

SEQ ID NO: 10382 - DNA, 380 bp, Zea mays
  Clone ID: LIB148-008-Q1-E1-D10
gacccaagcgtccacagagactccatggacgatcaggagaacgagcacgacaagcatgctgatgctgggactgacgtcgacgaagaagaggatgacgaagatggccacaagcgtgtcgtcgttcttggactccacgtccgcctcaaggaacagctcaagcttgacaaggatgatgagagcctgatgaggtggaaggagcagctcctcgggcaactcgacaccgagcagctcggagagactgcggcgccggatgtgaaggtgctcaacctgaccatcctgtcaccggggcggccagatctagtgccatcgatcccgttcgaggtctacgacaatggctatgcgtttacgctcaatgatggcagcctctatagcttccgttt

SEQ ID NO: 10383 - DNA, 423 bp, Zea mays
  Clone ID: LIB148-008-Q1-E1-D11
acgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgct

SEQ ID NO: 10384 - DNA, 411 bp, Zea mays
  Clone ID: LIB148-008-Q1-E1-D12
agccgggccgaggccatgatcgatgcagggaggaggatgctgccgctgctctggcctaatcactagtataaagcaggcggagacagccggcccctctggcctcgctgctcccccttcctccccgtccccacccacatgccctgcctccgccccgccccgccctgcccaagctgagttcccccaccccccaacaaacaattactagagtagctgcattggcggggaaattaaagcgctagaagctcagcagcaatggcggagcatgcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgac

SEQ ID NO: 10385 - DNA, 148 bp, Zea mays
  Clone ID: LIB148-008-Q1-E1-D2
aacatgcatcgggaccgtctatgggtgtgtgtgtcaaaagcatgtggacgtctttgtgggcacaggttgcgatggttatggcgttggagtacttggtgaaaaggtcattgtgaggacctcccaatctcccaccaggcataaacatcac

SEQ ID NO: 10386 - DNA, 279 bp, Zea mays
  Clone ID: LIB148-008-Q1-E1-D3
aactcatcgcctcctccatttgacaacaatttaacctccccgagcgccacatctattaggtgcagccatgggtgcctgtgcaacgaatcctaagacgcttgatgggaaagccccacctgaggccaccatctccacacccaaagttgcacctgagaccactaccatccacattgacgttgcggcaaaacatgcagtaattgagaacgtggatgacgacaacgatgaggcaccaacagtggctgcgaaacaagagccagcagccaccattgaacctcaacc

SEQ ID NO: 10387 - DNA, 330 bp, Zea mays
  Clone ID: LIB148-008-Q1-E1-D4
gatgggattcctcgccaataacatcatggtcgtgggcgccgtccttgccgcgcttgtcgtccgcgggtcatgcgggccccccaaagtgcagcccgggatcagcatcaccaccaactacaacggcaagtggctcaccgccagcgccacatggtactgtcaacccaactgtgcatgcgctcctgacaactgctgtgcgtgcgggatcaacaacgtgaatctgccagcctacaccatgatcatcgcatgcggcaacttccccatcttcaatgacggcaatggctgtggctcatgctacgaagtgagatgcaaggaaaaacctgactgctcggg

SEQ ID NO: 10388 - DNA, 403 bp, Zea mays
  Clone ID: LIB148-008-Q1-E1-D5
acccacgcgtccgctgcattcatctcctccaccaccaccaccaagctcaacaacagccagctcgcgaaaatattgaaagccgcaacatggcatcatccggcgcgccccttggggtacccttcccccaattgggggcaacggcccaaaaggtaccgtaggcaaagagaagaaaaccggcggcaaccgctaaggcggcgaaggcaaaaatattcaggacgacttctgctcgacgctgttcaaaggcatgaaggggacggacctggtcctgtgcaaagagtcctgcgcgctctcccagcactccaacctggtgctgtacggcaggattcagtgcaagggcaagtgcaccgagcagaagggcatcacggcgccggccatgaaggtctgccaggaggattgcgacaag

SEQ ID NO: 10389 - DNA, 426 bp, Zea mays
  Clone ID: LIB148-008-Q1-E1-D6
gaagaatctagaaggaggagcaacctccggagccaaggcggcgagggggcgaagcggctgtcctgggggcacaagagcatgcagctgcaggacacgaaccagagccacgtgcacgccgaggaatcgctgcccgttgtggccaaaagcggcgcggcggtggcgaggaacgacggcgactcgcggctgctcgtcgacctggagcccgtgccggcgatcagattcagcaagcggcacggcgacgacggcgccggcgaccacgcgccgccgtacgccaagaccttgtccagcagcttcaaggagccggcccgtgtcgcggaccgccgccctctctccggccccgggcagctcgccgcgtccaccggtttcgcctgggccaagaagccccggtccgtcgccaggtcttcgacggcggcagccgccgtcaca

SEQ ID NO: 10390 - DNA, 419 bp, Zea mays
  Clone ID: LIB148-008-Q1-E1-D7
acagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattagggtggacacgtaattggctgtgctgtaatcgctctcgtctggtggggaaggaagga

SEQ ID NO: 10391 - DNA, 394 bp, Zea mays
  Clone ID: LIB148-008-Q1-E1-D8
aagccccgtccagcccccaactccagcactccagaagctccccctgatccgacgtcgtggtggccgacggctggatccctccacccccgcgcgcagatgcccctcgcgccgcggtcctcctcgtcggcgaaccggcacagggaagcaccaccgcctccgacgcctagaaattctggagcgtagcagggtaccgtaccgcgcgtcggcgagctctgtttgcggcgtttggtactgaagatgaagaagtccgactgatggtttcttataataatatgcatccaagacatcgtacgttacagtctcccatgatctgtgtatgtaacgtggatatacaattgaatatgtggaggactgtgcgacatgcgttgaagtcggagggaggattgtatgctgt

SEQ ID NO: 10392 - DNA, 418 bp, Zea mays
  Clone ID: LIB148-008-Q1-E1-D9
ccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgct

SEQ ID NO: 10393 - DNA, 75 bp, Zea mays
  Clone ID: LIB148-008-Q1-E1-E1
ttgcctctcgctggcgtcgtgtaactcgctgccttctgcggcttctcttgcgccaggatgccttggtcccgttgc

SEQ ID NO: 10394 - DNA, 422 bp, Zea mays
  Clone ID: LIB148-008-Q1-E1-E10
aagtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggacaagaagaaggtcacgtacgtggtggaccccagcggcaacggcgactacaccagcatcaccgcggcgctggaggatatcccggtgagcaacaccaagcgcgtgatcctggatctcaagcgcggcgctcagttccgccagaagctgttcctgaacatcagcaagccgttcatc

SEQ ID NO: 10395 - DNA, 424 bp, Zea mays
  Clone ID: LIB148-008-Q1-E1-E11
agcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatcaccgaggcatccggattcatgttcgcaggcatcgccctgc

SEQ ID NO: 10396 - DNA, 419 bp, Zea mays
  Clone ID: LIB148-008-Q1-E1-E12
aggcatggtctctctcgtcccggcagtcccgtctcaagcaaaagctctctcctcttcttccgctcagtgcaccaatcactgcaacatactggcctgaggtcattgagttggtgaaagggaaggagggggtatcatgggcatctcatccaagtggattaaatccttggttggcataaggaagcaagaaaaagcgcagaatgcagaaaagcaagaaaaagggtggaacgctgagagcagtgaaactaagagctctgctaatcaatcactgcacaaacggaaacattctttggatcccggagctgcacttgcagtcgaagaaattacagtacaaagtgaagcattgactgataacaaaagcgcacaaatggtttcaaattcatttttttcagacagtacaccgcttgatgtgcacatttctc

SEQ ID NO: 10397 - DNA, 397 bp, Zea mays
  Clone ID: LIB148-008-Q1-E1-E2
cgtacattcacccggcggcaataatggcctcggttccggctccggcgacgacgaccgccgccgtcatcctatgcctatgcgtcgtcctctcctgtgccgcggctgacgacccgaacctccccgactacgtcctccaaggccgcgtgtactgcgacacctgccgcgccgggttcgtgaccaacgtcacccaatacatcgcgggcgccaaggtgaggctggagttgcagcacttcgggcacggcaagctcgagcgcgccatcgacggtgtcaccgacgcgactgggcactacacgatggagctcaatgacagccactacgatgacatctgccaggtggtgctggttggccacccgcgcaaggactgcgacgaggtccaggcgcttcaggaccgcgccgg

SEQ ID NO: 10398 - DNA, 419 bp, Zea mays
  Clone ID: LIB148-008-Q1-E1-C9
aaaagatcagatactgtgatggttcatcatttactggtgacgttgaggctgtggacactgcgaaagatctccgttacagagggttcagagtctggcgtgccgtcatcgatgatctacttactgtgaggggaatgagcaaggcgcaaaatgctcttctttctggatgctcagccggaggtctagcagcaatactacactgtgacagattccatgatctgtttccagcgaaaacaaaggtcaagtgtttttctgatgctggatattttttcgatgggaaggatatctccgggaacttttacgctaggtcaatctataagagcgttgtgaatctacatggatcagccaaaaatttaccagcttcatgtacctcaaagccaaagcaatcacctgagctgtgtatgttccacagtatgttgtcc

SEQ ID NO: 10399 - DNA, 372 bp, Zea mays
  Clone ID: LIB148-008-Q1-E1-B3
tgctgcagctcgtcgtcgcgggcttccgcgccgtcgtcatcgacaagctcaacaagtcgtccgagctggccgtccgccgcgtcgccgcgctcgcaggggaggactcacgcaacctctctttccacaagattgatgtccgtgacaagggatcactggaaatggtttttgcttctacaacatttgaagctgtcattcacttcgctggattgaaagctgtgggtgaaagcatacagaagccattactttattatgacgacaacgtcattggcacgataaatcttctagaagttatgtctgttcacggttgcaagaagttggtgttctcatcatcagctgcagtttatggatcacccaaaaactcaccctgcacag

SEQ ID NO: 10400 - DNA, 72 bp, Zea mays
  unsure at all n locations
  Clone ID: LIB148-008-Q1-E1-B4
agggtgccctcttcgccggtggccggaaggcgatggggaagccngaggacgctgagggcgggcgaaggctcc

SEQ ID NO: 10401 - DNA, 236 bp, Zea mays
  Clone ID: LIB148-008-Q1-E1-B5
cgaaagaagtcgcctaatgctttcaatcgaattacgtgccttcttcgtcacaggctccgtccttatttgtagattgaagcttacatgaacatttgactagatcatcgaaggattggtaggcctctttaaagttggggtcgtgaagggcaataaacttgcctagcggtattcaagatggagcgattcgtagttcgtcctaggacttggggagaagaagtttaacaagaacgtgaaga

SEQ ID NO: 10402 - DNA, 248 bp, Zea mays
  Clone ID: LIB148-008-Q1-E1-B6
aagcagaccaacccggacggggcctgcattcctaacctttgcagctgagcaagggagacgtttggaaagcaaaaaagaaagaaaatacggtgctgtttggctggcttgtctcaaaattgccacgttatgctttcatcatagtgtctgccgttgaaatgttgtagtagtaaaatcgtagggtgtaaaatgttttcttgtaaagtcattgtgtataccaaccaaattcaagaaagcttacaagttggccc

SEQ ID NO: 10403 - DNA, 386 bp, Zea mays
  unsure at all n locations
  Clone ID: LIB148-008-Q1-E1-B7
acccgccgcttccccttcttcattcccgtcccacacacgccgccgccgccggtgccgctccgctctcgtcccccccggtccgcnccggcctgcttgccggaaccaggttggcagggcactccggcaaccacttggttgggaaggcaacgacaccaccctatgctctgtcctcgcccgcagattaagattgcaccaccagtgaatttggaaccttgaagcattcatctgagacatggaaaaagtgatctgctgggcatatctccttcaacgcaagcagttctcgaaagaaactcttgattgctgtgtcttagctcgtgggaacactcctctctcctctctcgtgaactacacatagtggttatatgttcctctatgctcaacaacaa

SEQ ID NO: 10404 - DNA, 423 bp, Zea mays
  Clone ID: LIB148-008-Q1-E1-B8
acccacgcgtccgcctggctgtacctggcgacgaggcggcaggtgtacgcggacttcatcgcccacgaggccatctcgtcgagcgtggccgagttcagctgggacctcaagttcccgggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccggttgcacgagttcgcgcggcagcagatggactac

SEQ ID NO: 10405 - DNA, 342 bp, Zea mays
  Clone ID: LIB148-008-Q1-E1-B9
acaaaaaaatcaaaaaaaaagataaaaaaaaaaaaagaaaaaaaaaaaaaaaaaaaaaaaacaaacaaaaaagaagacacgtcaaacgtggggaggattcacatggggcttcaagttcccgtgcgcgcaagtgctgctggacgagttcaccatgacgtcagctggctgcacttacaaggtcatctcttaagcgggcaacttctggtacaccgtggtggtggccaaagttttccaccatgtgttaaacaccccttgcggcatgagtcatcttcgcaacggggccaactcgcattacctttccaacattttgttcctgctggtggtgtacggggacctgctgct

SEQ ID NO: 10406 - DNA, 380 bp, Zea mays
  unsure at all n locations
  Clone ID: LIB148-008-Q1-E1-C1
aaccacgcgtacgcgatcacgacangatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggcgacttccttgtcggacaactcaacttcacaggcccttgcaagggcgacgtgacaatccaggtggatggcaatctgctggcaaccacggacctaagccagtacaaggaccat

SEQ ID NO: 10407 - DNA, 400 bp, Zea mays
  Clone ID: LIB148-008-Q1-E1-C10
acgccgagctcatctactccgtcctcgacgtcgtgcgcaaggaggccgagaactgcgactgcctccaagggttccaagtatgccactccctgggtggcggcactggttctggcatgggcacgctgctcatttccaagatccgggaggagtacccggaccgcatgatgctcaccttctccgtgttcccgtcgcccaaggtgtccgacaccgtcgtggagccctacaacgccacgctgtccgtgcaccagctcgtggagaacgccgacgagtgcatggtccttgacaactatgcgctctatgatatttgcttccgcaccctcaagctcaccaacccttcatttggtgacctgaaccatctgatctcggcgaccatgagcggcgtgacatgctgcctgcggtt

SEQ ID NO: 10408 - DNA, 340 bp, Zea mays
  Clone ID: LIB148-008-Q1-E1-C11
gacaccactgacggcggcgcgtgcggctacaaaggcgagctggggaaagactacggcaccctgacggcggccgtgggcccgtcgctgtacaccaacggcaccgggtgcggcgcgtgctatgatctcaagggccccaagggcaccgtggtggtgacggccaccaacgaagccccgccgccggtgagcgggcaaaagggcgagcacttcgacctcaccataccggcgttcctcaagatcgccgaagagaacgccggcatcgtgcccatcacctaccgcaacgtggcgtgcgaaaggaaaggcggcatccggtacacgatcacggggaaacagcactacagcc

SEQ ID NO: 10409 - DNA, 295 bp, Zea mays
  Clone ID: LIB148-008-Q1-E1-C12
atgcaagcctctagcatgacgtcgaggtaaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcg

SEQ ID NO: 10410 - DNA, 276 bp, Zea mays
  Clone ID: LIB148-008-Q1-E1-C2
ccatcctattagaccgtctccgacagtttactcacccctcttagtcgattgttatttaagtgcagtctcttcggagatgcaattacagtccatcctctctttcttttcccctttctcaaagagctaggaccttgctcgactgagcatcaggctgtacggctctttgtgatcatcttttgccagttttcttcttgtagcacaagttgttgggcatggaactcctgttcctttcaccaatagaagcataatgatcagcactgtgaaacaagaaccgaa

SEQ ID NO: 10411 - DNA, 321 bp, Zea mays
  unsure at all n locations
  Clone ID: LIB148-008-Q1-E1-C3
gagcgatcgagagatanatatagatgatgaaagtgggatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcangaaggggatggacctggtggtgtgcaaggagtcctgcgacctctcacagcgctccaacctggtgctgtacggccggattcagtgcaagggcaagtgcaccgagcagaacggcatcaccgcgccgcagatgaaagtgt

SEQ ID NO: 10412 - DNA, 230 bp, Zea mays
  Clone ID: LIB148-008-Q1-E1-C4
gtggaggtggaggatacacaccgggggcgccacgacgaacgccacgccgaggtcgtttccgagaagattatactggaggacgcgccggcagttcttgcggataccgctggcaccccccgcaccacggaggtggaggtggagtccctcaggaaaggagcggcgccggttccagtactcatcctcgttggcgccgcagtggacgacgtggtggccgacaacgttcctggccg

SEQ ID NO: 10413 - DNA, 402 bp, Zea mays
  Clone ID: LIB148-008-Q1-E1-C5
cttgaaatctcgccctcgttgcggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcaccaggtggtggtggacaggctaggggagccaggcgagagctacgacgccttcacggcctgcttccccgccaacgagtgccgctacgccgtgttcaattttgacttcgtcactgacgagatctgccagaagagcaatatcttctttacctcttgggccccggatacatc

SEQ ID NO: 10414 - DNA, 409 bp, Zea mays
  Clone ID: LIB148-008-Q1-E1-C6
accggtcccggagctggtccttcgtggagcggcccggctcgctgctggtgatcgccttcctggcggcgcagctggtggcgacgtgcatcaccgtgtacaccaactgggagttctgcaagatgcagggcatctgttggagctggggcggcgccatctgggcgttcagcgtcgtcacctacttcccgctggacgtgctcaagttcgccatccgctacgcgctctccggaaaggcctgtcacaacatcaacaacaacacggacttcaccaaccgcaccgactacagcaacggcgaacgataggcgcagtgggccatggcacagatgacgctgcatgggctcaaccaggccaccgctacctccgacctcttcggcgacaaccagcgctaccgcgagctgtcggatctcgccga

SEQ ID NO: 10415 - DNA, 410 bp, Zea mays
  unsure at all n locations
  Clone ID: LIB148-008-Q1-E1-C7
acccacgcgtccggaacatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctaacgacactgcatggcgtcgctgggcgccgacccgcgcagcaaggaggccggcaacangaacatgcacgggctggcggtgctggccacaggatggccatcgnacacgccccgcagcacg

SEQ ID NO: 10416 - DNA, 314 bp, Zea mays
  unsure at all n locations
  Clone ID: LIB148-008-Q1-E1-B2
accacgcgaccgcccacgcgtccgcacattcaagcacctcctcctcccccgccggccaacaactcagccgccgcaaccgccacatcagccatgggcgcctgcgcaaccaagcccaagacgcttgaggggcangccccagctgaggccgccgtctccacacccaaaggttgcgcccgaggccactccaatctccgttgaggttgcggctgatgaacaggtagctganaaggtggtggtggaggagccggctgcggcggccgacgttgaacatcagaaggctaatgaggtggtcgctccagaggcggccgtcgccg

SEQ ID NO: 10417 - DNA, 410 bp, Zea mays
  Clone ID: LIB148-008-Q1-E1-C8
acccatccctcgggcagatacaaccgcactaagtaactgcgccgaagatgaccagttccagcaacagtaacagcacccggcatgtgatgctggtactgctcggtctccgcctgctgcttctggttggtgttgcgcacgcggtagtggacttggtgcctgctgataataatatcaccgccgccgctgctggcacggcggtggacgatagcgagccgcctcactactgcacgaccccggtgagcgtggaggacgcgtgccgcggcgcgtccgagacgcactccggcgtgggctacgaccactgcatggcgtcactggacgcctacccgctcagcaaggaggccgagacacgaacatgcacaggctggcggtgctggccaccacgatggccatccatcacgccgccagcaacg

SEQ ID NO: 10418 - DNA, 378 bp, Zea mays
  Clone ID: LIB148-007-Q1-E1-H5
gcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtaccaaaaaaaaaaaaaaaaaaaaaaaaaagaaaaaaaaaaaacaggaacaaataaaaagaaaaaaaaaactacagggagaaaaaataaaaaaaaaaaggggcggccg

SEQ ID NO: 10419 - DNA, 405 bp, Zea mays
  Clone ID: LIB148-007-Q1-E1-H6
acccacgcgtccgcccacgcgtccgcagcacgaaggctgtgcaggaggcatgggcatcagcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggacgtgtccgggatcacgctgctcaact

SEQ ID NO: 10420 - DNA, 421 bp, Zea mays
  Clone ID: LIB148-007-Q1-E1-H7
acggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaag

SEQ ID NO: 10421 - DNA, 350 bp, Zea mays
  Clone ID: LIB148-007-Q1-E1-H9
ggcgcgtgcgtgcgttcgtgcatccaccgccacgcttctgggcaccatgtctttcaccggcacgcacgccacgtgtccggcgtgcgactggaccgtccacgtcatcgccgtcttcatggccgtcggttgcatctaccatatcggatgcttcaagtgcagctaatgcatcggggtcctctcgatgtgcaggtcctcctccatggacggtgtgctgtactgcacgacctagttcgatcagctcttcaaagagactgggaccttctcctacaccttcacgccatctgccatgtcaatagatgacggtgaagtgacatggtgctcaaccaatctgtcgtctgcattttctggtt

SEQ ID NO: 10422 - DNA, 83 bp, Zea mays
  Clone ID: LIB148-008-Q1-E1-A1
agtacgtcaccgttcccaagaacatggccaacatcttcatgtacggcgacgggccgacacagacggtggtcaccggcgacaag

SEQ ID NO: 10423 - DNA, 424 bp, Zea mays
  Clone ID: LIB148-008-Q1-E1-A11
aagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgagga

SEQ ID NO: 10424 - DNA, 386 bp, Zea mays
  unsure at all n locations
  Clone ID: LIB148-008-Q1-E1-A2
ccacgcgtccgacttcgtaaacaaccgggaagtgtccggggtcacgccgctcaactccaagttcctccacatgaacatgttacggtgcaaggacatgctgattaaggactttaccgttacggcgcccggggacagccccaacacggatggcatccacattggcgattcatccgggatcaccatcaccaacaccgtcatttgcgtccagcactactgcatctccatcaggcccgggaactccaatgtgaacatcaccggcgtgacctgtggccctggccactgtatcagcatcggcagcctaaggcggtacacngacgagaaggacgtcacagacatcaacgtcaaggattgcactcttaagaagactatgttcggcgtccgcatca

SEQ ID NO: 10425 - DNA, 301 bp, Zea mays
  Clone ID: LIB148-008-Q1-E1-A3
aacatggccaagctccgcgcccccggtcaggccaagctgtagatggatcatcggagtatgtgttcgggccttcggggtgccactgccactgtgccaggccgcgccgtttcgctgtgcgcgtgctcccctcatcatcttgtcacccaagtcattttttttctcactgtctctttcgtttgtgcaagaagggacgagcaaagtacccaccgcagcggattactaaattgtctaattacgcagttgtcgtgtcgagtttactaaagatgaccacaggtaccttatgggtgtccccggtcggtca

SEQ ID NO: 10426 - DNA, 455 bp, Zea mays
  Clone ID: LIB148-008-Q1-E1-A4
gtacgctcgagaatcccaggtccaaccaagcctccgagaacaataacccaatagaaccatttaataaattcaagaatttggataaattaataaatccaaacaacggtgggttcaaggtggacccaaccaaggccaacggcaatccatccaaaaacccaacggcaacgctggtcaggcccctttggccctccaatggggggcgatcacaatctgcaactgccaaggccgccttcaatcgggaaaaatcccgttgccggagaagaagtccctgttcctcaacgccgccagcgcgtcgccccgggcactaccagcagcaacaaggcggcgcctcctcgcacgaagcgcccgccgtgagcgtcacgccgcggacggccacgaataagcagcagctgcacctgccggcgagcccccgggcgtgcctctgctcaccaaccgtgcacgccggctcgttccgg

SEQ ID NO: 10427 - DNA, 413 bp, Zea mays
  Clone ID: LIB148-008-Q1-E1-A5
gagcgatctcctctccctctccctctccgatccattctccagcgcagcgaagttaacatgtccgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaggtacatggtcatccaaggcgagcctggtgccgtcatccgtggcaagaacggatcaggaggcatcaccgtgaagaagacagggcaggcactcgtggttggcatctacgacgagccgatgacgcctgg

SEQ ID NO: 10428 - DNA, 421 bp, Zea mays
  Clone ID: LIB148-008-Q1-E1-A6
atcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtcccccaccagcggctcctccgcggtcgcacccgccatcgtcggggccgccgtggcctccttcttcgcgtactacattcactgagccgccggacgaggagccggactgccggagggaagagaccaagggggggagagacttggctgcgctgcgctgctctgctgctcccgcgcattcccgatgcgtgggtgggtgtgctctgattgggcacggcagtggcacaccttcgtcttccttttgtttgtttttttc

SEQ ID NO: 10429 - DNA, 418 bp, Zea mays
  Clone ID: LIB148-008-Q1-E1-A7
atgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccgccgaactggagacccgatgccgtctacacttccaacgtccaattctactagactttgaattcccttcgattcatccggcgcggtgggctatggacctgcagcagcaagctaattaagtttatatatattgcatgagagagcatgcac

SEQ ID NO: 10430 - DNA, 396 bp, Zea mays
  Clone ID: LIB148-008-Q1-E1-A8
aagacacgatttcttcatctgtttctgcttgttaaaaccagtcccagcttacaccaaggtcttgctttcacttgaaggcgtgataccaagatccctactgctcaaagaatgtgcacagaacatggtgtaaaactaaaagcaaacaaaccaacattttttggcttacttatctcatctcaacctggatctccatctcctcgtctcccgaggctttacaagctgtacaggcgcagccgggatccggagccaccactcccgcaatctcctcaccagcttctcactgctcttcttcctcaccggcatctgtcttgtgtattcttctagaaggattagtagaacgatggtcctcaagggcacgaacgtgaatatcgcagccacagcaaccagtgcagctgc

SEQ ID NO: 10431 - DNA, 423 bp, Zea mays
  Clone ID: LIB148-008-Q1-E1-A9
agtacattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggataaggccagggaggccaagagccgggtggacgagttcgcggcgaggaaccacgagggccggccga

SEQ ID NO: 10432 - DNA, 141 bp, Zea mays
  Clone ID: LIB148-008-Q1-E1-B1
atgcacatttgagcacgacgatgggatccctcgctaataacatcatggtcgtgggcgccgtccttgcggcgcttgtcgtcggcgggtcctgcgggccccccaatgtgccgcccggccccaacatcaccacgaactataacg

SEQ ID NO: 10433 - DNA, 335 bp, Zea mays
  Clone ID: LIB148-007-Q1-E1-H4
gggcaaccgcaatttcctccgtcccccccctccgattctcccctggcccaaggaaaaggaaaaggaaaaggaaagaaaaaaaaccgcgccgtccgcccaaggaaaaaagcaaagatccggaaccactgaaccgcgctacgcgtggtcgtcgtccggagccacgcgtggcgccgcggcgatgggcaactgctgcgtgacccggccgttttctggcaagcggcgaagcggctcccgcggtggcgctggcgggaaccgttgcgggcgcctcggcggcgccaacgtgcggtcctgctccacgctgtcctccatctccgacgcggcgcgcaccgccgcga

SEQ ID NO: 10434 - DNA, 421 bp, Zea mays
  Clone ID: LIB148-008-Q1-E1-B10
aataacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccattcacggtgtacatcactgacatgaactacgagcctatcgctccctaccacttcgacttgagc

SEQ ID NO: 10435 - DNA, 413 bp, Zea mays
  unsure at all n locations
  Clone ID: LIB148-008-Q1-E1-B12
ctctacagaaactcgggccagcggcgggcaacaccgacctggtgaccgtcgtggggtcgacgccggagggcgagtggctgaacaccgtggtggaccgggacctgcggggcgaggaggaggaggacaaggaggagatggtgaagctgatcagggtcggcatggcgtgctgcgagagcaacgtggacaaccggtgggagctcaagaccgccatcgagaggatcgaggagctcaaggcgaaggagcgccccgacgaggagcaagcgacggtgatcgacgaggactacagcgatgttgccctcaactgatcatcgacacgaaccggccgggaatcgatcgatanggaaggttgtgcgcaagctgatgatatgagcccaaaatgtgatgacctgcatgcatgccgagaccctaaacat

SEQ ID NO: 10436 - DNA, 426 bp, Zea mays
  Clone ID: LIB148-007-Q1-E1-F9
cggacgcgtgggcggacgcgtgggatctacttggtacaccttcagcagagtctatctccaagataaggaatgagaaagctcgacgatacatgaacaatatgaggaaaaagcctcgggttccctttactaaaaagtttccagggatagatcctatggctctccatttgcttgaacgtcttcttgcttttgatcctaaggaacgaccaagtgctgctgaggccctggcagatccatactttaatggattagcaaataatgaacgtgaacccatagcacaacctatctcaaaacttgaatttgagtttgagaagcggaaactggccaaagatgatgtccgagaattgatttaccgagagattttggagtaccatcctcaaatgctacaagaatacctacaaggagcagaccacaatcagatgaccttca

SEQ ID NO: 10437 - DNA, 311 bp, Zea mays
  Clone ID: LIB148-007-Q1-E1-G1
atggcgtacgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgtt

SEQ ID NO: 10438 - DNA, 205 bp, Zea mays
  Clone ID: LIB148-007-Q1-E1-G10
aaccagcccacgacgcacgcctctcctgatccatctgatacgtccaggatgacgttcacccctgtcgtaacagttcccacacggatcgaccacgatcactttcgcaacacgcgacgaaagggaagggtggatcgaacttgcatccaacatcgatcccaaatggtgcttcgcacgtacatgccatatcaatacctatcttcgaccg

SEQ ID NO: 10439 - DNA, 434 bp, Zea mays
  Clone ID: LIB148-007-Q1-E1-G11
acccgcccgtccaggcacttcatatatttcttgacagaatgtttcatcctgttgttgctgtggtattgtcagtgacatttgttcttgcctttggagaggttataccgcaagcaatctgtaccagatatggcctagcagtgggtgctaactttgtatggctcgtacgcattctcatggtcatttgctatccaatttcttaccctattgggaaggtcctggactgtgctcttgggcacaatgagtctgcactttttaggcgagctcagttgaaagctctagtttcaatccatggcaaagaggctggcaagggcggagagcttacccatgatgagactacaatcataagtggagccttggacctgaccgaaaagactgctgcagaagctatgacacctattgagtcaactttctcactagatgtggattctaagttg

SEQ ID NO: 10440 - DNA, 425 bp, Zea mays
  unsure at all n locations
  Clone ID: LIB148-007-Q1-E1-G12
gacccacgcgtccacaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtaatcggttggattccgtntatatatatatttaagtactttaaattgggtctgaacatgtcaattggatcattc

SEQ ID NO: 10441 - DNA, 413 bp, Zea mays
  Clone ID: LIB148-007-Q1-E1-G3
atcgagatttcgttatcctcctcgatcttaattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatg

SEQ ID NO: 10442 - DNA, 318 bp, Zea mays
  Clone ID: LIB148-007-Q1-E1-G5
actcaaagttgaagcatgtggcaggtcttgatgcgctgcagcacctcagacttgtctttcctccgtccaccgagacattttatttcgaagagctaataattttccggagcgttgccttcccacggtggctggaaccacaggatcaaaagtgcaaaaggccgcgacaggttgaattgcaatgtggtctgtcacagtgcacaggacctgcctcaagggtggaaaaatgtgaaatctcgtgcagcatatccccgaggtgcgcatcataatctgcaagggaaagagatactttcggtaaaacaagacccgcggaaccaacaa

SEQ ID NO: 10443 - DNA, 266 bp, Zea mays
  Clone ID: LIB148-007-Q1-E1-G6
gacccgagcgtcaacgcagggtggcgtgcacgaagcagggcggcattcggtacaccatcaccgggaacaagtacttcaacatggtgacgatcaccaacgtgggccgcgccggcgacagcccggcagtgtcagtgaaggggaccaagcgcgttaagtggaccgagatgaagcgcaactgggggcaagtgtggcacaccggggatgaccgcacatgcgagtcgctgaagttcccggtgatgaacagcgaccaccgcagacgccagcct

SEQ ID NO: 10444 - DNA, 409 bp, Zea mays
  Clone ID: LIB148-007-Q1-E1-G7
agatcatcatctccatccaccgcccgccgtagctagctagatctgctgccatggcttcctttggcgaggctcccggcggtgacgccggcagcggcgagaagatcttccgcaccaagtgcgcgcagtgccataccgtggagcgaggtggcgcgcacaggcagggacccaacctgcacggcctcttcggtcgtcagtcaaggaacaacctcgggtaagcctaatccaagggcaacaagaacatgggcgtcctccgggaagagggcacactgtgtgaataactcctcacacccaagaagtatattccaagcgcacaaagatggtcttcccggggctcaagaagcctaaggagcgaaccgatctcatcgcctacctcaaggaatccacggcttaacttcttctagctatctta

SEQ ID NO: 10445 - DNA, 429 bp, Zea mays
  Clone ID: LIB148-007-Q1-E1-G8
aagttctctcttccttgtccaagtgatcttgccaagttacgagcagcaagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgcccgtggcgggcgtcacgaacacggtgaccggcgcggcggccggtgtcaaggacaccgtgaccggcggccactgatcg

SEQ ID NO: 10446 - DNA, 394 bp, Zea mays
  Clone ID: LIB148-007-Q1-E1-G9
acacagattactttctgttgcttctagttcacagattctctatgttggtgatcacatatacggagatattctgcggagcaagaaagttctaggctggcggactatgctggtgattccagaactagaacaagagctgaagcttctctcagaatcaaagtctactcgtaaggagcttagacatcttagaatggagcgtgattcaattgaagacaaaatccatcatcttgaatggtctcttaagcttgatgatatctcagaaaaccagaaggagaaattgttctctgaacatgacaatctgctgaaacagagagggcatgttcgtggtcttcatcaagaagctcagaagcaacatcatcagaagtttcataaggtgtggggacagctcatgaagact

SEQ ID NO: 10447 - DNA, 388 bp, Zea mays
  unsure at all n locations
  Clone ID: LIB148-007-Q1-E1-H1
agatcacaatcgagaaactggtcaagcacccctggttcaaaaaggggtacaggccggccgtcatcctggcacacccgcacggctcaagcaccctcaaggatgtcaaggtcgccttcagcaacgccgaccacaaggacagcatcagcaaagtggaacagccggcggacagctccttgaagccggcgaccctgaacgcgttcgacatcatctcccactccagagggttcgacctgtcaagcctgttcgangtggaccaagagcagaaggccagcaactcgcggttcatgacccagaagccggcgtcggcgatagtgtcaaagctggagcagatcgctgagacagagcgcttcatggtgaaaaaacaagacgggctggtgaagctgcaggg

SEQ ID NO: 10448 - DNA, 430 bp, Zea mays
  Clone ID: LIB148-007-Q1-E1-H11
cccgcccgtccgaccacgcgaccgccggtccttcctgcggcagaaggacaacatgctggtgctgttcgaggaggagttcgggcggccggacgcgatcatgatcctgacggtgaagcgcgacaacatctgcaccttcatctcggagcggaacccggcgcacatcatgtcgtgggagcgcaaggacagccagatcacggcgaaggcgaacgccgacgacctcagggcccgggcggcgctggcgtgcccgcccaagaagctcatccagcaggtggtgttcgcgagctacggaaaccccgcgggcatctgcggcaactacaccgtcggcagctgccacacgccacgcgccaaggaggtggtggagaaggcgtgcctcggcaagcgcgtctgcacgctgcccgtgggcgccgacgtctacggcggcgacgccaac

SEQ ID NO: 10449 - DNA, 425 bp, Zea mays
  Clone ID: LIB148-007-Q1-E1-H12
agcgccatgagctccccgtggtgcgcgcggcgtcgtgctcgtcgtggccgccgacgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgacctgtgcccgcccaacgaccaacagtccgcggacagccgcgggtggtgcaacc

SEQ ID NO: 10450 - DNA, 391 bp, Zea mays
  Clone ID: LIB148-007-Q1-E1-H2
gatcttgccatgttacaaccagcaagcagaaataaggtcaaccccgggcaatatttcgacaaggaaaaggaggagaaccccgaggaggacgctgcgcccgtcgacgtctccgcggacggcgtgtatgtgcctctcaagaaggagaaatccggcgaagacgccacgccggtcgacgtctccaacaccaccggcaaatacgtatcttcttcttccaaggcaaacggcaagcccacgggaggtcagcccgcagagagctccaccaccgccaccgcggatgcgtacgcgtctccaaagcagaaagtcgtcagcagccagcccatggccagcgccgctcctgacgagcttccgctggcggccaagagctccaacacctcggacgcgtacgcatctc

SEQ ID NO: 10451 - DNA, 402 bp, Zea mays
  Clone ID: LIB148-007-Q1-E1-H3
tagtcttcgtctcactcaccccgccttcacgcctccctcaccaaataaggtcccgcccttttccgacattcacacgggggacaggaaatcagcggccatggcctcgattccggcgacgaccttcgccgtcatcttatccgtcctcttctgtgccgcggctggcaccgccgtcgacaacgacctccccgactacgtcatccagggccgcgtccattgcgacacctgccgcgccgggttcgtgaccaatgtcaccgagtacatcgcgggcgccaacgtgaggctggagtgcaagcacttcggcaccggcaagctcgagcgctccatcgacggggtgaccgacgggaacggcacgtacacgatcgagctcaaggacagccacgatgacgacatctgcgacgtggt

SEQ ID NO: 10452 - DNA, 399 bp, Zea mays
  Clone ID: LIB148-007-Q1-E1-F7
actcagtcatctacgatccgacaccatggatcgtcgatcgttcagcagcacaagagacgacaatggagacgacagctcctcgggtccggtccgatcgattcttgcttacgtgtacatagctgaggcgcaggcgcagcacctacttacccattaacgtcattgccagtgagagtttcatcataattttatttttattaaacaagatgatacatcacgatatttgatgacatgacacggtattataataaaaaaaacacaaaactaaaaaatctcaaacaaataggaaaacacactaaaagaatcatacatacataacacgagaaaaggaaataaatgaaccggtcaaaggcgccaagtcaattcaattcaaggggacgacacaaaaaagggggggccccc

SEQ ID NO: 10453 - DNA, 145 bp, Zea mays
  Clone ID: LIB148-007-Q1-E1-E11
cgcgctctcgccctcgcctccttcctcctcgtcgcctccgcggccgtgggtttcgccgcggtggccccggcggcctctccgggcccttcggcctctgtgccgttgggggcgcccgtccgttcgcctgcgtgtgtccgggcgggcc

SEQ ID NO: 10454 - DNA, 396 bp, Zea mays
  Clone ID: LIB148-007-Q1-E1-E12
aatcgacataaagtactgccccaacaagttgtgtactgccaacggcgcctccaaggtcaccgtcaaggacatcaccttcaagaacatcactggcacctcctccaccccggaggccattagcctgctctgcactgccaaggtcccatgcaccggcgtcaccatggatgacgtcaacgtcgagtatagtggcaccaacaacaagaccatggctatatgcacgaacgccaagggcagcaccaagggttgcctcaaggagcttgcatgcttctagaccctcagtcgactgacccatctctctagttataatttttctctcgtccttgaattgtccattagttgctatccatttgtaacgcacaacagtaaaatgatagacatccaacagctatattatgt

SEQ ID NO: 10455 - DNA, 393 bp, Zea mays
  Clone ID: LIB148-007-Q1-E1-E2
ggccccttggccggccccttggggccgaaggcaacaagcccaactgggccaaaaaactggcaagccaagggcttgaacccctccaacttcaaatcaagttcatgggtcgggaacagacaagggcgtcggcagaaatgcatcggcaagtcaatcggcttggcaaaggagctggcgtgcatttgaaccaattgactaacatgcatatattatgtactaggtttgtgcccgtgcgttgacacggaagttaaaaattagtataaaacaaagatacataacgataaatatcactatgacattcaaaatccatgtggcaaaatatcactgtaaccatctatgattgtgcattgcgacgccacacaaattattcgataaaatattagcaattgggaaaaa

SEQ ID NO: 10456 - DNA, 422 bp, Zea mays
  unsure at all n locations
  Clone ID: LIB148-007-Q1-E1-E3
gcatccggtccgcaagggccccgccggcgaactgcgctaaccgtcctaaccggagagcaacgggacctggaaattcccaagcatcggcgccttccagtgcaacgacaggtacatgcgtagccgcctgcaagcggcagcggaggcngccggcaagcctgagtggggccacggtgggccgaccgacgctggcggctacaacaactggccggaggacaccgtcttcttccgcggcgacaacggtgggtggagcaccgagtacggcgacttcttcctgtcgtggtactcgcaagatgctgctggagcacggcgacctcatcctgtcgggcgccacgtccgtgttcggcgccgcgcccgtggaggtctccgtgaaggtggccggcatccactggcactacggcagccggtcccacgccccggagctc

SEQ ID NO: 10457 - DNA, 410 bp, Zea mays
  Clone ID: LIB148-007-Q1-E1-E4
cgaccacgagttcgccctgcgccggcgtcgcgtcaccgcgttcctgcggctcctgcacgagctccgggaccgccagctgcagcggctggaggctgctgccggggtcgccctcgaaggcgaccagctgacccctttcggtcggagcctcttcatcggcgcagctggcggcggcgatcatggcgtggcgctgggcgactacttcctcggccccagcctcgacgctctggtgcagcagctcgccgagaacgacgcgggacggcacgggacgccgccggccaagaaggaggccgtggaggcaatgccgaccgtggaaatcgccggtggcaatggcaacgatgacgacacggccagctgccccgtctgcctggaggactacgcggccggcgagcgcgctcgggagattccctgca

SEQ ID NO: 10458 - DNA, 425 bp, Zea mays
  Clone ID: LIB148-007-Q1-E1-E5
aggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccacccaaggacaagtggtgcaagccgccgcaggagcac

SEQ ID NO: 10459 - DNA, 423 bp, Zea mays
  Clone ID: LIB148-007-Q1-E1-E7
acccctctccatctctgcgtgatggacgcccgcctcgtcttcctcctcctcctcgccgccgcggcgtccgcgccgctggcctccgcgcagctctcggcggatttctacaagacgtcgtgccccgacgccgagaagatcatcttcgacgtcgtccagaagcggttcaaagctgaccccggcaccgccgccggcctcctccgcctcgtcttccacgactgcttcgcaaatggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggc

SEQ ID NO: 10460 - DNA, 191 bp, Zea mays
  Clone ID: LIB148-007-Q1-E1-F10
aaagacgcgagggcggacgcgtcggatctacgtggtacaccttcaggatagtctatctccacgataaggaatgattatgctcgacgatgactggccggggtaaggagtaggcgtctgtttgcctttactagcagggtttccagggggtgcttcctatagctctccacttgcgtgagcggcgacatggattt

SEQ ID NO: 10461 - DNA, 413 bp, Zea mays
  Clone ID: LIB148-007-Q1-E1-F11
aaaaaaaatcaaagggtggcatctttcttgctttatctcacggatgtcgaagaagggggagaaactatgttcccatacgagaacagtgagaatatggatataggctatgactatgagaagtgcattggcctaaaggtaaaaccaaggaagggtgacggactcttgttttactcccttatggtaaatgggaccattgaccggacttcacttcatggtagctgccccgtcatcaaaggcgagaaatgggtcgccaccaaatggatcagagacaatatagtgtagaaatcgaaaggctcaggtgtcatgtgccctccaaaaaaatagatcatgcgcacatatactgaccatatacttcagtgtttgttcaattgccatggacagttggaccaacggaaggaaagtgtaaccaatct

SEQ ID NO: 10462 - DNA, 420 bp, Zea mays
  Clone ID: LIB148-007-Q1-E1-F12
acgacgatgacccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatctcccacgagtccgcctcttccgacaacgccgagtccgccgcgttcaccgtgaactcggacaacgtcatcgtc

SEQ ID NO: 10463 - DNA, 148 bp, Zea mays
  Clone ID: LIB148-007-Q1-E1-F2
acaaaaccagtaaactatacacggcggcgtcgcggacatgctgcacaaaactacaacgatacagagcgaacgcatggcatggatagcagtatctaccgaaagaaaacgaagaaaaggaaaataaaaaatgtatcagagtgcttgattc

SEQ ID NO: 10464 - DNA, 395 bp, Zea mays
  Clone ID: LIB148-007-Q1-E1-F3
cggacgcatgggcggacgcgtagggggatgggcatcgctctggcagactccgaccacaacggcatcgggagcttcgctggtaaccgtgtggatcactacgtcagatgcgccatgacaaatgccttcgctaaggcattgggtaacgggctcagacaggggaacaacatggacatccaacgcaacgacaacaccagcgagatcatggcagggatcgccaaggacactgagcacctggctcagttcgagctggagatgttcagcccggtgctgaagctgtggcacccgttcccgggcgcgtccgtggtgagcacgctccacatctgctacagcgtcttgctgaagcagtacatgtccaaggcgacgtacctcatgaacgagctcgtgcacgtgctgaa

SEQ ID NO: 10465 - DNA, 425 bp, Zea mays
  Clone ID: LIB148-007-Q1-E1-F4
aggggtggcgcagggcaggattaggcagggcagcgccgcgccggccggaccgcccgtccacgagccagggactttcggccatgggggacggtggtgctgacgacgcctcctcgccgccgccgcatgacgggggcttctcctacctcgccgtcttccacaactaccccctcgtcgccgccctgctcggcttcgccgtcgcgcagtccatcaagttcttcctcacatggtacaaggagaacaggtgggatcccaagcagcttatcggctctggtggcatgccatcatcacattctgccacggttacagcactagcagtagcgattgggttgcaagatggctttaactgctccctctttgcaacagcaactatatttgcaagtgtggtaatgtacgatgcttctggtatcagattgcatgctggaaag

SEQ ID NO: 10466 - DNA, 427 bp, Zea mays
  unsure at all n locations
  Clone ID: LIB148-007-Q1-E1-F5
atataagttcaccgaggtccccgccgtctcttgtgtctcggaaccggaaagcaaacaagtccagtacgccaagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctaaggctcctangcggtgcngtccgggggatgatgctcggagaggcgatcggtgactatgagaccgacgccgcttatgatgccggg

SEQ ID NO: 10467 - DNA, 411 bp, Zea mays
  Clone ID: LIB148-007-Q1-E1-F6
accgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttattatatttgtattccacattatata

SEQ ID NO: 10468 - DNA, 410 bp, Zea mays
  Clone ID: LIB148-007-Q1-E1-E10
gtccaggcgtcggacgcggcaggccgcacgccgtggtgatgccgtacccgctgcagggccacgtgatcccggcggtgcacctggcgctgcggctggccgagcgcgggttcgcggtcaccttcatcaacacggagtccgtgcaccaccagatcggcgccggcggcgacatcttcgccggcgtgcgcgcgcgggggggagggacgacgacggaggagctggacgtgcggtacgagctggtgagcgacggcttcccgctgggcttcgaccggtcgctgaaccacgaccagttcatggagggcgtcctgcacgtgcccccggcccacgtcgaggacctcctccgccgccgcgttctcgtggacccggccaccacgtgcctcgtcgtcgacaccgtcctcgtgtggccggccacg

SEQ ID NO: 10469 - DNA, 422 bp, Zea mays
  Clone ID: LIB148-007-Q1-E1-C6
cccacgcgtccgcccacgcgtccgccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgccaacccctaccgccgcggctgctccgccatcacgcgctgcgcccgcaacatgaactgagcccagcgctagctgctgccggggcgc

SEQ ID NO: 10470 - DNA, 402 bp, Zea mays
  Clone ID: LIB148-007-Q1-E1-C7
acgtggatggcggtgccacaacctctcctgctgtcgctgctggtcgccgtgctagcggtggccgccgatgtcgccaacgccggccaagccaagcccccaaagccttgccggccccttggaaaagaacaacaacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgacgtgcggtgcgtggacagccctaccgggtgcaagcccgacgcggcagcgctggtggtgaccgtgaccgacctgtgcccgcccaa

SEQ ID NO: 10471 - DNA, 398 bp, Zea mays
  Clone ID: LIB148-007-Q1-E1-C8
agtgctacggttccggccagggggccacgccggggccgggcgagcgccggcagccgagctggacgaggcgccgcgggagggctgctgggcgcagttgcctctcgatcttctgcgtatgattaataccatgggagtgatatacagatggttctaccaatcatggttggaggttacacagacttcttttgttctatgctccatacaaggaattgtggattcatcttccgagggtcgtagactccgatcaatccaaattgatatgtgttttcttggtcaatcatggttggattcatcttccgaggatctagactccactaagactgtcctttgacaagctggacggtgttgacgttgcatggagtcagtcaaggatcaacgactctgtcatggtttgctca

SEQ ID NO: 10472 - DNA, 406 bp, Zea mays
  Clone ID: LIB148-007-Q1-E1-C9
cccacgcgtacgccgaggtcacaatcgatgcacggaggaggatgccgccgtagctgcggagattgataatataaagcgggcggagaccgccggcccctctggcctcgctgctcctccccccttcctccccccacatgcgctgcccccgcccggccctgccctgccctgctgcgcccaagctgaatctccgcacagacaattagagtagctgcattggcggggaaagcgcaagaagctcagcagaaatggcggagcaggcaggcgccggaaggtactggtgccacatgtgcgccgcggtcgtgagccccgcggagggcgaggcggaggtgaagtgcccgcattgccacagcggcttccttgaggagatggagaccgtccgcggcacgcccgcggccgatgacggcga

SEQ ID NO: 10473 - DNA, 431 bp, Zea mays
  Clone ID: LIB148-007-Q1-E1-D1
acccacgcgtccgccctgctcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgattatgctgaggcggacgaagagcgggcgggcgttcccgccgccgatctccgtgatcggcaagggcgggcgggcgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcg

SEQ ID NO: 10474 - DNA, 378 bp, Zea mays
  Clone ID: LIB148-007-Q1-E1-D10
aaaaagatcatgcaacagatggtgacaagtacctcgagtgggcagctcaaatggccctcagcacacaaacaggagttccatggataatgtgcaagcagtcttcagctcctggtgaagtgatccctacatgcaatggaaggcattgtggagacacatggacacttcgcgacaaaaacaagcctatgctttggactgagaattggactcaacaattcagagcatatggcgatcaagtagctatgcgttcagctgaggacattgcatatgctgtgttacgattttttgcaaagggtgggtcattggttaactactacatgtaccacggaggaacaaattttggaaggactggcgcttcttatgtgctgactggatactatg

SEQ ID NO: 10475 - DNA, 415 bp, Zea mays
  Clone ID: LIB148-007-Q1-E1-D11
gacccgcccgtccacattcaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaacgccgccgagaacacgacga

SEQ ID NO: 10476 - DNA, 412 bp, Zea mays
  Clone ID: LIB148-007-Q1-E1-D12
gtccagctagctaaccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagaccaacgggagagagagtgacatggctgcgcgcattccgatgcgtgggcatgttttttgattcgacacacctttttgtcccccttttcttt

SEQ ID NO: 10477 - DNA, 373 bp, Zea mays
  unsure at all n locations
  Clone ID: LIB148-007-Q1-E1-D3
aaggcttccgaaaactcccccggcgccaacaacaaccgctccggttgcgcccggcaaccgttaacccttgactttccccggggggccggggaaaaaaaaggcagaaggaggaggcacggagaggacgagacaggatgctcgggttcaggcagatgccgtggtcgtcggcgcaggagcaggagcaagcgccgtcggagcagctgtgcgagggggtgtcngccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcag

SEQ ID NO: 10478 - DNA, 442 bp, Zea mays
  Clone ID: LIB148-007-Q1-E1-D4
gacgcgtccgaccacgcgtccgcgcgctccccgtccttcggtaggtgcattgcttcggtggtcaaccatggcgcagcaaccggtggccacgatgacaactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaac

SEQ ID NO: 10479 - DNA, 420 bp, Zea mays
  Clone ID: LIB148-007-Q1-E1-D5
acgtacacccgctcttccaagttaggaggggagcacccatcagccaagagctatccatacgcacagcgatgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccg

SEQ ID NO: 10480 - DNA, 421 bp, Zea mays
  Clone ID: LIB148-007-Q1-E1-D6
agattcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatccagtcacggtgttcatcacagacatgaactacgagcctatcgctcgctaacacttcga

SEQ ID NO: 10481 - DNA, 429 bp, Zea mays
  Clone ID: LIB148-007-Q1-E1-D8
accacgcgtccgggtaggtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgtt

SEQ ID NO: 10482 - DNA, 418 bp, Zea mays
  Clone ID: LIB148-007-Q1-E1-D9
agcaaaattaaatggtttatctaagactggtgtacaaagaaaacttaatttggatcgtcagccatcccaaaagggtatgaagccaaccgagactagcaataaactaactacgaatcgggtaccagctcggaatagcccagggaatcctgtacttaggcattcacggagcttgcctgaaactggccgaggagcaatacagaaggtctcatcaattacagagaaactatcccaaatgtctgtgacctctagaacacggagcgctgtgaagcctgctgcccccatgatgaaggccggacatggcaagtcggactttcttgggaagtctgacgatatccctccagcaaagaggctgacaagaaaattggtcagctaaatgagggtatgtggagtgaaaattcgattagctgcaggaagggtg

SEQ ID NO: 10483 - DNA, 292 bp, Zea mays
  Clone ID: LIB148-007-Q1-E1-E1
acgcgaaaaaaaaaaaaaaaaaaaaaaaaaaaaaaaaaaaaaaaaaaaaaaaaaacgaaaaagaaaataaaaaaaaaaggaagaaaaacaaaaaagctacaaaaatcaaataaaaaaaaaaaagggggggccgcccaaaaggttcaaacctaaattacccttgcatggaacgtcatagcccttcaaaagggccaccaaattcaaattaaagggccttcttttaaaaacttcagaactggaaaaaccctggctttacccaatttaacccccttgaaaaaaaaccccctttccc

SEQ ID NO: 10484 - DNA, 422 bp, Zea mays
  Clone ID: LIB148-007-Q1-E1-B11
accacgcgaccggagagaggaacgcgaacaaccaacgatcgcctcatcgccatggcacgctctgtccccatcgcgcctctgctcctgctccccctcctcctcctcctcgtctccactgcgtccgctgcacggaccgtgggcgacaccgtgcaggacgcgtgcagcaagacacaattccccaagatctgcgtggacagcctcaccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccgacgccaa

SEQ ID NO: 10485 - DNA, 410 bp, Zea mays
  Clone ID: LIB148-007-Q1-E1-B12
agacgttggcaagagaggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaagagctgctcaagtacgccaaggagaaaggcatcgtgtcaccgaccaacggcacggggtggtacaagggcatcgcccgggag

SEQ ID NO: 10486 - DNA, 424 bp, Zea mays
  Clone ID: LIB148-007-Q1-E1-B2
agtgccgccccgtcctcctctcgctccttttcctcctcgtcctcctcaccgcgccggcgttcggctcgacgctcctccccgccgcagccggcggccccggcccggcgggcaccagcgtcccggtcccggtcccggtcccggctcagccgagcgcgtacgagatgctggaggggttcgggttcccgaggggcatcctgccggagggcgtgaccgggtacacgtaccgcgcgtcggacggcgcgttcgaggtgttcatggacgacggggactgcgagttcgaggtggacggcggctaccgcctcacgtaccgccgcagggtccacggcaacgtcgcgggcggcagcatccggaacctcggcggcgtctccgtcaggatgttcctcttcgactggagcatcgaccgcgtcgccgtggaggacgcggc

SEQ ID NO: 10487 - DNA, 113 bp, Zea mays
  Clone ID: LIB148-007-Q1-E1-B4
tttctgcgatgtgatcgagcatttcctgcaagttgcgggaataagccattccatgcactgcgagtctggtggttatgccccgttctagcacgatggcaagtcttaacggtgct

SEQ ID NO: 10488 - DNA, 385 bp, Zea mays
  Clone ID: LIB148-007-Q1-E1-B5
acccacgcgtccgcggacgcgtgggctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgcccgggcaactacctgacgggcgggctggagctgaagggcccctgcaagtcgtccatcatcatccgtctcgacggcaacctgctc

SEQ ID NO: 10489 - DNA, 409 bp, Zea mays
  Clone ID: LIB148-007-Q1-E1-B6
agcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcaaagtgtgggcaagcctaccca

SEQ ID NO: 10490 - DNA, 420 bp, Zea mays
  Clone ID: LIB148-007-Q1-E1-B7
acgcacaactgcctgtaccgcgccgtggacatctacctcaagacacacccggggctggacgagatcgagcgggagaaggtgtgcagcgtcatggacccgctcaggctgtcgtaccaggcgcggatgcacgcgtcgcagaacaagcggctgccgctgcaggccgtgctcagcgtgctctactacgaccagctgaagatccgtagcgcggacggcagcggcggcacggaggaagggtgggagacacagtcggccgccgggaaggcccgtgcgcaggcgcgggcggacgtgtccctggcaagggagaacgaggcgctgccgttggagctggcgcggatgcgagcgtacgtgtcagggatgcagcagagcagcaaggggagcgggtccaggccatcgtcgtcatcgctggtaccaggcccagcg

SEQ ID NO: 10491 - DNA, 426 bp, Zea mays
  Clone ID: LIB148-007-Q1-E1-B8
agccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgta

SEQ ID NO: 10492 - DNA, 440 bp, Zea mays
  Clone ID: LIB148-007-Q1-E1-B9
gacccaggcgtccgaaagaagtcacctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaagcgagcctgaggaacggcg

SEQ ID NO: 10493 - DNA, 237 bp, Zea mays
  Clone ID: LIB148-007-Q1-E1-C1
acccacgcatccgcccacgcgtccggctgttgctacagtcctaggaatgatgctatatggcacatacgcaagcgtgcatgtctatgcatatggaccaggtccctgtgtgggctttgtgagagcgcgcggcatgttctgcattttgtcacaaccattatttgcaatgatgaattttcctctcgcctttcaatcaattcgactcctaggctacgatctgcgggcaataagtgctcgttc

SEQ ID NO: 10494 - DNA, 370 bp, Zea mays
  Clone ID: LIB148-007-Q1-E1-C10
agagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcagggcgcgagctctctgaagaggaagacgcgcatccgctcgcgcgatcgccatgcatgccccggaacgacagaagctgtttgtcttgcatcgaccggcggcctctgcatgtacccgtgtgccgttttttgcaccgccggtgccagtgttctcttactccatgtaaactactctagacagtgcccggtgagtacagctg

SEQ ID NO: 10495 - DNA, 421 bp, Zea mays
  Clone ID: LIB148-007-Q1-E1-C11
ccactaccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgctcgccacggtgcgcgcgcccgcggcgctgtgccgcaaagccgcccgcgtgcgcaagggccgcatgcgctct

SEQ ID NO: 10496 - DNA, 411 bp, Zea mays
  unsure at all n locations
  Clone ID: LIB148-007-Q1-E1-C12
accacgcgaccgcgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatccgggggcatcactgtgaagaaaacagggcagtcactcatcattggcatctacgacgagccgatgactcccgggcagtgcaacctgntggtgggaaggctgggcgactacctgctccaacaaggggatgttatgacaacccctcccc

SEQ ID NO: 10497 - DNA, 394 bp, Zea mays
  Clone ID: LIB148-007-Q1-E1-C2
acccacgagtccgtggaaagcgaggcgttttgttttctcccgtgctccccctcccggggaaggggcaacgagaaatcgaacccacacgcaacgcgacgcctccacccgctcgcctagtccagaatccagatccagcgcccgcatctctctctctcgcgcgcgcgcgcgagcgcgatgagctgccgcgacgggcgatcgtgctagcggtaacagcgagcggtgcgcgagggcggagtgggagtgtggatccgaggggcggcaaatctggcaagcgccgcggtggggctgcgggcgcgggggagggcggggggctgggcggacggcggggagggaggggaggactgcggtaagctcaagccctggcgcaggaggctgctcgcgtccatggcgctct

SEQ ID NO: 10498 - DNA, 359 bp, Zea mays
  Clone ID: LIB148-007-Q1-E1-C3
ctaacggccgcccggcaaacaaggcggtttccacaaccaattgcaaagccccccggcaacagaggcggggcccagaaggaccgggggcgccgagggtcggcggccccgccaaagcccgtcagcattgacgtgccccgcatacccttcgacgagctcaagaggatcaccaacaacttcagcgaccgcgccctcatcggggagggctcctacggccgcgtctacaacgccacgctcagcgacggccgcgccgccgtcatcaagaagctcgacaacagcgcctcgcagggacccgacaccgacttcgccgcgcagatcgcgaatgtccccaagctgaagaacgagtatttcctggagctcct

SEQ ID NO: 10499 - DNA, 340 bp, Zea mays
  Clone ID: LIB148-007-Q1-E1-C4
actaactttctggcctgcaactttcgaaggcgttccaagctccgggatggcgcccgtgtacatggccttcctccgcttcatgggggacgagaacgaggccaagaactacagctacagcctcgaggtcggcgccaacgggaggaagatggtgtgggagggcaccccaaggagcgtccgcgacagccaccgcaaggtgagggacagccacgacggcctcatcatccagaggaacatggcgctcttcttctccggcggggaccggaaggagctcaagctcaggatcaccggacggatctggaaagagcagcagacaccagacggcgcatgtactccaaatctg

SEQ ID NO: 10500 - DNA, 416 bp, Zea mays
  Clone ID: LIB148-007-Q1-E1-B10
gacccgcccgtccgaccacgcaaccggcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaacccgcccaacgacacaacg

SEQ ID NO: 10501 - DNA, 395 bp, Zea mays
  Clone ID: LIB148-006-Q1-E1-H2
agctggagcaggaaccctcgtctcgcggtcgcgggggtagggccgggtgagcacaaccgctgcccgctcgctgaaccatggcgggctccgcggtggccgtcgtcctcctgtcggccgtcgcgctgctctgcctgtaccacctccttttcctctccctgtccgtcccggacccggcagcagcagcagcagccgtcccccgccgcgccggtggccaccgtggcagcaacgttccgtccgggtcaggaaccgccaacgtcgtcctccgcttcggcctgtccgggcagccgctccgcctccacgaccccgccgccgccgccggcctcccggacatcgacaccttccgcggcaagctcgagcggctgctttcctcccgacgaccacgaacccgggctggt

SEQ ID NO: 10502 - DNA, 221 bp, Zea mays
  Clone ID: LIB148-006-Q1-E1-H3
aataaatccccggccccaaagttaaggcggagttcaagcaatttcggaacgggaagctccaaccctccaaccaccgggttgaccgccggaaccgcaacttcaacattcaaccccaaggccagccacaaggaggaaaccgccaaggtggccttgcggaaaaccccccccaaggactgcaacaagttcaaggcggacaggaacccccccggcttctggctcac

SEQ ID NO: 10503 - DNA, 99 bp, Zea mays
  Clone ID: LIB148-006-Q1-E1-H4
cttcaaccggaacccaggacaattgcacggcttccaacaagacggtcaacttcatcgacctcctcacggccgacggcgccatctaccataagacatgct

SEQ ID NO: 10504 - DNA, 323 bp, Zea mays
  Clone ID: LIB148-006-Q1-E1-H5
agttctagatcgcgagcggatgggcgtggtccatcaaccagtgcaggtccttccgctggaacctgacggcgagcgcggcgcggcccaacccgcaggggtcgtaccactacggccagatcaacatcacccgcaccatcaagctcgccatgggccgcggcaaggtggacggcaaggagcggttcggcttcaacggcgtgtcgcacgtcgaccccgagacccccgtcaagctcgccgagtacttcaacaccaccgacggggtgttccagtacgacatcatcggcgacgttccgcccttcaagttcggccccaacaagattggcccc

SEQ ID NO: 10505 - DNA, 420 bp, Zea mays
  Clone ID: LIB148-006-Q1-E1-H6
gtccagctggagcgggacccgaggaggaggctcgggtacgccggcggcgccgacgaggtccgggcccacccgttcttcgccggcgtcgcgtgggacatgctcacggaggtgtccaggccgccttacatcccgccgccggccgacgaggacctcgcggacgtcgaagggttcgacgtgaggggccacttcaaggaccttcaccagccgccgcctcccaagtccgcgtcggagtcgtcctcgtccgagttctcgacggagttctgactgtgagctcgggctagcttcttttgcgctttggtcctcggtagattactatatttgtaccagagggtcaagggtgtcggtactgtacatacatggagacggggatggtgctgtaaattcgacgtagagttggtgtggttgtgcaaacattttggg

SEQ ID NO: 10506 - DNA, 410 bp, Zea mays
  unsure at all n locations
  Clone ID: LIB148-006-Q1-E1-H7
aatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggattcagtgcaatggcaagtgcnacgagcagaagggcatcacggcgccgcatatgaaggtgtgccaagaggcgtgcgacaaggactacgtggtcaatgcggctgaggtcaccaaggcctgc

SEQ ID NO: 10507 - DNA, 279 bp, Zea mays
  Clone ID: LIB148-006-Q1-E1-H8
gagatagatacgcaggaccgccggcgactatcgacgagggaggaaccagatacccggcggcggtgatcgatggctccgcgcagctcatcggcggcgacgtgcctgtgcctcgctctcgccgcggccacgctggcgctggtccacggcgcgcaaggaggaggaccatcggcatcggcggcggtcctggacaaggtcacggacgagaccttcgtggacatccagatcgactgcaagcctgcatgccggatcgtgctgggactgtttggggacaccgttcct

SEQ ID NO: 10508 - DNA, 396 bp, Zea mays
  unsure at all n locations
  Clone ID: LIB148-006-Q1-E1-H9
aatttgtcaaagagtggaagaagtatcttgaggaggaggcgaagatcatgaaagatgttccagggtggaaggttggcgagagtgtgtacaattccgggaaatggatgcccccggctaccggtgagctccgccctgaggtgtggtaagggcctgttgtaggcattgagaatgcaatcatgtcatgagggcatgaataaggctttcagacatgggcatccttctttgttcactaaggatcagctgttcanatacctgtatctattttgctcttatgaaatctggctggttaataatatgaagccgacgctttgcctcatctatgctcgtgcattgatgtaacgtgtccttgtctgatattaagaaaatatggaatataagaaagaaaaaaacgcctgc

SEQ ID NO: 10509 - DNA, 421 bp, Zea mays
  Clone ID: LIB148-007-Q1-E1-A1
accacgcgtccgcgacaagcagggcttcaacgtcgaggagatggtcgcgatgctgggcggcgggcacagcatcggcgtctgcaggtgcttcttcatcgagaccgacgcggcgcccatcgaccccaagtacaagaagacgatcagcgacgcgtgcgacggcaaggactcgggctccgtccccatggactccacctcgcccaacgacctggacgggagctacttcggcctggtgctggagaagaagatccgctcaccatcgaccgcctgatggggatggacaagaagacggagcccatagtgaaggccatgtcggacaagaccaccgacttcgtcccgatcttcgccaaggccatggagaagctcagcgtgctcaaggtgctcacggggaacggaaggcgagatcaggaagacgtgctccgag

SEQ ID NO: 10510 - DNA, 413 bp, Zea mays
  Clone ID: LIB148-007-Q1-E1-A10
ctgagcctggaggagatcgagtcgaagatcctgaagtaattaaaaaccgttcgtgggatcacaagccccatttggagatatgtaagtagcgatgccattttcaaaacgggcgctcgctcactcgtaggatcggagccaaagctttcagacatgggagtacatatgcaaagggcacgtctcggtgtaaagcttggacatctttctcttatattagcgtagtgaatatttccgaacatacttggtaaattacatctgcagttgagtcataatcacgcctctgtagactgtagtccactgtgagctactgtagtagtatgcatgtcactagtaaaagctggtaagctgtgcgatggactgatggtgtagacttgtgcagttgtgctctcataatggtgggcatcagatcctgtaaa

SEQ ID NO: 10511 - DNA, 363 bp, Zea mays
  Clone ID: LIB148-007-Q1-E1-A12
agctggttcatggatggcggcgccacggcctctcctgctatcgctgcgggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccag

SEQ ID NO: 10512 - DNA, 414 bp, Zea mays
  Clone ID: LIB148-007-Q1-E1-A2
tgggttcaaggctggatccgttggcttaacaaaccttaccggcaaccggaaaccccgtccgggcaaaaaaggattgggcctaacccgccaacctaggcaatttggtggagaaccgaccgggtccgggtacttaaatgcctaaattttgacggcactcccgcatgctcaaaataatactaactgacagcgtgagacagaactggctgctctgtcggacctgctagcccaatgatgggtgctgtggagaggaagactcatgacaatgaacgcaagcaatggccacgacaggattgtttagaaccatttctgttacaacgttcatgatatctctctcactcactgctctcatctcattaagtactagctatccaatgcaatgtttccacactgggcagtcatatcaccctgttttgg

SEQ ID NO: 10513 - DNA, 379 bp, Zea mays
  Clone ID: LIB148-007-Q1-E1-A3
tcgctccgacaattaataaggacaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccaaggccgcgtgtactgcgacacctgccgcgccgggttcgtgaccaacgtcaccgagtacatcgcgggcgccaaggtgaagctggagtgcaagcacttcggcaccggcaagctccagcgcgccatcgacggggtcaccgacgcgaccggcacctacacgatcgagctcaaggac

SEQ ID NO: 10514 - DNA, 428 bp, Zea mays
  Clone ID: LIB148-007-Q1-E1-A4
atcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaactttacaggcccttgcaagggcgacgtgaccatccaagtggatggcaatctgctggcgaccacggacctaagccagtacaaggaccatggtaattggatcgagattctacgcgtggataacctgggcatcaccggcaagggaaaccttgac

SEQ ID NO: 10515 - DNA, 412 bp, Zea mays
  Clone ID: LIB148-007-Q1-E1-A5
gggccgacccaaacgtccagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctaaaagaaaaagaaaatatcaatggggatgttcccacgattacctccgccgcaaacaacgaagaagaagcgttgttcaatgtccgagaatccaacaaggacgattgccatcgcttgacgatggaatgctccactcccgtctcctccagtagcccttccactcgcagagaagcgcggggcgttcagcctcttcaaggcgatgttcctgttcttcggccggagcaacgacagcattaagaagacaaacgacgaca

SEQ ID NO: 10516 - DNA, 390 bp, Zea mays
  Clone ID: LIB148-007-Q1-E1-A7
aaagaaacaatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgttgccgctgccccatcgtcgtcgtcgtctaggaagtctggtccagctgccgcgccgaccaccgccgcctctacaccgtcttcttccacggacgaggagttgagccct

SEQ ID NO: 10517 - DNA, 430 bp, Zea mays
  Clone ID: LIB148-007-Q1-E1-A9
actgccatcctctccaacacgaagatggcgttcatcagcaatgtcgcagtgtacgcggcggccgtggccgcgctgctgctggtcgcaccggtgtcgcctgccgcgcgcgcggcggcggtggcggtggcgggaggggcgccgtccgtgccggcgggtccgctggacatcgcgcagctgggcgccaaaggcgacggcaagtcggacagcaccccgatgatcctcaaggcgtgcgaagacgcgtgcgacgcgacgggggtacacaatatcgtcatcccgccgggcaactacctgacgggcgggctggagctgaagggcccctgcaagtcctccatcatcatccgtctccacggcaacctgctcggcaccggcgacctcagcgcgtaccaaacgaactggatcgagatcgacatcgtccagatcctgtccatca

SEQ ID NO: 10518 - DNA, 294 bp, Zea mays
  Clone ID: LIB148-007-Q1-E1-B1
gacgcatggggtctacgacaacgacggcatcgccaagcacggctaccagctgcgcatctggctcagcgccgtgatcgcgaacatggagacgtgcatcgaagggttccccgatgaagagttcaagaccaaggtgaacgagtcgttcaccgaggggaaagagctcagcaaaaacaccctggcgctcatcgagaaggggtcgtcgcgcctctccgcactcaggggcgtctcaaaacggcgtttgctggaggacgagaagggattgcggccgtggccgcggcctcccaagccggggcg

SEQ ID NO: 10519 - DNA, 66 bp, Zea mays
  Clone ID: LIB148-006-Q1-E1-H12
gtccggaatctgcgggaggtcctaacctgcacagatatagaccacgagcaagcttcctacacttcc

SEQ ID NO: 10520 - DNA, 423 bp, Zea mays
  unsure at all n locations
  Clone ID: LIB148-006-Q1-E1-F6
ctccttcgtcggcacggaggagtacgtggcgccagagatggtgcgcggcgagggccacggcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgacgaggaggctcgggtacgccggcggcgccgacgaggtccgggcccacccgttcttcgccggcgtcgcgtgggacatgctcacggaggtgtccaggccgccttacatcccgccgccggccgacgaaggactcncggacgtcgaagggttcgacgtgaggggccacttcaa

SEQ ID NO: 10521 - DNA, 413 bp, Zea mays
  Clone ID: LIB148-006-Q1-E1-F7
acccacgcgtccgcccacgcgtccgcacattcaagcacctcctcctcccccgccggccaacaactcagccgccgcaaccgccacatcagccatgggcgcctgcacatccaatcccaacacgcttgatgggcaggccccagctgaggccgcagtctccacacccaacgttgcgcccgacgccactctaatctccgttgacgttgcggctgatgaacacgtacctgataaagtggtggtggacgagccggctgcggcggccgacgttgagcatcagacggctaatgaggtggtcgctccagaggcggccgtcgccgagcccgatcacaaggaggaggaacccttggataaaaccgtcgtcaaggaggacaacccagcggaagccgccattgcagaggaaaaggtctccaccgccg

SEQ ID NO: 10522 - DNA, 421 bp, Zea mays
  Clone ID: LIB148-006-Q1-E1-F8
agtagactccatcaataccacgcggaacacgctcaaaagcggcggcagcaatgcagacctcatgtcggagctatccgcggcggacaccttcgccaccgactgcggggacaccttcgacgagcgaccagacctcaactcacccatacccggtgcacagcgccacgtcaaccgcctcatcagcaactgccttgacctagcagccaccattaaggaacaaccctagatgcctatgatgtggacactgacagaaatttatctacaactggctgaagaagaaacagtcccacatcctacttcaaatttacgacatgtctgcacatactaataattgtgtggcttatcgattttggctctttttatatcctttgatattgctggggcatacaaagcaatcatcggttattaatacgtggatacgtgt

SEQ ID NO: 10523 - DNA, 393 bp, Zea mays
  Clone ID: LIB148-006-Q1-E1-F9
acggacgcgtggggtcgccgagccatgacgatgacaatacccgcctgccccggctggtcctcctccccgggcgtccccgccgcggcggaaaaaacttccgccggagccgaaggcgaaggcaacggcggtttgaaggccgttggcgaagcggccggcggcggtataccaaccccaaccgaggaagccaatcacacccggcctctggagacacgaagacccctttcgacacgcggcggtcactcaacccatagcgaggcagcgcaatccacgcgtgccgctgaggagacgacgacgactctttcgacaggcggcgggggttacggcggtgcaaccggcaaggcttccacaagcggcggcgggctggaccccgacggcgacccagaggttgggctg

SEQ ID NO: 10524 - DNA, 389 bp, Zea mays
  Clone ID: LIB148-006-Q1-E1-G10
aatgagttaattttcaacagctaacatccggctgccaaaaagtgaagtcgtacttttggcgagacacatttttttttgaaaccaagaacaagaagctaaacctgaaattccgtgttagcagtaacctgatcaagttacactacaactagcaatacagatttttctcaagccttgttcacatatatattcaagtgcaaaaaggagatcgatacaacaccatcccggctcttacaactggcaggccggccaacgcgcacgcggctagtgcccgtgcttgtgcgcgtgctccggctggttgacgacgacgaagatgttgagaacgttgtcgacgaggcggtatacgttccgctgcatgggcaagaagggggacctaatcgccgggaagtcag

SEQ ID NO: 10525 - DNA, 405 bp, Zea mays
  unsure at all n locations
  Clone ID: LIB148-006-Q1-E1-G11
acattcctgtcagatcccactgaaacaggtctgaagagaagcgctcgacgtggtgcaggtctgtcatattctgtggtgtagttcaagcataagccattacagggaggctcgtcttcaggatgcaagccttttcattatgatgaaggcatacgagatgaaggtgtaatctaaggatgacatgaataaacgccgaagctaccgccagatcgatagcttcggctcatgatgaagatgaagtatgatggtgatgctgaccgaaggggaaaaaagactatttagtccttaataatttgtattttgatcataagtaaatattggggatataaatgtacttttacctgngcttgggctgcgtcncgtgcctataaataggtgaacggtagcaacatactgttcacactgatt

SEQ ID NO: 10526 - DNA, 411 bp, Zea mays
  Clone ID: LIB148-006-Q1-E1-G12
aaagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgcca

SEQ ID NO: 10527 - DNA, 433 bp, Zea mays
  Clone ID: LIB148-006-Q1-E1-G3
ggtctaaattacgggtcgaccacgcgtcgacgacatttgggcgtgggcaacaaaggaaaaggctccgacacctacgaacctccaaagcaatcctggggggccaaccggaaggaaggcaaccacaagccgattaaaggaaccaacaacgttcaactcacaaccaaggaaggactaagacgtctacgacgatgtcatccccgccggctggaagcccaacactgcctacaccgccaaataaactaaccaaataataataagtatcaaatggcacacttgatagacctttattttttattttttatttaataaaaggatataaggagtgtgacaaacaacaacacgaatattgtattgtctatgtatctcctatatatgcaatcccaattttatcatggccacattttaaaatggaatatatgatatatatatgtac

SEQ ID NO: 10528 - DNA, 316 bp, Zea mays
  Clone ID: LIB148-006-Q1-E1-G4
cggccccggaacctggcaacgggccggctggtggcgctcaaaaaggtgcggttcgacaccgtggaccccgagagcgtgcggttcatggcgcgggagatcctcatcctccgccgcctccgtggccaccccaacgttgtcggcctcgagggcatcatcacctcccgctcctctccctccatctacctcgtcttcgagtacctcgagcacgacctggccggcctcagctcctcccccgacatcaccttcaccgagccccagatcaagtgctacatgcgacagctgctggaagggctggcgcactgccatgccccccggg

SEQ ID NO: 10529 - DNA, 406 bp, Zea mays
  Clone ID: LIB148-006-Q1-E1-G5
agccatttctgaaaaccttggcacgacactggtttgttttgggtcagccacacgtttcagttgtcgctgtccctactttgttccgggagtattgagagcttgtgttctgttcacgattgattcaggtgttttcctttgttttgcgtgtttttttttcttcttctttttatcgctgagccgatatatatgcactggttctcctctgaatatgggtgtccttcaccaggactcaatatgtgtaattcttttctgtttcctggtcatgattgtctgtaaattgtaaacattgggtttgatggatatcgacactggagtgtaaagtgttggcggttaaatacacggccctctttcctggctcagcaaaaaaaaaaaaaaagggagagaaaagaagggcgggacccaggac

SEQ ID NO: 10530 - DNA, 423 bp, Zea mays
  Clone ID: LIB148-006-Q1-E1-G6
agacaaaacatggctgtgaatgtgagaaccatgtggtcgtcgatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgttacacttcgat

SEQ ID NO: 10531 - DNA, 418 bp, Zea mays
  Clone ID: LIB148-006-Q1-E1-G7
gtcttccatggcctcctcatagaataagctctatctcaccgcaacaactcctcattacaatccttcaagagagcagcactacactacactacattagagagaggtcgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggaccaggtccctgctgggagtgccccagaaggtcatcctcatcaacggcgagttccctggccccaggatcaactgctcctccaacaacaacatcgtcgtcaacgtcttcaaccagctcgaccatccgctcctt

SEQ ID NO: 10532 - DNA, 423 bp, Zea mays
  Clone ID: LIB148-006-Q1-E1-G8
acccacgcgtccgccgggccatgcgcggcagggacagccagcagggaaggagccattcaggttgcctaccgtcagctgcctgacattaggaagaccgaggtggtagaacgtacatgaccccggcgtcgtcagggaagtatatggattattacagggggcttcggcttcggcataaaggtcttctcttatggcaaagacatacaatgtgaagatgtaacccgaaggtgataagaatggtcaccgaaggtgtagccgaaagagcttcggcttaatatgatgacgaagaccaaatatgatgctgaccgaaagggggaagaagactatttagtccttaatgattcatgttatgataataaatagatgtcagggacataaatgtacttttacccgggttgcatctcgtgtctataaatagatgaacag

SEQ ID NO: 10533 - DNA, 198 bp, Zea mays
  Clone ID: LIB148-006-Q1-E1-G9
agacaacatccatgttcctcctgggcgtcgtctgaatcatgcatgacgacaaggaagattcatcgggcatcaatgcgacagcgtccgagtctgctgggtcgttcaagatcaccacattgggcacctccggaaatagcaagacagagagcactaaagctgtgcaagaggcatgggcatcagcgtacggctgaactggga

SEQ ID NO: 10534 - DNA, 423 bp, Zea mays
  Clone ID: LIB148-006-Q1-E1-H10
acccaagcgtcaacagcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctg

SEQ ID NO: 10535 - DNA, 404 bp, Zea mays
  unsure at all n locations
  Clone ID: LIB148-006-Q1-E1-H11
acccacgcgtccgcccacgcgtccggaagctgcggaaggtcctagcctgcacagatatagaccacgagcaagcatcctacacttcatatgacggaattctgttcaaagctgatgcaccacaccggcaacgagctcttgcagcggacgcaataacctgccggaaattcgccgagcgggcttacaagtacagaccactcaaagttgttgagtttgatcggccctacccacagtgcatagcatacttggatctcaagcgcgacgagtgctctcgactctttcctgcagggcggatatactcgcaagccttccaccttgcagggcagggtttcttcctctcagctcactgtaacatggagcagcaaagcgcgttctactgcttcgggctcttcctgnggatgcaagag

SEQ ID NO: 10536 - DNA, 417 bp, Zea mays
  Clone ID: LIB148-006-Q1-E1-F5
aaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggaaatcgacttggcgccgctggtggaggcggcgaacgcaagcccggaggcgagcctga

SEQ ID NO: 10537 - DNA, 362 bp, Zea mays
  Clone ID: LIB148-006-Q1-E1-E12
acgctgatgcttcgtctggggccaagaagaacatcttcaagcagaagcctccggaagccgatgccgctgcaagcagctgctgttaacatgcttttgccatgctaattccgcgtcctcccgtggatgatgacgatgatatctttgtttggtgtgtcggtttattgtttcttcttcttttggtcctgtatatgctgaatttattacacccacacataactgtacgttggcagcagctatataatatatcgttttttgttgttaaaaaaaaaaaaaaaaaaaaaaaaaaataaaaaaaaaaaaaaaaaaaataaaaatgtaaaacaatgaaactcacaaaaaagaagtaaaaaaaaaggggcggc

SEQ ID NO: 10538 - DNA, 373 bp, Zea mays
  Clone ID: LIB148-006-Q1-E1-E2
aggccccggaaacaagcgcacgccgcatccatccgcgccctacgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaa

SEQ ID NO: 10539 - DNA, 309 bp, Zea mays
  unsure at all n locations
  Clone ID: LIB148-006-Q1-E1-E3
tgcaacttgcaaccaaggaaattaattaaaagaagatcggccccatggcggcaacgacgacggggatgcagatgatgcangtgcagcaagcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaagtacgtcngctgtattagcganagcagaagcgcctgcatcaagcacacaagcaacac

SEQ ID NO: 10540 - DNA, 432 bp, Zea mays
  Clone ID: LIB148-006-Q1-E1-E4
aacccagccttcgaccaagacttcggccaagccttcggcaattccttggttggcggggcaacaacttccctggtggccccggcgggccgcaatgcaaccggtggccgccaatttcgcaaaggccggcaacccaaaccccctgacccctgccggccccttggtacacaacaacaacggaaatttcacggccgggccgtggaaacaagccacgccaccttctacggcgggcgggacgggtccggcaacacggcgggcgcgtgcgggtacaaggacacgcgcgcgcaggggtacggcgtgcagacggtggccgtgagcacggtgttgtttggcgacggcgcggcctgcggcgggtgctacgaagtgcggtgcgtggacagccccagcgggtgcaagcccgacgcggcggcgctggtggtgacggcgaacgacctg

SEQ ID NO: 10541 - DNA, 421 bp, Zea mays
  Clone ID: LIB148-006-Q1-E1-E5
agcttgctcctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattata

SEQ ID NO: 10542 - DNA, 424 bp, Zea mays
  Clone ID: LIB148-006-Q1-E1-E6
acgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaacctcgctcgctcgcttgtccatggttcgagcatccagcagcaacgataccaacatcagcattatttaattggtagcctcctctagctacgcacgca

SEQ ID NO: 10543 - DNA, 420 bp, Zea mays
  Clone ID: LIB148-006-Q1-E1-E7
gcgagcgagcgttcctctccgtccgcttccgccgtttgcccgtcgatcagttgttggctgccggccgggtactaccgcctgcacgagcagcggctagccacagcccacagacagacgacgtcaggtcttggcaggtgtgcaagcagacagagctcgctcggtcgccatgtctttcaccggcacgcaggacaagtgcaaagcctgcgacaagacggtccacttcatcgacctgctcaccgccgacggcgtctcgtaccacaagacctgcttcaaatgcagccactgcaagggcgtcctctcgattagcagctactcttccatggacggcgttctgtactgcaagacgcactttgaacagctcttcaaggaaacggggaacttctccaggaaattccaaggtggaggtggagcatcttcaaa

SEQ ID NO: 10544 - DNA, 419 bp, Zea mays
  unsure at all n locations
  Clone ID: LIB148-006-Q1-E1-E8
acgcgagatgtaccacggcaggcccgacggcagccccgaggaggtggccaggttccaggagggcgtccggcagggcgccttcggcctgctcctcaactccgtcgtcctcggagccagctccttcctcatcgagcccatgtgccgcaagctcaccgccaaggtcgtgtgggtcatgagcagcttcctcgtctgcgtcgccatggccttggtcaccgtcctcagctcctggtcgctcggcgacatcgggggcaacgtgcaggacgccgccgccgtggataagggcctcaagaccaccgcgctcgccatcttcgtcttcctcggcttcncattcgcggtcctatgcagcgttccgtccgccgtgacggcacagctggcggcggccaagggcggccggcaagggctgtgcacgggggtcctca

SEQ ID NO: 10545 - DNA, 403 bp, Zea mays
  Clone ID: LIB148-006-Q1-E1-E9
acccacgcgtccgcgacatttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgaca

SEQ ID NO: 10546 - DNA, 368 bp, Zea mays
  Clone ID: LIB148-006-Q1-E1-F1
acccacacgtccgcacgggccggctggtggcgctcaagaaggtgcggttcgacagcgtggagcccgagagcgtgcggttcatggcgcgggagatcctcatcctccgccgcctccgtggccaccccaacgttgtcggcctcgagggcatcatcacctcccgctcctctccctccatctacctcgtcttcgagtacctcgagcacgacctggccggcctcagctcctcccccgacatcaccttcaccgagccccagatcaagtgctacatgcgacagctgctggaggggctggcgcactgccatgcgcgcggggtgatgcaccgggacatcaagtgcgccaaactgctgggtaacaacagcggcgagctc

SEQ ID NO: 10547 - DNA, 404 bp, Zea mays
  Clone ID: LIB148-006-Q1-E1-F11
gtcagatcttccaaagataaaccagccaacgctgatcatttggggggagcaggatcaggtcttcccaatggagctggcgcataggttggagaggcatcttggggagagttctagattagtagtcgtaaaaaacgctgggcacgcggccaatctagagaagtccaaggaggtgtgcaagagcatcattgactattttcaggaaccgggttcaagtgattgagttggggggaaaggaggtgaagccacaatgtgacggttggaaattctgagctaggacatcgtcctgtgattggcccgcagttttgccgtttccttggcaacttgtaattgtaacaaaagaacctttgtaatcacacggaccatacaagtctcctgtaaattgtctgagggctttctgcgctcaa

SEQ ID NO: 10548 - DNA, 330 bp, Zea mays
  Clone ID: LIB148-006-Q1-E1-F12
atttcaaatgcacagatcaatctgtgggagtatccaaccaacttcaacatcttgcatctattattcaggttcttgacccaaagctacatgaccacctacaaactcttggcggaagtgactacctttttgcgttccgaatgttcatggtgctatttaggcgtgaagtatcatttggagactccttatacctctgggagatgatgtgggctctagaatacgaccctgacattttcttcgcaacatgcgaagaacaaggtgcagtacataaaaataaagtttctaaatccaaactgaaaggactgcgccattttggcaagtgggataaggaca

SEQ ID NO: 10549 - DNA, 410 bp, Zea mays
  Clone ID: LIB148-006-Q1-E1-F2
acgacaaaatggcgtgcacaaacaatgcgatgagagccttgttcctcctggtcctcttctgcatcgtgcatggtgagaatgaagagtcaaagggcatcgatgcgaaagcgtccgggcctggtgggtccttcgacatcaccaagttgggcgcctccggcaatggcaagacagacagcacgaacgctgtgcaggaggcatgggcatcggtgtgcggcggcactgggaagcagacaatcctcatacccaaaggtgacttccttgtcggacaactcaacttcacaggcccttgcaagggcgacgtgaccatccaggtggatggcaatctgctggcgaccacggacctaagccagtacaacgaccatggtaattggatcgacattctacgtgtggataacctgctcatcaccggc

SEQ ID NO: 10550 - DNA, 351 bp, Zea mays
  unsure at all n locations
  Clone ID: LIB148-006-Q1-E1-F3
agctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgacnccatgggagacgcngacgtggacgtggcgccactgatggaggcggtgagcatgaacccgcg

SEQ ID NO: 10551 - DNA, 369 bp, Zea mays
  Clone ID: LIB148-006-Q1-E1-F4
taaacccctcaaattccaagaagcatgttaagacgccctcaatggccacaatggcaagggattaagttaaagtggaaaattgccaaacaaaattttaacaagaagggggaaatatacaaaagaaaatgccaaagccatcaatggacaaaatttgaacctaatggccctccgtcaacctcaaggaataatgcaacctgaattgaagccagagaattttctcttcacaacaagagatgaaagcgctcctatgaagttgattgactttggtctgtcagattttattacaccagatgaaaggctcaatgatattgttggaactgcttaatatgttgctccagaggttctacacagatcatacagtatggaagc

SEQ ID NO: 10552 - DNA, 356 bp, Zea mays
  Clone ID: LIB148-006-Q1-E1-E11
aaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaacccaatctggcacgaggagctaactctgaccgtcaaagatcccagcctacctctgaagctggaggtgttcgacaaggacacgttcagcagggacgaaccgatggggga

SEQ ID NO: 10553 - DNA, 416 bp, Zea mays
  Clone ID: LIB148-006-Q1-E1-C6
accgggaattgcgtatcgaggtcgtcgccggggatgactacgctccggggtccagcggcgccggtgccggaggaggtggcctcgccgactgggcgcgccaccgcaagcgtcgccgtgaggagctcctcaaggagaaagaatctacaactcacatgtcagaccaaacaaattgcaatgaagttgaagcagaagagtgtgatgcgtatgaagaaaatcaagaggaacctgtagcaatggtagaagaatctccacccgatgttggccaagatggtgatgatgggcaaggtattgattcgtcttggactgtggttggtacaccagttttacgagtcaagacaatttatatcagttcagcgattcttgctgcgaagagtcctttctttatcaagcttttctaaaacggcatgaaagaatcg

SEQ ID NO: 10554 - DNA, 367 bp, Zea mays
  Clone ID: LIB148-006-Q1-E1-C7
accgggaactgcataccgatgtcctcgccggggatgactacgctccggggtccagcggtgccggtgccggatgaggtggcctcgcccactgggcgcgccatcgcaaacgtcgccgtgaggagctcctcaacgagaaacgaatctacaactcacatgtcacaccaaacaaattgcaatgaacttgaagcacaagagtgtggtgcgtatgaagaaactcaagaggaacctgtatcaatggtacaagagtctccacccgatgttggccaagatggtgatgatgggcaatgtattgattcgtcttggactgtggttggtacaccagttttactagtcaagataatttagatcagttcatcgattcttgctg

SEQ ID NO: 10555 - DNA, 230 bp, Zea mays
  Clone ID: LIB148-006-Q1-E1-C8
gtgccagcctacgtctcacccttcgctccttcaacacaaactaattaaggagaaggatcgtgccctctttcctctgaccatcgacaggggaggacgggaacgtcacgtagacttcaccctgtagggaaatagtggcctctgattccggcatccggacgactgattaccgctcgtcgttaatctctatgccgaggtggtcctctatcaccatgtgtcgcggactgaccact

SEQ ID NO: 10556 - DNA, 407 bp, Zea mays
  Clone ID: LIB148-006-Q1-E1-C9
cttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagccc

SEQ ID NO: 10557 - DNA, 411 bp, Zea mays
  Clone ID: LIB148-006-Q1-E1-D1
aggaggaagaggaggttctggagaaagaagatgaaggccaggaaggagatcggcgggctggtggacctcgtcaacgatatttcggccaagtcagaggagagcctaagggttagcaaccaaaacatgcccagcagggcgctgacgttcagtcagctgagcgccgcaacggacgggttcagttcgcagaacctgctcggagaaggcggctttggacgggtgtacaaagggctcctcgaggacaccggagaggttatcgccgtgaagcagctgaacagggacgggctccagggcaacggcgagttcctcgtcgaggtgctgatgctcagcctcctgcaccacccgaacctcgtcaagctgctgggctacagcaccgactccaaccagcggatcctggtctacgagtacatgccc

SEQ ID NO: 10558 - DNA, 393 bp, Zea mays
  Clone ID: LIB148-006-Q1-E1-D10
acccacgcgtccgcccacgcgtccgaaactctttgatcttctatctgacagaaggcaactattgatgagggaagatggcaagaaacaagtttgcattgttggtctacaggaatttgaggtttctgatgttcagattgtcaaggaatatattgaaagagggaatgcagccaggagcacagggtcaacaggggccaatgaggaatcatcaaggtcacacgctattctgcaactggctgtgaagaagcatatcatagtaaaagataccaggagacagagagatcgtgatgctaatgaagctaaaaatacaaaggctgtggggaaaatatcatttattgatcttgctggaagtgagcgtggtgctgatactactgataatgatagacagacaaagat

SEQ ID NO: 10559 - DNA, 257 bp, Zea mays
  Clone ID: LIB148-006-Q1-E1-D11
tccggccggcgcatacagcttgtgcgtctggctgtctccggtcggtcgggcttgtcgtgcgtcctccagtccgttgacggtcatgccctctagcggttggtcggtgttcgggagacctgccagagggatcgggagacacagatgtatacgggtatggagtgcctgctggggctgctcaaggtgcgggtggtgcgaggagttgacctggcaatctgcgacccgctcacccacagcagcgacccctacgtcgtcctcgc

SEQ ID NO: 10560 - DNA, 403 bp, Zea mays
  Clone ID: LIB148-006-Q1-E1-D12
acccacgcgtccggcgtgcctagcatgcatgcatgtgacgacctctcctcctcgctgtctctctgtatctgcaactgcaagcaaggaaattaattaaaagaagatcggcgccatggcggcaacgacgacggggatgcagatgatgcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgccggcgtgtccgcgctc

SEQ ID NO: 10561 - DNA, 367 bp, Zea mays
  unsure at all n locations
  Clone ID: LIB148-006-Q1-E1-D2
gcaaggccaataaccttaaccgtgccaaaccggcaaaaaatttcacggaactggaccccgacaaggacaactacttgacggtggaaaaagcgcgctgcgtactgcagagcctcgttacgggggagttctcctatgctacctcacatgccaagttcttgatgaaggctgatgtgaaccatgacggcaaactgtcgctggaggagatgctagacgactacatatccttctacagcaccgtgtatatggatgatcattacgccagtgaaggtgaagtagatagtgattcccgcgacgagctatgagcagttaagccaggacaggacagcaagtcggaggttctttactttcaaatacactangattttgc

SEQ ID NO: 10562 - DNA, 409 bp, Zea mays
  Clone ID: LIB148-006-Q1-E1-D3
cccacgcgtccggaataacacaggtgaccgcaacaatgggatcccccgctaataacatcatggccttgggcgccttccttgcggcgctcgtcgccggcgggtcttgcgggcccccaaaggtgccacccggccacaacatcaccaccagctacaacggcaagtggctcaccgctaaggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcaaggaaaaacctgagtgctcgggcaatccagtcacggtgtacatcactgacatgaactacgagcctat

SEQ ID NO: 10563 - DNA, 387 bp, Zea mays
  Clone ID: LIB148-006-Q1-E1-D7
aggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatg

SEQ ID NO: 10564 - DNA, 394 bp, Zea mays
  Clone ID: LIB148-006-Q1-E1-D8
cgcacaagtccaggacgtctcagcatcatcttctgttgcatcagggaacaaattctgcaagggtggtgcctgtgatttctctgagtccagtaactcctcgagagatgccaaggagagatccacgtccatgaggaagcttataatcgcagtgatgctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcaggtcagatggccacttgctggcatactggta

SEQ ID NO: 10565 - DNA, 405 bp, Zea mays
  Clone ID: LIB148-006-Q1-E1-D9
gacccaagcgtccaggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggccgcgttcgcgcaccacgagctcaacgccatcaaggacgacgacgtcccgtacaagtgcatcgacacctgctccgaggacat

SEQ ID NO: 10566 - DNA, 413 bp, Zea mays
  unsure at all n locations
  Clone ID: LIB148-006-Q1-E1-E1
cacatcacttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcangacgccagcgacacgctgatcacgctgcacaagcagggggagc

SEQ ID NO: 10567 - DNA, 408 bp, Zea mays
  Clone ID: LIB148-006-Q1-E1-E10
acccacgcgtccgccgcctcgccgccgcgctcttccgggccgcgccaaccatgttgtacatcacgccgaaccttgtgtcctgcaacatcctgctcaagggccttgttggcatcggtgacctcgattctgcgctgaaggtgctcgacgaaatgactggatgggggatcgtcccggatgtcgtcacttacacgacggttctcactgcctactgtgccaaaggggatctcgagggtgcacagcagctctttgacgatattattgccagtgggcgtaggccagatgctactatgtacacagtgctcatagatgggtattgccatcgtaggaagttgcaagatgcagcaaggatcatggatgagatgggagctgctggggtgcagccaaatgatgttacatactctgtggtga

SEQ ID NO: 10568 - DNA, 414 bp, Zea mays
  Clone ID: LIB148-006-Q1-E1-C5
acccacgcgtccggccctttccccacctcgatctcgcgctaggttttcgccacaccgctctcgtcctccgcgaagatgccgaagaacaagggtaagggaggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgtcgcctctgccatatccggggcaagatgcacaagaaggtgtggatcgcggccggggacatcgtcctcgtcggcctccgcgactaccaggacgacaaggccgacgtcatcctcaagtacatgaacgacgaagcgcgcctgctcaaggcctacggtgagcttcccgagacgctc

SEQ ID NO: 10569 - DNA, 401 bp, Zea mays
  Clone ID: LIB148-006-Q1-E1-B10
acagagctcctgactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggacagaattgggcgatttacaatatcatggctacccgtgttactcagaagcaaaggtgttgttcattgtatatttgtggtaccctaagacaaacggaactacgtatgtgtatg

SEQ ID NO: 10570 - DNA, 398 bp, Zea mays
  Clone ID: LIB148-006-Q1-E1-B11
aaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcttgccggccccgttcgcgcgccgcctcgcaatcgtcttcgagctcttcgtgggaaactcgacggccgcgttcgccgcgccgcgcggctacgcgctgg

SEQ ID NO: 10571 - DNA, 381 bp, Zea mays
  Clone ID: LIB148-006-Q1-E1-B12
tgcaagcgtctacacagacgtcgtagtatccctggctcactatatccaggagggatcatttggtccagtcgatagacatggacatgcgtcacgtcgtcagatccgtcctctgcaccgtttccttgggaatcgccgtgctaggactctgtcacggttgatgtgcagtgtcatgcctgcggggttttggctatgtctagcgtgcggatgaatgcaagaagagccttgacctgagcaatccacacattgagcacgtcagacgtcgctgtcagtattgaattttacttggcctgttgacacttttggcgagatttgtagattttacagtatcatggctaccgtattactcagtagcacaggtgatgttctttgtatatttgtggt

SEQ ID NO: 10572 - DNA, 415 bp, Zea mays
  Clone ID: LIB148-006-Q1-E1-B2
aataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgccgctcatgctacgaggtgagatgcaaggaaaaacctgagtgctcgggcaatccagtcacggtgtacatcactgacatgaactacgagcctatcgctccctaacacttcgac

SEQ ID NO: 10573 - DNA, 405 bp, Zea mays
  Clone ID: LIB148-006-Q1-E1-B3
cacttcggccaacgcttcggaaaaaactgccccttggcaacaaaacccttgtaacatgggctacaccgaggcttattgaaaacaaggtgaggcaatgcttcgatccaaggctcggaaacaaataccctcaaaaggctgtagccaagatggctgctgtggccgccctctgcgtgcaatacgaaggtgaattccgtcccaacatgagcatcgtcgtcaaggctctgaaccccttgctgcacagccggtctggcaaccgccctactgcctcgtcggcctcccacgctgccgcagcagcatagcgatccggactgtgatttcccatcgctgcgacaactttgggttcacgaaaaacgaccgtcttgtggagcgttggtgttgctgtgtcgtgactgccaacgccttggc

SEQ ID NO: 10574 - DNA, 413 bp, Zea mays
  Clone ID: LIB148-006-Q1-E1-B4
gaacacaattgagcgcaacgatgggatccctcgctaatatcatcatggtcgtgggtgtcgtccttgcagcgctcgtcgccggcgggtcatgcgggcccccgaaggtgctgcccggtcccaacatcaccaccatctacaagggcaagtggctcaccgccagggccacctggtacggtcagcccaacggtgccggcgctcctgacaacagcggtgcgtgcgggatgaacaacgtgaacctgccaccctacagcggcatgacggcgtgcggcaacgtctccatcttcaacgacggcaaaggctgccggtcatgctacgaagtgagattcaacgaaaaaactgaattctcgggcaatccagtcacggtgtacatcactgacatgaactacgagcctatcgctccctaccacttcgac

SEQ ID NO: 10575 - DNA, 420 bp, Zea mays
  Clone ID: LIB148-006-Q1-E1-B5
agacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcc

SEQ ID NO: 10576 - DNA, 348 bp, Zea mays
  Clone ID: LIB148-006-Q1-E1-B6
aggctgatccattggtagatacgtactcgggtggagcagaacagctagagacatggcgactacaagtcctgttgccgccaccgccgccggagtgctgctggtcctgtccgcgcttggtaacgctggcgcgggacgaggacccgtacttgttcttcgtgtgcaacgtgacgttcggtaccaggtctctgctgggcgtgccccagaatgtcatcatcatcaacagcgacttccccggcaccagtatcaactgctccgctagcagtatcatcgtcgtcaatgtcctcattcatctcgaccatcggctctcttccacctgtacagggatgcatcacatgaagaactcttgga

SEQ ID NO: 10577 - DNA, 419 bp, Zea mays
  Clone ID: LIB148-006-Q1-E1-B7
agtgggataggctctcctatgtggcctatccgggatcctcgtcgtggcggtggtcgtcagtgtggtcggcaacgtcacccgctccggcagaaatgccggcgacaacttcacggtcccgatggaggcttcgcttgacacgtccggcaagtcagtcaagtccctgtgcgcgctcagcctatactaggagtcgtgcgataagagactgtcccaggccaccaatcggaccgacaaccgcaatgaggtgttccagatcctggacaaggtggaactgcgctcagtccagacggaggtcgagcagtcgacgtctatcagctaggccaaggctaccgactcgatgaccgacagcgcacgcgaggactgcaataagctcctgtaggatgctgccgacgacctgatgggcatgctcgagatggccggcg

SEQ ID NO: 10578 - DNA, 394 bp, Zea mays
  Clone ID: LIB148-006-Q1-E1-B9
accgagcaccatgcgaggaaataacatgccgcggcacacgtcgccgttcctttttgccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtacagggcatgtgccccggc

SEQ ID NO: 10579 - DNA, 420 bp, Zea mays
  unsure at all n locations
  Clone ID: LIB148-006-Q1-E1-C1
cacaaatgggcgagcggcggcgcccttcaacaggtcttcgtccggccttcaaccggcgacgagcatccaccagaaacgtggagctcagagcattggtgcctctttcctctttcaacaaggattccggtgccttgtttcacaagacanaaaaagtctcaagggtcttgattcttgtatgaactcaagatttatggtggatcttggagctgtgggatgctaagcctggtctagctactagattatgaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatctggggaaaccattgcacat

SEQ ID NO: 10580 - DNA, 404 bp, Zea mays
  Clone ID: LIB148-006-Q1-E1-C10
aatcgtcggcgcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtcccccaccagcggctcctccgcggtcgcacccgccatcgtcggggccgccgtggcctccttcttcgcgtactacattcactgagccgccggacgaggagccggactgccggagggaagagaccaagggggggagagacttggctgcgctgcgctgctctgctgctcccgcgcattcccgatgcgtgggtgggtgtgctctgattgggcacggcagtggcacaccttcgtcttc

SEQ ID NO: 10581 - DNA, 180 bp, Zea mays
  Clone ID: LIB148-006-Q1-E1-C11
agcggaaggccgccgtgcccgttcttcccacctgcagcaaccggccattgcccgcggttgcgttgcatttgcatggctgcccgctgcgctctggaaccttgcactaccggttcggcggcctaggcgcggggcatcttccgagtgcgtgcgtctctgtacacgctcagatcctctctcggg

SEQ ID NO: 10582 - DNA, 406 bp, Zea mays
  Clone ID: LIB148-006-Q1-E1-C12
acccacgcgtccgcggacgcgtgggctgtagctcctgccaaggcacccgagtctgctgccacgagaactgcccccgctaaggcacctcaagccgcctccacccccgccgttgccgctgccccatcgtcgtcgtcgtctacgaagtctggtccatctgccgcgccgaccatcgccgcctctacaccgtcttcttccacggacgaggagttgagcccttccccgtcggcatccaccgccgaggtggcgtcccctgccgctgatgggcctgctgagggaccggcggctgctgatgcctccggtgctgctacccttggtagcggagctgccatcgctggtgtcgccgctgctgtcgctaccatgatcttctactgagttcaccaatgaccgtgtcgtcgagggtgggcac

SEQ ID NO: 10583 - DNA, 328 bp, Zea mays
  Clone ID: LIB148-006-Q1-E1-C2
cccacgcgtccgggaataactctctctcccgtcgccgggatcccgccggtgacaatggtgaggtggctgccgccgccgccgccagcggacggcgagatacccttcggacacgacgccgtcgccttgtccttcttcgtggcgtgtgtggccgccaccgtcgcgctcgcgtcgtccatgtgctcggcatgcggtcgcaagccgaaggcggccacccgtgcagacccggccgcttcggaccagtccaccgggacgggctcgggctccgtctccggtggcggcggaagccaggaggctagcgccgcggaggcggaggaggaagtggtgagac

SEQ ID NO: 10584 - DNA, 373 bp, Zea mays
  Clone ID: LIB148-006-Q1-E1-C3
gcatccacgccggcaacttcgcgcaaatgctccacatcaccgtcaaagactggcccgtccaagaagcgctccgctacgcaaagctcccgctcaagttgcacggggatgcggcggaaggaccggccggacctcgcaaccgtcgtactgccggagctcaaccggttaaggaacctcggccacgcgtacgaggcacgcatgagcgccgtcgggaccaacagtggaagtggcgaaagtaatgaccaggtcagcgggagctcgccgacggcgggtggttcatggagaacggcggagagctagcgggtggtacggcgtggccatgagtcagttagagagcgagcttgtgatggggagagttcctttgttggacggagag

SEQ ID NO: 10585 - DNA, 288 bp, Zea mays
  Clone ID: LIB148-006-Q1-E1-C4
acgcctgatcggccactacccgctggcggtcgtccaaagggctgtagcgctggtgctgcagtgcctcgtcgaggactcgaccatcagggcagccatgggccacgtcgtcgtctcgctgcagtacctcacaatcgcgcaggagcacgacgatgcccaccggtcgtcgcgcatgtacccactcgatcaccgtcaggctgcggcgctcaacatccgggatctgaacgctcatctccgcatgtccgccttgcctctacacgagtgagctaccatattcataatcgatcatct

SEQ ID NO: 10586 - DNA, 108 bp, Zea mays
  Clone ID: LIB148-006-Q1-E1-B1
gcgtccaatcacaagtaggtgcaccacggctcgttatcctcctcttgcactgcagtgcaggtcgtagttgaccagcactagccactgcagacgatgtcgtggcagacg

SEQ ID NO: 10587 - DNA, 342 bp, Zea mays
  Clone ID: LIB148-005-Q1-E1-H4
atttcctttcattggccttttcagcaacagcgatccattctcgtaggggggagagagagagagagagagagggagagaaatcaaagaggagagtgatcatggagcatgtgatcggagggaagtataagcttgggaggaagattgggagcggatccttcggagagctatatctcggtgttaatatacagaatggagaggaagtgggaataaaattggtgcctgtgaaaacaaaacatccacagctgcactatgaatctaaagtttatatgctgctgcacggtggaaacggtatcccacacctcaagtggtatggggttgacggggagtacaatgttatggtga

SEQ ID NO: 10588 - DNA, 270 bp, Zea mays
  Clone ID: LIB148-005-Q1-E1-H5
agcggttcgaaacagaactacctccctccgctgccgccgctgacgaggtgcaaccaagactcgggcttcttccgactgtggaagaaggcggcgctgccgacgtgccaggcgccgccggatgccaccccgcgcggcggccgcggttcgcaccacgtcccgcggccgtccatcagccggggcacgcagcggctctacgtccgcctcaacacgctccactacgtgctgacccacctggaggccctcgacagctcgctgtcgtcctcgacctct

SEQ ID NO: 10589 - DNA, 420 bp, Zea mays
  Clone ID: LIB148-005-Q1-E1-H8
cccacgcgtccgcggacgcgtgggcggacgcgtgggttcgtccccgcgtggagaacgagagacagaaacaggggagcgcccccccactcctcttcgctgccaagaaaccaccattcctaacggatttctacccagtcttctttaggatttccgattcggttctccggtgagagggtgggaattttattttcctccgctgcaaccggtgcaaacatttcgaatccctccattgcattcctctccgtgcaatcgggcattcatatgttccttggctgcattgaggcatcggtactcgaattttgatgtgagctgaccagacatggctgcgagagactgctcgggatcacaggatctgggggggcacacgttctggcccatgctgtcctacgcttgccgcgagctgtgtgtgatcgtactgcg

SEQ ID NO: 10590 - DNA, 406 bp, Zea mays
  Clone ID: LIB148-005-Q1-E1-H9
agcagtaatagctcacatgcaagaaaacatggatacagctgagaagaatcctagctgccacgagagtgaagtatccaaggccaatgttcatgatagcgttctaatgacagagcaaagtgagcgagagcataatcaatgcgaaggtgaatttgcaaacagtcatgtcccaggaagccctgtcactattccggtcaccgtgtccactattgacgggaactctagcaacagtcccaagaagcctgattctgctgagggttttctatgatatgttattgtaaatctagattgggggtgatgatgatagttcatttcagctctttctattggatctgtcatccttcttgcataaatagttttgttcagctcttcagctaaatttttcaccctttagtgttgctttcgggca

SEQ ID NO: 10591 - DNA, 410 bp, Zea mays
  Clone ID: LIB148-006-Q1-E1-A1
acgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggc

SEQ ID NO: 10592 - DNA, 396 bp, Zea mays
  Clone ID: LIB148-006-Q1-E1-A10
gatgcaaaactctaaatgagcgtcgtcatacgcctcctcatcccggtcccgttcgaccagcccccgccggagaacgaccacgtggtgctcatcggagactggtacaccaaggaccacgaggtgctagcccgccagatcgacgccggcaagggggtgggccgccccgcgggcgtgctcatcaacggcaagggcggcaaggacctggacgccgcgcctgccttcaccttcgacgccggcaagacgtaccgcctccgcgtctgcaacaccgggattaaagcgtcgctcaacttccgcatccagggccactacatgaagctggtcgaactggagggctcccaaaacctgcagaacacgtacgactccctcgacgtccacgtcggccactgcctctccgtg

SEQ ID NO: 10593 - DNA, 370 bp, Zea mays
  Clone ID: LIB148-006-Q1-E1-A11
cgggccgacccacagcgtccagccgcatccgcggcacgccgcgccgcatcccgtgcccgcgcaaaaccggatccgccgccgccatggcggtggaccgcgtggacggcgaggaggcgttcgaggaggtggacccgacggggcggttcgggcggtacgcggacgtgctggggctcgggtccgtcaagaaggtgtaccgcgggttcgaccaggaggaggggatcgaggtggcgtggaaccgtgtccggctgcggtcgctggccgaccgcgaccccggcatggtggagcgcctccacgccgaggtgcgcctcctccgctcgctcagccacgaccacatcatcggcttccacaaggtgtggctggaccgcgacgc

SEQ ID NO: 10594 - DNA, 372 bp, Zea mays
  Clone ID: LIB148-006-Q1-E1-A12
gaatgcaacatcggtttccaccattttcctctttacagaatactactgctccgtgtatacggagaaactacatttcacggagtagtaaataaacagggattaattagcgccgtgtgcatgcatgcatacggcgttgggctggccgacatgatcataacaattaattaattaattaaggcgaagacacgaagcgtggaggatcgatgcgtccccgccgccgcagtatgttttaagctgacttgcggtagatgtgttgtggcctgccggcggcggcgtccttctgggtgtctatgacagtctcgaaggcgccgacgagcgccttgaccctgctgcactggcgcttctgcatcagcttggtgcgtgccgcctcga

SEQ ID NO: 10595 - DNA, 326 bp, Zea mays
  Clone ID: LIB148-006-Q1-E1-A2
cggacacgtggggcgccgctggccaagcccggcgccaagggcggccaggcggtggcggtgcggctgttcgggaccaagacgcagatctacaactgcaccatcgacggcggacaggacacgctgtacgaccacaagggcctgcactacttcaagggctgcctcatccggggcagcgtcgacttcatcttcggcttcggccgcagcttctacgaggactgccgcatcgagtcggtggtcaaggaggtggcggtgctgacggcgcagcagcgttccaagtccatcgagggcgccatcgacaccggcttctcgttcaagaactgcagcat

SEQ ID NO: 10596 - DNA, 259 bp, Zea mays
  Clone ID: LIB148-006-Q1-E1-A3
agcacagcaatcaacggcccgcggtagcaaccaagatcctctccaatcgcctcccttcgccaaggtccacggcggtgaacctggaaacgggaaaaaaatattccgcacaaagtgcgcgcagtgccaaaccgtggatcgaggtaggtcgcacacgcagggacccaacctgcactgcctcttcggtcgtcagtcaggcaccaccctcggctatgcctactccacggccaacaagaacatggccgtcgtctgggaagagggc

SEQ ID NO: 10597 - DNA, 331 bp, Zea mays
  unsure at all n locations
  Clone ID: LIB148-006-Q1-E1-A4
cggaaccggaaagctcaaccgctcaatcaacggggtgaccgacgggaacggaacgtaaacgattcaagctcaaggacagccacgaggaggacatctgctaggtggacttggtggaaagcccgcgcaaggactgcgaccaggtgcacgcagacagggaccgcgccggcgtcctgctcaccatcaacgtccgcatcagcgacaacctgcgccccgctaaaccgctcggctacctcaaggacttgccgctgcncatctgcgcctcgctgctcaaacagttggactcggacgacgacgacgatcagtaatagcacatctacgacgactatcgata

SEQ ID NO: 10598 - DNA, 372 bp, Zea mays
  Clone ID: LIB148-006-Q1-E1-A6
acgcgcatctcgcggtggtgctcctcctcctcctccccctgctcccggggcgggcgctctcctgttcctcctcctcctgctgctggtgccagggccgggagggcggcgcggaggtggcgctcatggggctcgccggggacgggtcggcggacaccgccaacctcagtaatagtgaaaatggtcggttcagttatggagttgcaagttctcccgggaaaagagcatcgatggaggacttctatgaggcaaggatagacgacgttgacggagagaaagttggaatgtttggtgtgtatgatggtcatggaggagtcagagcagctgagttcgttaagcagcatcttttcaacaatttaatccaacacccaaagt

SEQ ID NO: 10599 - DNA, 416 bp, Zea mays
  Clone ID: LIB148-006-Q1-E1-A7
agttccgatcctctccgccgtcgcgatggcggcctcctgccgccgccgccgtcacacgccaccgcacagctagctaccgacgaagacaaggcgggcaatggccaaggcgcccctgccgcttccgtcgctgctcgtcctcaccgccttcttcttccaccacccctgctgcacggcgcaaggccgcgccgaaaacatctcggaggtcgatgccgcggtccgcgcccgcgcgtccgagctgctccgcgacgccagcagccagctcgtcgacctgcccctcccggccaacctctccggcgcgggcgtcagggcctcggccctcaacgtgcgcagcaacgcgctctgggccggaggcgtcaacaccaccggcttcaccgtctcgccgcgcgtcgtgccggccccgttcgcgcgccgcctcg

SEQ ID NO: 10600 - DNA, 418 bp, Zea mays
  Clone ID: LIB148-006-Q1-E1-A8
agctccggcaacctcgctggtccgaaccccgacccgtccaggatgctggaggaggcagagatgggcgtgacgcaggggcagttcaaagccaagcaaagcaacctccaggccatggtgatcggcggcgcggcgggtggcgcggcggcctttgggatagtagcggccatatgcgtcgtggcttaccactcgaagaagaggcgggcgctgggtaacagcgtgtcgcattcatcgggatggctgcccgtctacggtggcaactcgcacacaaacgccagcaagtcgtccggcggcaagagcgcggcgctcaacccgaacatcacggccatgtgccggcacttctcgttccaggagatcaaggcggcgaccatgaacttcgacgagtcgctggtgatcggcgtgggcgggttcggcaaggtgt

SEQ ID NO: 10601 - DNA, 430 bp, Zea mays
  Clone ID: LIB148-006-Q1-E1-A9
gggccgacccaaacgtccaatcagcgtggtcagccgcctcctcatcccggtcccgttcgaccagcccccgccggagaacgaccacgtggtgctcatcggagactggtacaccaaggaccacgaggtgctagcccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccgggatcaaggcgtcgctcaacttccgcatccagggccactacatgaagctggtcgagctggagggctcccacaccctgcagaacacgtacgactcgctcgacgtccacgtcggccactgcctctccgtgctcgtcgacgccgaccagaagcccggcgac

SEQ ID NO: 10602 - DNA, 361 bp, Zea mays
  Clone ID: LIB148-005-Q1-E1-H3
accacgcgtccgcccacgcgtccgagcgaaccaagagagcagggtgtgggcgaagagaccccagccagtcgatcgttcaagaaaaataccagcttagcagcaacagcagcagcaagcccacccgttcgacgacatggcccgcctcggcgccggcgccgtgttggcgctcctattggcggtcgcggcggtggccgcgttcctcgcggtgccggcctcggcgaagtccggggaagctaaccccaagggggttgtgggcggcaaaggccggaaccgcgccggcccgcaaaaattctcgggcgcggtgggcgaatgcgacgttgacgatgcggaggagctcgggctgagcggcggcggcctcggc

SEQ ID NO: 10603 - DNA, 247 bp, Zea mays
  Clone ID: LIB148-005-Q1-E1-F9
cccaacaaggccacgatatccccggcaaatccaatacgccatttaaggacccccccaaggccaacatggccaagcaataagctaaaggtgggaatttgctccacaaagttttaccaccaggtgggagatatgccaagaaggagaccaaaccgatcattgtccagatttcgagcgtactggcctactatcacctccagggattattccaccggattttgagccccgggaatttccccttcaaaacagg

SEQ ID NO: 10604 - DNA, 248 bp, Zea mays
  Clone ID: LIB148-005-Q1-E1-G1
acccacgcgtccgcccacgcgtccgcgcccaccaggatccgcgtggccttgctgagcttggcgctggtggggctgctcatctgccacctcgccaccaccgcctccgccggcaagaacagaatccgcatcctcgacagcgtcgacgactcggccggggacaacaacagctccgacgcctcggccggggacaacagcaccgactccgagtcggaatgccgcgtcgtcgattccgacatgaagctggctga

SEQ ID NO: 10605 - DNA, 111 bp, Zea mays
  Clone ID: LIB148-005-Q1-E1-G10
cgtcaatatgagttaagtttcaggagccggtagaaggttgccaccagagtgattgcgaacctttgacggtacaccctttcttcagacaacccgggccctgggccttgcggg

SEQ ID NO: 10606 - DNA, 355 bp, Zea mays
  unsure at all n locations
  Clone ID: LIB148-005-Q1-E1-G11
cccccttctcttcggttcggccaaccgggccaccagcggggcggttcttgacttcagcaggcatggtgaaggcctaccccacggtgaacgaggactacctcaaggcggtcgacaaggccaagcgcaagctccgcggcctcatcgccganaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctacca

SEQ ID NO: 10607 - DNA, 202 bp, Zea mays
  Clone ID: LIB148-005-Q1-E1-G12
aaaaccacaatccttcgtctcaacccgtcacatgatcatcacaaccgcccagcaataatggcgcatagcatgaggattgtggcgctggccctgttggccctgctggtggtggcggcggcggcgcccgtggccaccgcgtacggctgctacgacgactgctacaagcgctgcgccaacggcaagaaagaccccgcctgcacca

SEQ ID NO: 10608 - DNA, 439 bp, Zea mays
  Clone ID: LIB148-005-Q1-E1-G2
ggccgatgcacgcctctagcgagagacgagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgccgtgggcgagtgcgacctggacgacgcggaggagctcgggctgagcggcggcggcctccgctccgacgacgcggtgcggtcggagctggcgcaacggaagccgaccaaccggtacatcagctacgcggcgctgcgcgcggaccaag

SEQ ID NO: 10609 - DNA, 396 bp, Zea mays
  Clone ID: LIB148-005-Q1-E1-G3
ctgggctctggcctagcctccactgtctcccagtccccaggtcctcatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaaggtcgcgatcgcatcgtgcgcgtcctccccatcgatctcgagggggcgccccgcgaggtcgtcggcctctccgggcagacactcctccgcgcgctcggcaacgcggagctcaccaagccgggctcccaccggctcgaggatatcgacg

SEQ ID NO: 10610 - DNA, 401 bp, Zea mays
  Clone ID: LIB148-005-Q1-E1-G4
gtcaagcccagaggatccaactgcatggacttggctgatccttgcgctcaatactacgtggaggcgtacctgaaccagccagaggtgatgaagaccatccgtgccaacacagggctcaagtacagatggactagatgcaggggcacgttctacaacctgctcaagttcggtgactcgccgtcgaaatcgatgctgccctacgtcaaggccgtcgccgccgccggcgtccgcgtgtgggtcttcagtggcgacctggacgccatggttcccgtgatcgcgacgaagcggtccatggagaagctcggcctcggcgtcgtggaggactggcgcccctggtccatcgacgccaaggaccaggaggtcgccgggtacgtgatcgagtacaagggcgtggtgttcgc

SEQ ID NO: 10611 - DNA, 402 bp, Zea mays
  Clone ID: LIB148-005-Q1-E1-G5
catcttcaaagtcatcctcgccaccaaagggtgaatcaaattcttctcccagtcctccatcgaaatcgtccctgtcaccaccgccaccaccaaagaaaagtggtagtacgtctagctctaaagatgggaagacgaagaagtcgtcttcatcgtcttcatcgtcagataatacagccgctgtgatcaccggcgtggtgcttggggtggtgggcttcgctctgctcttgtccatcgtggcgtgcgtgtgctgcgccaagaagaagaagaaacgtccgcccccaatgaacatgcccttctacaccgacgagaaaggcaatgtgtattaccccaacgctggtctgccgcctatgtggcagcaatatggcagcaacggcagcatccctccgccgggatggcaccatc

SEQ ID NO: 10612 - DNA, 199 bp, Zea mays
  Clone ID: LIB148-005-Q1-E1-G6
acacataccaaatcatcgtcgccatcgcatcgcaacacagggtcttccagggttcctgcatcaatctatttccagacaccaaaggcaacaatacatcgatctttcaatacttccacctccatcttcggcatggccatcagatctccttcatccatcctcatccacatcatactcaagccaaccgttagtaaatgatgtg

SEQ ID NO: 10613 - DNA, 414 bp, Zea mays
  Clone ID: LIB148-005-Q1-E1-G7
gccaggaccaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaagggcaaagttgtgataccggagaacaagcccttcatcttcgtgaagggcaacggcaaaggccggacctccatctcccacgagtccgcctcttccgacaacgcggagtccgccgcgttcaccgtgaac

SEQ ID NO: 10614 - DNA, 317 bp, Zea mays
  Clone ID: LIB148-005-Q1-E1-G8
cccacgcgtccgcccacgcgtccggtcgtgcggccacatggcgaccccgcccaccgagacaccgccgatcacgcccagcaagaagcaggacgacaagccgaagccggggccggatgccgccaccgcggcgaactaggcgtcgttgtggtcgcgcaagagcttcaggcagcgcgctgcccgcgctttccgccgcaacatgtcgggcgtccgcgtcaggacggtcacggacctcgcccaggaacgggactcagtgcgcgccgtcagcaacaaggtctccgatgaagccgagggcgctaccgcggtgccgcctgcaggtg

SEQ ID NO: 10615 - DNA, 369 bp, Zea mays
  Clone ID: LIB148-005-Q1-E1-H1
acccacgcgtccgcgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattagggtggacacgtaattggctgtgctgtaatcgctctcgtctggtggggagggagggaccaagtgtttctttgctttgctcacttcgtttgctcttgtaacattatggggtcaaccgttatgtaactaatggatttgattaatccggtctctaaaaaaaaaaaaaaaaaaaaggcggccgc

SEQ ID NO: 10616 - DNA, 396 bp, Zea mays
  Clone ID: LIB148-005-Q1-E1-H10
cttcaaatttcatttgacaaaaccgggaaaaaggtaattcaattggacatgacacataactttgaggtaaggtatggctttcggaagaaaaactgggagattgcaagatgggttgctcttggcgttgttgtttttgaggcagtgctctttctattagctctggttgtcacggcaatgaacaaacctgcggagtatgacagtgatgatgaaattattgcaattggacgaagccctaccatgcggcagccattgatccatgcccaaaatgtgccggccaccggtgttcctgtcccaacactcgatcagcgttcaagtagaaatgatgcctggagccaaaggatgcgatagatgtatggtctggacacgagccagttcacgtacaacccctcataccca

SEQ ID NO: 10617 - DNA, 396 bp, Zea mays
  Clone ID: LIB148-005-Q1-E1-H11
tccgggaatacgaacgtcgtacgagaacctttctcgctcctctacctttctccttttcttgcgacggcagaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcga

SEQ ID NO: 10618 - DNA, 371 bp, Zea mays
  unsure at all n locations
  Clone ID: LIB148-005-Q1-E1-H12
aattgtcggtgaaggggaccaaccccgttaattggacggagatgaaccgcaactgggggcaattgtggcagaccggggaggacctcacatgcgagtcgctgacgttccgggtgatgaccagcgaccaccgcaaggccacctcatggcacgttctccctgctgactggaagttcggcgtcacgtaccaggcgtccaagaacttctaagtagccactttccctcctcttcttcaacctgcatgcccgcaagcagccatgcagatgataacatgcatcatgcatgcatattcattctttcgctcatgcactccgatacggtgccggagttaaaaaaatataaatcaatgtgcaaattcanatgacananaaaaa

SEQ ID NO: 10619 - DNA, 439 bp, Zea mays
  unsure at all n locations
  Clone ID: LIB148-005-Q1-E1-H2
aacgtgaagaccaccatgtacgcgccgccgttcaccacgcacggctgctccatgaaccagcggctgctgatcctgcgtgtcaccgcgttcgtcgaggagggccggagctacagggtgaccgtggacgcgccgagaaagccggagctggcgccgcgagggtactacctgttgttcgtggtggcgaagggcgtgccgagcatgggtgcgtgggtgaaggtccggtgagatcgatcagctcacatccaccgtgtgggtcgctgcgggatcgtgtacacaagtggagagccagcctaactctctctctctctctctgtgtgtgtctctttgcgttctttggttttgttttcctgctanggatggatggatgtaaataggatcgatcagattggccagttcaccgctggatcactctnataggttgattggatacctgcccaca

SEQ ID NO: 10620 - DNA, 372 bp, Zea mays
  Clone ID: LIB148-005-Q1-E1-F7
acccacgcgtccggaaaatgatcctttcacgagaatgatggtgtttgagttcactccacatggtagtctctcacagcaccttcacgtcaaagagtttgagcatctggactgggctgcgacgatgagggtcatcatgggcgtcgcatactgccttcaatacatgcaccatgagctcagtccacctatggcgatccacgacgtgcggtctgacagaaccttcatttcagatgattatgctgccaagattgcacatgttggtgtatggaacgagcttgctgcaaaagcaaatgttggaaacgacgacggcagcaccccgttctgaagctcctccggctctcccattcagcgcctactgcttcggcgcgctcatga

SEQ ID NO: 10621 - DNA, 281 bp, Zea mays
  Clone ID: LIB148-005-Q1-E1-E11
cggcggcatgacggcttgcggaaacttccccatcttcaaggacggaaagggctgcggctcatgctacaaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcaaaagggtgcgatgcaagtaccccgccgggc

SEQ ID NO: 10622 - DNA, 413 bp, Zea mays
  Clone ID: LIB148-005-Q1-E1-E12
acgagcaccccgccggctagggttacggccaccgccttccacgcctcccccacttcccgtaggcggaggctggtcggcgtgcacgcgaccgcggcggcggagatggacccggacttctcgcccgggggcggggggcccagctttgaattcgccttcaacgaggtcaacttctccgaccgggaattgcgtatcgaggtcgtcgccggggatgactacgctccggggtccagcggcgccggtgccggaggaggtggcctcgccgactgggcgcgccaccgcaagcgccgccgtgaggagctcctcaaggagaaagaatctacaactcacatgtcagaccaaacaaattgcaatgaagttgaagcagaagagtgtgatgcgtatgaagaaaatcaagaggaacctgtagcaatggt

SEQ ID NO: 10623 - DNA, 438 bp, Zea mays
  Clone ID: LIB148-005-Q1-E1-E2
gggtcgagcacgcgtccgcaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatgaagcggcggcggctaccgcggtgccgcctgcaggtgccagtgccaagacctccagcagcaacgatgcgcgcgacggcgccatgggcagcgtccaggacgagccgcggcagcagcgc

SEQ ID NO: 10624 - DNA, 425 bp, Zea mays
  Clone ID: LIB148-005-Q1-E1-E3
gggccgacgcccgcgtctacagatagtcctaatggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcaccctccagcagcagctcttccgactagccgcccggcagagatatctacggcgtccgatcagtctttggcgccacctatgacctatcggattctgcaaagctatgtatgattctatggtataatgtgtggttgccgcaaacgcgcggaaataatgtgcttgcgtg

SEQ ID NO: 10625 - DNA, 99 bp, Zea mays
  Clone ID: LIB148-005-Q1-E1-E4
agaaacatgcaaatggagaaggaattgtttctgcctttctaagattcttcttagcacaatgtgcaaaactttttcataatgtaagagagttctggcgtc

SEQ ID NO: 10626 - DNA, 380 bp, Zea mays
  Clone ID: LIB148-005-Q1-E1-E5
ctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaaaagggggaggaagagcagcaaggtgatgtccatctcgattctggatgagccgtgaaccttgaggagtgaaggctttgatggctttcgccagcctcttggtcttgaagagctgctaacatcgcagcatgatgactaccacatgatgctaagatttctc

SEQ ID NO: 10627 - DNA, 402 bp, Zea mays
  unsure at all n locations
  Clone ID: LIB148-005-Q1-E1-E7
gtactgccccaacaacatctgcgtcaagtccggcgcctccaaggtggccgtcaacgacgtcgtcttcaagaacatccacggcacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatccatcactcactcttcgtcacctctctctttctcactctcgccagtctttttttaggcctctggcaatctgcgaactttcttattcattctactagtgtggatctataattccattcaanatatatacatg

SEQ ID NO: 10628 - DNA, 405 bp, Zea mays
  unsure at all n locations
  Clone ID: LIB148-005-Q1-E1-E8
agtgcattgcttcggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaatgtcacgtacgtggtggaccccagcggcaagggcgactacaccaacatcaccgcggcgctggaggatatcccggtgagcaacaccaagcgcgtgatcctggatctcaagcncggcgctcagttccgcgagaagctgttcctgaacatcagc

SEQ ID NO: 10629 - DNA, 380 bp, Zea mays
  Clone ID: LIB148-005-Q1-E1-F1
cccgaccctacatcgagtcctgctacaacaacatccgcgtcaactccggcgcctccaatgtggccgtcaacgacgtcgtcttcaagaacatcgacggcacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatccatcactcactcttcgtcacctctctctttctcactctcgccagtctttttttaggcctctggcaatctgcgaactttcctactcattccac

SEQ ID NO: 10630 - DNA, 369 bp, Zea mays
  unsure at all n locations
  Clone ID: LIB148-005-Q1-E1-F10
tcactttcacgggccgggtggccccgaccccggcccgttacccacccttgaaaagcccctcttgcaagaacaagtcaacaacggaaaaggccttcaccggaacaatcgcctccggggatacgcccaaaaccagcctggggataacggacgccttgctcaacttaaggctcgcaaccgacgccaacatcaacaaggccaacccggagggggacaaggacaagatcgcaaaaatccttgctgcatacggcaagacggccgacgcggtcgctgcggccccgcttcccgagaagctcacagtcatggagaagaccttctcggcggtcgccgccgccgctcatcaggangccgcagcagctgctgctgctgctg

SEQ ID NO: 10631 - DNA, 225 bp, Zea mays
  Clone ID: LIB148-005-Q1-E1-F11
atctccatctctcgcgtctccttggtgtccgtgttcacgccgtcgctagcgcctgccgcggcgaagcttctgccctccccggcgccgggctcgggtcttcgtcggccaggcagctgctacgcgtgaacacggtcacaccagtaccacgtgacgtgaacggtgaactcgtgaagaacagagccgccactgaggaaccctagcgacggcggcgtgctaccggtgaca

SEQ ID NO: 10632 - DNA, 341 bp, Zea mays
  Clone ID: LIB148-005-Q1-E1-F12
tttcttccctccgtcataataccgctgcagcttctgtgcttgccttgcctcttcacgttcttcatcctcgccgacgcggcggcgccacaggtcggcgccatcggcatcccgctcattcgcggtggccatagcaggccaggagcgccggccaagctcgcgccaccgaagccgatacctctcaggcacgcggcgccggcgccaccgaagctgacgccgattgcctcaggcgcctacatcgtgcggagcctgtgcctgaagaccgactactccgacctgtgcatgtcgggcatcgcgaagctgccgcagtcgcagctgccggtcgggaagcggctggacagcgc

SEQ ID NO: 10633 - DNA, 349 bp, Zea mays
  Clone ID: LIB148-005-Q1-E1-F2
gaagcaggccgacccgttgctgggcaagaggtaccccgtgaaggggctgttccaggcgctcgccgtcgcgtccatgtgcttgcaggaggacgctgccagccggccggggatcagcgacgtcgtctcggcgctctcgttcctcgccgatccgcaatactaccctccccaaggcacgggagccgagcagaaggccacagatcgagagagtaaacccaacgacaattctacagacaaggatagcagtcctcataaggccggaatgatcagggcagacgacgaaacgaagcatagatgatgaccgtagggggggaacgctaacgacgggaattaaaagggaggaacactgcag

SEQ ID NO: 10634 - DNA, 356 bp, Zea mays
  Clone ID: LIB148-005-Q1-E1-F3
cgagttcgacgccaccaccgcgcggtgcgtgacgttcgcggccagcggggaggtcgtggccacgcacgccgtcgcgccgggctccgcgtgcgcggtgaacggcacgggtcacttcggtatagcggtgctgctgcccgagacgccgccgccagcctcggccgtgagggccaggtggtgggcgtggacggtgggtgtcggcgccggtggggtgctgggagccagcgccttgacgctctctgtgggcggcgcggtgagctggaccaggatgccgcgaagggaggagatggatcggcgggcgatggccggggaggagctggggaggatgaccgtgcgccggaacaagatgccatcggcga

SEQ ID NO: 10635 - DNA, 413 bp, Zea mays
  Clone ID: LIB148-005-Q1-E1-F5
cccacgcgtccgcccacgcgtccggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgacgtgccggtccgtggacagccctagcgggtgcaagcccgacgcggggggacgggtggtgacggtgaccga

SEQ ID NO: 10636 - DNA, 428 bp, Zea mays
  Clone ID: LIB148-005-Q1-E1-F6
acccacgcgtccggaaaatgagcctttcacgagaatgatggtgtttgagttcgctccacatggtagtctctcacagcaccttcacgtcaaagagtttgagcatctggactgggctgcgaggatgagggtcatcatgggcgtcgcatactgccttcaatacatgcaccatgagctcagtccacctatggcgatccacgacgtgcggtctgacacaaccttcatttcagatgattatgctgccaagattgcagatgttggtgtatggaacgagcttgctgccaaagcgaaggctggaaaggaggacggcagcagccgtgctgaagctcctccggatctcccaagcaacgcctactgcttcggcgcgctcatgatcgagaccatatccgggagggttcctgacccgtatgatcacaaacccatatgcagct

SEQ ID NO: 10637 - DNA, 401 bp, Zea mays
  Clone ID: LIB148-005-Q1-E1-E10
tctcctgctggttactccgcgcgccttctctttctctcccggacgtcgatcgtgttcttcagcacgggctagctagctccctccctcccagccatggcgacgccggacaacaaagggcacgggcatccgctgcccaagtttggggagtgggacgtgaagaatccggccacgtccgatggcttcaacgtcagattccacaacgcacgctaccacaagagatccaccagcggccctggagctcggatcgcacactcatgccattcgccggtcttcacgaactgcggaggtgacagtgggtacaggcccgatttcggagacggcaaccattacacgccgcccaaacggtagaagtgggccttctgtcgctgctgaatcgaaactcgctgtgctgctgtgctgac

SEQ ID NO: 10638 - DNA, 397 bp, Zea mays
  Clone ID: LIB148-005-Q1-E1-C5
cccacgcgtccgcgccgaggtcgccgcgcaccgcctcatcttcctggactcgcgccactccttgtaccagggcctgtacgcccgcagcgtggcggacgcccgcatccgccccgcgctccgcctgctgaagcagaacctgtcgttcctggtgtccgtgctcgcggaccgcgcgcagcccgtggcggtgcgggaggtgatgcgcgcctccttcgaggcgttcctgatggtgctcctggcgggcggcaacgagcggagcttcgtgcgcgccgaccacgccacggtggaggaggacttccggagcctgaggcgcgccttctccacgtgcggggaatggctggtccccgagacgtggtggcgcgggatgcagagaccgccgaagccgtcgtggggctcatgg

SEQ ID NO: 10639 - DNA, 427 bp, Zea mays
  Clone ID: LIB148-005-Q1-E1-C6
cccacgcgtccgcgacgcgccggcgctgaagaaggcggacatcggcatcgcggtggacgacgcgacggacgcggcccggagcgcgtcggacatcgtgctgacggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggagctcttcttctac

SEQ ID NO: 10640 - DNA, 423 bp, Zea mays
  Clone ID: LIB148-005-Q1-E1-C7
ctcgccgcccggggagaaggagggctccgccgctcccggggaagagcgcgccattgccgccgccgcgctgactggggaagatggttgtccaggagttcacagttgatctcaacaagccccttgttttccaggttggccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcataccgttcatgacgtagctatgatggctctgtttgggatatttatttggactctgatcgaatacactttgcaccgcttcctgttccacatcgagaccaagacctactggt

SEQ ID NO: 10641 - DNA, 109 bp, Zea mays
  Clone ID: LIB148-005-Q1-E1-C8
agtcgccgtccggttagatcgatggatccaacgatgacgtcgaccagcgcgcgattggcgacgctggcctgactgaggaagacggctcgcaaatcgttcagaggtaatg

SEQ ID NO: 10642 - DNA, 159 bp, Zea mays
  Clone ID: LIB148-005-Q1-E1-C9
agcctcgacggccattacgcgctgccgggcgtcaaactgtgcgtagcgctggcgctgcagtacctctccgtagactctactacagacgtgagccatggaccatgtcgtcgcgtcgctgcagcagatcagtaatccccatatagcaccaaggatgcccac

SEQ ID NO: 10643 - DNA, 377 bp, Zea mays
  Clone ID: LIB148-005-Q1-E1-D1
cccacgcgtccgggctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacg

SEQ ID NO: 10644 - DNA, 301 bp, Zea mays
  Clone ID: LIB148-005-Q1-E1-D10
cctctcctagtgtcaatgctgctcgtcaggctcgcctcagtctcctataacgacgaggaccgcggcggcgtaactaaggcccacgtcaaccacggcatgtttaaggcggcaccgtggtccaactggcacgcgacttactacagtggggcacagcggttagctgacacgaccgacaggggcgcatggtgatacaacggcgacctgtgcaaatcatgaatgtagctgtatggaggcttttcatacttcactttacaccaacggcacccggtacggtgcgtactactatctcaatggtcccagt

SEQ ID NO: 10645 - DNA, 392 bp, Zea mays
  Clone ID: LIB148-005-Q1-E1-D11
acccacgcgtccggccggagcaaaaagcttgtgcgtctggctgtctccggccggccgggcttgtcgtacgtcctccaatccgttgacggtcaggccctctagcttttgctcggtgttctggagacagagcgagagagagagagagagagagaggtagacggagatggagtgcctgctggggctgctcaaggtgcgggtggtgcgaggagtgcacctggcaatctgcgacccgctcacccacagcagcgacccctacgtcgtcctccgccacggaaagcagaaagtgaaatcaagtataaaataccgcacgattaacccagaatggaacgaggagctcaccctgtccatcacgaacatgatgaacccggtcaagattggactctttcgacacg

SEQ ID NO: 10646 - DNA, 201 bp, Zea mays
  Clone ID: LIB148-005-Q1-E1-D12
ctcctcccccgccggccaacaactcagccgccgcaaccgccacatcagccatgggcgcctgcgcagccaagcccaagacgcttgatgggcaagccccaattgaggccgccgtcgccacacccaaggttacgcccgaggccactccaatctccgttgaggtttccgctgatgaacaggtagcttataaggtggtcgtggtgg

SEQ ID NO: 10647 - DNA, 427 bp, Zea mays
  Clone ID: LIB148-005-Q1-E1-D2
acacaaccgttgccctacctgcaggcaagagctgggcgacatcaggtgcctggcgctggagaaagtcgccgagtcgctggagctcccctgcaggtactactcgctggggtgccccgagatcatgccttactacagcaagataaagcacgaggcgcagtgcggcctgagaccgtacaactgcccctacgccggctccgagtgcggcgcggccggcgacatcccttccctcgtctcccacctgagggacgaccacaaggtggacatgcacagcggctgcaccttcaaccacagatacgtgaaatccaacccgcgggaggtggagaacgccacctggatgctgacggtgttccactgcttcggccactacttctgcctgcacttcgaggcgttccagctcgggatggcgcccgtgtacatgggcttcctc

SEQ ID NO: 10648 - DNA, 401 bp, Zea mays
  Clone ID: LIB148-005-Q1-E1-D3
aggctgattcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgc

SEQ ID NO: 10649 - DNA, 409 bp, Zea mays
  Clone ID: LIB148-005-Q1-E1-D4
cgtccactgcgatcctctccagcacgaagatggcgttcatcagcaatgtcgcattgaacgcggccgacgtggccgcgctgctgctggtcgcaccggtgtcgcctgccgcgcacgcggtggcggtggcggtggcgggaggggcgccgtcagtgccagcgggtccgctggacatcgcgcagctgggcgccaaaggcgacggcaagtcggacagcaccccgatgatcctcaatgcgtggaaaaacgcatgcgaagcgacgggggtagagaacatcgtgatcccgtcgggcaagtacctgacggtcgggctggagctgaagggcccctgcaagtcctccatcatcaatcagtctcgaacgcaacctgctcggcaccggggacctcagggcgttacacatgaactggatcgaga

SEQ ID NO: 10650 - DNA, 391 bp, Zea mays
  Clone ID: LIB148-005-Q1-E1-D5
cggacgcgtgggctagaccagaacatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccagga

SEQ ID NO: 10651 - DNA, 404 bp, Zea mays
  Clone ID: LIB148-005-Q1-E1-D6
cagcgtctccaccctccttccaagggccacgatgagggcgcctctcctctcctcgctcctcgtcctcgccgtcgtcgccaccgtgcctctactactcccggcggtgtgcatctcgcggcacgacaagtccgagagcaaggctgacgaataagctgctgctactaccgttgccgccgacgagcatggctctgtcaagaccatgtccctcgacgcatacgggccactggagatggccgccaagaagcccaaggagcaggtcctgaacgcgcaagctacgccggcgacgaccgctggcgctgacacatatgaccagaaacccgttggtgaaaaacaggctgaaacggccacggcctccgctgccgatgaacaacccgacaaatacggtggaagctcctattcctgac

SEQ ID NO: 10652 - DNA, 393 bp, Zea mays
  Clone ID: LIB148-005-Q1-E1-D8
ctgacgcgtgggcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccggcggcggcggcctcatccggtccctcgagcgcaccagcgccatcgtcgtcgtctgagtcctccgccgcacgatgctcatcttctgatggcacctcgagcgccccagcaccatcgtccggcgacgattctgattccaacgaccatgggtcaacttgagcctgaccgatgacgcaggtttgggttaccggtgccactcaaa

SEQ ID NO: 10653 - DNA, 281 bp, Zea mays
  Clone ID: LIB148-005-Q1-E1-D9
tgccccgcgttgcgtatcatgtgcgtgggcgccctctgtgctgtgctagtctgcagtagctgcgtccgggcctaggcacgtggcatcgttcgagatgataccagtctgtacacgcgcagagtggttcatcgggaggattacctggtagaggtcagaccaccggcttctcgctctctcacactagcgtattctcggggatgataagggaggagcgtaacgccatatccacaccataaggcatgacgtacagtgaccttctttaagggcatcacggtcggctg

SEQ ID NO: 10654 - DNA, 337 bp, Zea mays
  Clone ID: LIB148-005-Q1-E1-E1
gccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgacgaggacatctgccaggtggtgctggtggccagcccgcgcaaggactgcgacgaggtccaggcgctcagggaccgcg

SEQ ID NO: 10655 - DNA, 430 bp, Zea mays
  Clone ID: LIB148-005-Q1-E1-C4
agtggcacacggaggacgacctgttcatgaacggcgccatcttcaatccgtccggcggcgcccccaagcaggtcgacaccaacgagtgggtcaagcccaagccaggaacctacgttacaaggctcacccgcttctccggcacactgtcctgctgcacgggcaagccgtgctgaaggccggccggtgggcgtcagaggctgcttcttctagctcatggcctggccatgccaggtcgcgatggctgcgtttcatttcatggaagaaagcaaggatggatcacaggttgtcgttctgctaattaatcgacgtttgccttcaagtactgtgttgtggcattgttacacatcacagtacagtttggccattttttttccacagaggaagtacggattgatttaatcccacacgcgtggtactacgtatacagttt

SEQ ID NO: 10656 - DNA, 263 bp, Zea mays
  Clone ID: LIB148-005-Q1-E1-A6
acggaagcatgaggcggacccatcaagtacatggtcatccaaagcgagcccggcactgtcatccgcgggaagaagggatccgcatgcataactgtcacgaacacagggcaagcgatggtggacagcatctacgacgagcccatgacccccggccagtgcaacatggatggtcgagaggctcggcgactacctcgtaaagcaaggcctgtgaatggcttcagttaacctcgcacgctcgcgtgtccatggatcgagcatccagc

SEQ ID NO: 10657 - DNA, 391 bp, Zea mays
  Clone ID: LIB148-005-Q1-E1-A7
gaagcaactgaaaacagccgagcgatctcctctccctctccctctccgatccattctccagcgcagcgaagtagacatgtctgaccgggcaaagatgtcgtggcaggcgtacgtggacgagcacctgatgtgcgagatcgagggccaccacctcgcggcggcggccatcgtcgggcacgacggtgccgcctgggcgcacagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaataagggatcaagaggcatcaccgtgaagaacacagggcag

SEQ ID NO: 10658 - DNA, 213 bp, Zea mays
  Clone ID: LIB148-005-Q1-E1-A8
acccacgcgtcagcgcgctcaccggcgccccgcccctcccccatgctggccgcacccgcaatggggtgcgcggcgtcagccgccaacggggccgggccccggcagcgggggtgggcgcggacgcggatgcggtggtacatccaggcctccacctcgggtctgccgccgccgccgccgccgacgcacgacgcggcggagtcgtcatccgggggc

SEQ ID NO: 10659 - DNA, 236 bp, Zea mays
  Clone ID: LIB148-005-Q1-E1-A9
agctattatgcatcggtaagctcgaccgctccatccacggtgtgactcacgggaatggtacgtacacgatccatctcaacgacagccacgaggatgacatcatgccacgtggtctttgtggggagccctcgcaaggactgcgaccatgtgcacgcagacagggaccgcacctgcgtcgtgctcaccagcaacgtcgatatcagagacaatctgcgccccgccataccgctcagcta

SEQ ID NO: 10660 - DNA, 343 bp, Zea mays
  Clone ID: LIB148-005-Q1-E1-B1
atttttattttttttttttttttttttttttttttttttttgttggtagataacaacattgttttttttatgagaaaaataaagggtgtaattgggagttcaaggtcacgtacattagcattctcaggagtgggtgtgcacgcacaaatgccattttttttctctctgtttctttctctaatattgatccgcttttttgtggacatgttatctcgttcaagatttcgtatataaactaatactttgggcgggatatatatatctgtctcactcatttatatcatatgtattaaatatgcgtttttgttatgcaatatatatatgcagctcaatgcgtgttttc

SEQ ID NO: 10661 - DNA, 377 bp, Zea mays
  Clone ID: LIB148-005-Q1-E1-B2
ggctcagccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtcgctggcgcacaaggcgcggggcccctgcacggggaccaaccccatcgaccagtgctgggggtgccgccgcgactgggcccgcgaccgcaagcgcctggccaggtgcgccat

SEQ ID NO: 10662 - DNA, 375 bp, Zea mays
  Clone ID: LIB148-005-Q1-E1-B3
ctccatctcaaagcatgtcatcctcagctggtagtccgagagtgacagaaaggaaagcagacagagacagccacgagcaccacgacgatgacgacgacggcgagaagggatcaggtttctttgacaaggtgaaggatttcatccaggacgtcggcgagaagatcgaagaggtggtaggcttcgggaagccgaccgccgacgtgaccggggtccacataccccacatcagcctggagaaggcggagctcgtcgtggacgtcctcatcacgaacccgaaccccgtcccgatccctctcgtcgacatcgagtacctgatcgagagcgagggaaggaagctcgtctccggcacgatccccgacgccgggaccatccacg

SEQ ID NO: 10663 - DNA, 431 bp, Zea mays
  Clone ID: LIB148-005-Q1-E1-B4
atcgagcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgc

SEQ ID NO: 10664 - DNA, 395 bp, Zea mays
  Clone ID: LIB148-005-Q1-E1-B5
agtcagcttgggattgctccgcatggattcgcgcctatggatgcttcctggaggaacggctcgagtgcctcagggttctcagatacgacatcgaaaccgagcgtctcgtcagatatccccagacttccagcaaggtacatagtaaaaccaggaccctgcctagcccggaactcttggagcagttgcctgcactgcagcagctgcttttcagggttgtcggcgtccagcctgaaggcgctgcctgctcaaattaccttattcagtacgcactagccctggttctgaaggagagcttcaagatctactgctcaattaacgatggcatcatcaatctcgtcgatatgttcttcgaaatgccgaagtacgacgcaatcaacgctctggcgatttacaaa

SEQ ID NO: 10665 - DNA, 408 bp, Zea mays
  Clone ID: LIB148-005-Q1-E1-B6
agatcctcatcctccgccgcctccaaggccaccccaacgtcgtcggactcgagggcctcgtcacctcccgctcgtccccctccatctacctcgtcttcgagtacctcgagcatgacctcgccggactcagctcctcccccgacatcaccttcaccgagtcgcagatcaagtgctacatgcggcagctgctcgaggggctggcgcactgccacgcgcgcggggtgatgcaccgggacatcaagtgcgccaacctgctggtgagcgacggcggcgagctcaaggtggcggacttcgggctggtgaacctcttcgcgccggcgccggcggcgccgctgaccagccgggtggtcactctctggtaccgcccgccggagctgctcctgggcgccacggcgtacgagccctccg

SEQ ID NO: 10666 - DNA, 321 bp, Zea mays
  Clone ID: LIB148-005-Q1-E1-B7
ggatcgtcaactgccgccgccgccaaggacagcccaacgtcgtcgtggctcgagggcctcgtcacctcgcgctcctcttcctcgatctaggtcgtcttcgacgtatggcggagcatgaggtcgcccggactcgagctcgtgcggggcatatcagcattcaccgtggtcgaagatcaagtgctactatgccgcagtatgctcaaggaggctgtcgcagtaccggggcacgcgagggtgcaggcacacgggacatttcggtgcgcggaagaatgactgagtgtcccactggctggtagctcacagtggcagagggtcaggatg

SEQ ID NO: 10667 - DNA, 419 bp, Zea mays
  Clone ID: LIB148-005-Q1-E1-B8
ggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctccaaggtggccgtcaacgacgtcgtcttcaagaacatccacgg

SEQ ID NO: 10668 - DNA, 411 bp, Zea mays
  Clone ID: LIB148-005-Q1-E1-B9
gacgacgcgtccacccacgagtccgagcaaccagattaccagagccaccactactcgcctgctccgctcgcgcatcccatcccagcggcggcagacagagagcagggatcggcgggtccgccgtcgacatggctcggtacgtggagatgctggacatgggcgtgcgcatcgcggcgaggttccactcgcactgcccgcagacggcgcgcatgtactacaagccgccgcagacgcagacgcagtcgtcgtcgtcgtcctcggccgacgacgccaatgccgcgagctccacccccgacgcgccgtcggtccggcggcccttcgcgctcgcggcggcggcggcggcggcggcggatttccgcgccggcgaccggtcgggccatcatcagctgcacggcttggacaccgcgcaag

SEQ ID NO: 10669 - DNA, 292 bp, Zea mays
  Clone ID: LIB148-005-Q1-E1-C10
caggtcgtctcgtcgctgcagcaactcacaaccgctccaggaccacgtacgatgcccaccggtcgtcgcgcaggtagccacacgatcaccgtcaggctgcagcgctcaacagccgggatctgaaagctcatcgccgcctgtccgccttgcatcgacccgagtgaactacgatattcatattcgatcatcttttgtatcttcgacatgagtactatgtaaatccgtggtgaagacctgagtaattagtggtacgccagagcttgagtgttgattagatgtaactggtggcttc

SEQ ID NO: 10670 - DNA, 171 bp, Zea mays
  Clone ID: LIB148-005-Q1-E1-C11
ggtcgacgacgcgtcaaggcctaagcggttgtaggctgtgcccatgattccaggcgaacatgtacttatatcgccgtgggtaatcaggtgagcgcctgctccgtatcatcctgactgctgtccgatttaggaggaacggccatgcatagagcagagccacacttcgaatgt

SEQ ID NO: 10671 - DNA, 403 bp, Zea mays
  Clone ID: LIB148-005-Q1-E1-C12
gagtgatagtgtcagccacacagtgccaatctatgaaggttatgcccttcctcatgccatcctgcgccttgaccttgctgggcgtgacctgactgacagcctgatgaagatcctcactgagagaggttactccttcaccacctctgctgaacgcgaaattgtaagagacatcaaggaaaagcttgcatatgtggctcttgaatacgaccaggagctcgagaatgccaagagcagctcatctgtggagaagagctacgagctgcctgatggtcaggtgatcaccattggggcagagaggttcagatgccctgaggtcctcttccagccttccttcattggtatggaagctcctggcatccatgagaccacctacaactccatcatgaagtgcgatgtcgacatc

SEQ ID NO: 10672 - DNA, 432 bp, Zea mays
  Clone ID: LIB148-005-Q1-E1-C2
accgggatcacgatcaccaacaccgtcattggcgtcggcgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaatgatgtcaccttcaagaacatcaccggcacctcctccaccccggagggccgttagcctgct

SEQ ID NO: 10673 - DNA, 388 bp, Zea mays
  Clone ID: LIB148-005-Q1-E1-C3
acgaccatccctgcaaattaccgcgatggctcccaagatcctagtcatccttgtgttcctcgccgtggcctcaccggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaac

SEQ ID NO: 10674 - DNA, 352 bp, Zea mays
  Clone ID: LIB148-005-Q1-E1-A5
ctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatg

SEQ ID NO: 10675 - DNA, 423 bp, Zea mays
  Clone ID: LIB148-004-Q1-E1-H10
cgcgtccacccacgcgtccggaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatctggggaaaccattgcacatccaccctccatggctcatgccattttagcagtgggagaaagcatggtttctgaagcggaacctcttctgcaagtggtggagtgtcgcatttgtcaggaggaagatagtatcaaaaatttagagagtccatgtgcttgcactggcagtctaaagtatgctcataggacttgtgtacaacgatggtgcaatgagaaaggagatgtaacatgtgaaatatgtcatgagc

SEQ ID NO: 10676 - DNA, 426 bp, Zea mays
  Clone ID: LIB148-004-Q1-E1-H11
acccacgcgtccgcgagcgacgacgagatgatcatcccgcggaagggcacgctgcggcacgccgtgatccaggaccggccgctgtggatcgtgttcgcgcgcgacatggtgatcgagctgcggcaggagctgatcgtgaaccacaacaagacgatcgacgggcggggcgcgcaggtgcacatcatgttcgcgcagatcacgctgcagaacgtgcagaacgtgatcctgcacaacctgcacatccacgactccaaggcgcactcgggcggcatgatccgcgactcgaagcggcactacgggctgcgcacgcggagcgacggcgacggcgtctccgtgctgtcgtccagcaacgtgtggatcgaccacgtgtccatgtccagctgctccgacgggctgatcgacgtggtgaacgggtcgacgggcatc

SEQ ID NO: 10677 - DNA, 416 bp, Zea mays
  Clone ID: LIB148-004-Q1-E1-H12
acgcgtccagcgatggccacattgtggcggtggacatcatggagaagggctccgacacgtacgagcctctaaagcactcctggggcgccatctggaggaaggacagcgacaagccgatcaagggacccatcaccgtccaactcaccaccgagggaggcactaagaccgtctacgacgatgtcatccccgccggctggaagcccaacactgcctacaccgccaaataaactaaccaaataataataagtatcaaatggcacacttgatagacctttattttttattttttatttaataaaaggatataaggagtgtgacaaacaacaacacgaatattgtattgtctatgtatctcctatatatgcaatcccaattttatcatggccacattttaaaatggaatatatgatatatat

SEQ ID NO: 10678 - DNA, 434 bp, Zea mays
  Clone ID: LIB148-004-Q1-E1-H2
cacgcatccgcccggccgcgcgtcaaggaaccgccgcacatttccatgggcaaggtgcgctccttcttctgccgcgcccgcagcggcaagcgcggtggctcccggccaggcttgtcgtcctcgtctctctcgtccccgtgcccctccgcgaggagggcgtcgccgccggccggggacgagacggagcgcgtcttccgcaagttcgacgcgaacggcgacggccagatctcgcggtccgagctggcggcgctgttcgagagcgtgggccacgcggccaccgacgacgaggtgtcgcgcatgatggaggaggccgacgcggacggcgacggctacatcagcctgcccgagttcgcggcgctcatggactcggcgtccggcgacgccgacgccgtcgaggaggacctgcgccacgccttctcggtcttcgacgccga

SEQ ID NO: 10679 - DNA, 419 bp, Zea mays
  unsure at all n locations
  Clone ID: LIB148-004-Q1-E1-H3
ctcactcaccccgccttcacgcctccctcacaaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggngtgaccgacgggaacggcacgtacacgatcgagctcaaggacagccacgaggaggacatctgcgaggtggtcttggtggagagcccgcgcaaggactg

SEQ ID NO: 10680 - DNA, 438 bp, Zea mays
  Clone ID: LIB148-004-Q1-E1-H4
tgatgtcgacgtcagggaagaagattcctttgaaatcagtcacttcaatcgtcgatgggctaaagaaatcgtacattgagaagttgaggcccttggaaaaaacctatcagttccatgacttcgtgtctcccttgctgactagcagcgatttcgatgcgaagccaatggtcatgctgttgggtcaatactccacggggaaaacaacatttataaagcatttactaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgacct

SEQ ID NO: 10681 - DNA, 432 bp, Zea mays
  Clone ID: LIB148-004-Q1-E1-H5
agatttctcgacctcggctatggaggcggcggcgttatgagcgccgaggtgccgcacttccaccccggcgtgcttcttgaccagggcggcttcaggttcggcctcggcaacgcggcggtcggcggcggatctggacgcgcactacgcggcgaacaacatcgtgttggcctccttcgccagccagctcctcgctaacgcccccgcaccatcgcgggatgatcgtgctggcgggaggacgccgtcgaacgagatggacgatgagctgtacgacatcaccggctgcgacagccacgtcgcagcgagcttgcggtgccccagccaatccggggccatggcggtctggtcgtcgtccaagaagtcgtacgatatctgtaccagcgccggcggaccagtaaccatgccggcccatgacacataccacctcgccggggc

SEQ ID NO: 10682 - DNA, 444 bp, Zea mays
  Clone ID: LIB148-004-Q1-E1-H6
acgccactccatcagcgtcctcgccgactgcgagaccgtcgtcttcggcacccagcacgtgaacgcgcagcacaaccagcggacgttccacttcgcggacgagacggcgcagaacaacgtgtgggagatgttcgacggggagaatgtgcccaagtacaagcaggccaagatcaggctgcgcaaggccggcgacctctacaacctcaccaaggacaagaccgactacgtctggtacacctccagcttcaagttggaggcggacgacatgccgatccgcagcgacatcaagacagtgctcgaggtcaacagccatgggcatgccagcgtggcgtttgtcaacaacaaattcgtaggatgtgggcacgggaccaagatgaacaaggcgttcacgctcgagaagcccatggacctgaagaagggcgtgaaccacgtcgccgtcttggc

SEQ ID NO: 10683 - DNA, 437 bp, Zea mays
  Clone ID: LIB148-004-Q1-E1-H7
agtacattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaggaaccacgagggccggccgatggagtccatcctc

SEQ ID NO: 10684 - DNA, 431 bp, Zea mays
  unsure at all n locations
  Clone ID: LIB148-004-Q1-E1-H8
gagctcacatcaagcagcagtagccatcctaatgtagcagctggtcccactactgcttaaatgttatcagtatcacatacaaacaattattacaggattcacatcaaagcaattcaggtacaaggctaacatcagtacaacaccaaaagatagattgggcattgcatgaatcacatgcgtatgaagaagccagaagagtggatagctgtttgtgatctcttcctgttctcttctgttcacggtgtcacctgcttcagcgctcttgcactgccggtagaaagtcttacagagatgagagctaaaagggtttcaaagtaaacaggttgtttcagaaacgcttcacagaaagtggcgcgcagagtagtgtatgtgcagctgacatgtatgtatagttaanagggaactaactttcgctcataaatgtaaaataa

SEQ ID NO: 10685 - DNA, 418 bp, Zea mays
  Clone ID: LIB148-004-Q1-E1-H9
aatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggc

SEQ ID NO: 10686 - DNA, 358 bp, Zea mays
  Clone ID: LIB148-005-Q1-E1-A1
cccacgcgtccggcggtgccacaacctctcctgctgtcgctgctggtcgccgtgctagcggtggccgccgatgtcgccaacgccggccacgccaagcccctaacgcctggcgggcgcgtggtacacgacaaccacggcgagttcacggccgggccgtgggaacccgcccacgcaaccgtcgacagcgggcttgacgggtccggcaccacggcgggcgcctacgggtacaaggaaacgcgcacgcacgggtacagggttcatacggtggccgtgagcactgtgctgttctgtgatagggcaggctgcagtgggtggcaaaatgtgccgtgcattggggaaccctagcggtgcacacccg

SEQ ID NO: 10687 - DNA, 393 bp, Zea mays
  Clone ID: LIB148-005-Q1-E1-A11
gctcctgcgccgcccgtccgatccggtcactggccggggagggctcagaaacctttcatccaatacatacatctatctgagccctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcaagcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgcggcgggcgctggcgaagtacgatggcccgtgcat

SEQ ID NO: 10688 - DNA, 183 bp, Zea mays
  Clone ID: LIB148-005-Q1-E1-A2
aataaaaaggcatgctggcagttactactatccattcaatcgatgaaaaacacacatttgcgtgacattacatttggagttccatcgacggtatatttggaaaaaaaacaattagcttataaaatgtgtgtttttcatcgattgaatggataataataaaaaggcatgctggcagttactact

SEQ ID NO: 10689 - DNA, 140 bp, Zea mays
  Clone ID: LIB148-005-Q1-E1-A4
ccctcgtcccggagccccgatctgctccccgtctcctcctgggcaggtcccccttttccgcgtgtgcgtaggccggctggttcccgataagggggttgctggcggtggaggccgcgggcgcggcgtcggtcccggcctcg

SEQ ID NO: 10690 - DNA, 432 bp, Zea mays
  unsure at all n locations
  Clone ID: LIB148-004-Q1-E1-H1
aacgacagggtccaccaccaccaccgccgctccgaggcgtcgtgtccggcaacctccgcggccgtggcggcggcgaaggccgatgacgccctgcgccagcgcccgccggggctcgtgcangtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgc

SEQ ID NO: 10691 - DNA, 410 bp, Zea mays
  Clone ID: LIB148-004-Q1-E1-F7
agataaggagaccaccacccaaggccatgacgaccttggcaagcgctgcgccaagtactacgaggcaggtgcccgctttgccaagtggcgcgctgttctcaagattggccctaatgagccatcacagcttgccatcgacctgaacgctcagggtctagctcgctacgccatcatctgccaggagaatggtctggtgccaattgttgagcctgagatccttgttgatggccctcatgacattgatcgctgtgcttacgtcactgagaccgtccttgctgcctgctacaaggcgctcaacgagcaccatgtcctcctggagggtaccctcctgaagcccaacatggtgactccaggctccgactccaagaaggtgacccctgaggtgattgctgagtacaccgtccgtaccc

SEQ ID NO: 10692 - DNA, 440 bp, Zea mays
  Clone ID: LIB148-004-Q1-E1-F8
acccacgcgtccggtttacccagcaggagcttccagcatgcaagccaatgttaactcctggaatcgtcatcggtgctttctcgctcatcggtgtcttcttcgtcccgatcggcctcgcttcgctatccgcgtctcataacatcgttgaggtgatagatcgatatgacgccgagtgtgtgtccgccaacgacaaggtcggcttcatccaggacaccaagaccgacaaggcgtgcacaagaaagatcaccgtgccaaagccgatgaaagggccgatacacatatactaccagctcgagaatttctatcagaaccatcgacggtatgtgaagagccgtaacgacatgcagctgcggaacaagggcgacgcaagcacgatcgcgaactgcgagcccgagggcaccagcgaggacggcgggaagcccatcgtgccctgcgggctc

SEQ ID NO: 10693 - DNA, 393 bp, Zea mays
  Clone ID: LIB148-004-Q1-E1-F9
aatcgccgacgccggcttctgggtcatgaaccgcgagttgctggccttctgctcttggtccacctcgaacaggcttgacaggtcgaaccctctggagtgggagatgatgtcaaagctggagcagatcgctgagacagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatc

SEQ ID NO: 10694 - DNA, 440 bp, Zea mays
  unsure at all n locations
  Clone ID: LIB148-004-Q1-E1-G1
aaccaggtacacttcangaagatgttccagaaccttgacaaggcccccaaggttaacaaccccccccgacctgctgctggcgtcgatgcgcgtcgcggcggataaggccagggaggccaagagccgggtggacgagttcgcggcgaggaaccacgagggccggccgattgagtccatcctcggcgcctgcagcaacgggtacggcaacgttgtgcagacgctcgaagaggcgcggaagatcgtcgccacgcgggcggcggcgggcacccaggcccaggccgacgacatgaacacgaagctgtcggccgccgtcacgagcgccagcgactgccacaacgccttcgccgacttcccggcgattaggtcccccttcttgcncatgcagcggaacgtctaccgcctcgtcgacaacgttctcaacatcttcgtcgtcgtcaacc

SEQ ID NO: 10695 - DNA, 428 bp, Zea mays
  Clone ID: LIB148-004-Q1-E1-G10
aagcttcggcctgtccgggcagccgctccgcctccacgaccccgccgccgccgccggcctcccggacatcgacaccttccgcggcaagctcgagcggctgcttcctcccgacgaccacgaccccggctggtcgcgccgcttcgacgccgagctcggccccgtgcacaggtacttcggcccggacgcgccgctggacgtgcggcagcggatcgcgtacctgttcgcgatcctcgaccggtcgtccaggggcgtcggcgtcggcgtcggcgtcggcgagctggaggcctggctgcgctggcaggccgccgcccggctggacgctgtcacgcggagggagatggctccgcacgacacggaccgcgacggtgccgtcacgctgcgcgagttcttcgcagactggatcaacatgggacatgacaaaatggggt

SEQ ID NO: 10696 - DNA, 398 bp, Zea mays
  Clone ID: LIB148-004-Q1-E1-G11
acaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaacacgacga

SEQ ID NO: 10697 - DNA, 211 bp, Zea mays
  unsure at all n locations
  Clone ID: LIB148-004-Q1-E1-G2
gcatggtgagaaggaagagtcaaagggcatcgatgcgaaagcgtccgggcctggtgggtccttcgacatcaccaagttgggcgcctccggcaatggcaagacagacagcacgaaggctgtgcangangcatgggcatcggcgtgcggcggcactgggaagcagacaatcctcatacccaagggcgacttccttgtcggacaactcaacttc

SEQ ID NO: 10698 - DNA, 445 bp, Zea mays
  Clone ID: LIB148-004-Q1-E1-G3
atcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaaa

SEQ ID NO: 10699 - DNA, 449 bp, Zea mays
  Clone ID: LIB148-004-Q1-E1-G4
acgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctg

SEQ ID NO: 10700 - DNA, 438 bp, Zea mays
  Clone ID: LIB148-004-Q1-E1-G5
actagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcat

SEQ ID NO: 10701 - DNA, 442 bp, Zea mays
  Clone ID: LIB148-004-Q1-E1-G6
acgcgagcacgggcgggcgcgtggtggtgggctgcgtcccgtaccgcgtgcgcgggggcgacggcgaggtggaggtcctggtgatcagctcgcagaagaagggccccgcggggggcgtgctgatccccaagggcgggtgggagctgggccgctggtgctaccgcagccgcagctacgacgccacgtacgagggcttcgtgctcccgctgcgcgtcaccgcggagctggaccggtggcccgagatggccgcgcgccgcagggagtgggtctccgcagccgaggccatcgcgcgctgcccccacccctggatgcgcgaggcgctgcagcggttctccgacaccgtcgcggtcgcggcggagacgatgcacctcgcctccgccctctagctctaggcccggccggccgtcgatcgattccctcttcccgccgcggtttcgtcgga

SEQ ID NO: 10702 - DNA, 437 bp, Zea mays
  Clone ID: LIB148-004-Q1-E1-G7
agacgcgacaagaagctttcctacaggaaggtcctccggctcgcgctggacctcgccagagggctgagctacctgcactcgaagaatgtgatgcaccgcgacgtgaaggcggagaacatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaaatgcgacgtgtacagcttcggcatcctgctctgggagacctactgctgcgccatggcctaccccaactacagcctcgccgacatctcctaccacgtcgtcaagctgggcatccggccggacatcgcgaggtgctgcccgcgggcgctggtggagatcatgacgcggtgttggga

SEQ ID NO: 10703 - DNA, 361 bp, Zea mays
  Clone ID: LIB148-004-Q1-E1-G8
cccacgcgtccgcagggcggcatccggtacaccatcaccgggaacaagtacttcaacatggtgacgatcaccaatgtgggcggcgctggcgacatcgcggcggtgtcggtgaaggggagcaagcgcgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggcgtcacgtaccaggcatccaagaacttctaagtcctccaagcaaatacaccttcggcagtatgatatgcgaactgacacagcatga

SEQ ID NO: 10704 - DNA, 388 bp, Zea mays
  Clone ID: LIB148-004-Q1-E1-G9
aaagcaaccgtgtgccttttggagacgcgatgtcgtccggcaacaagatcagcgtggacttgctgagcgtggccctagtgggcctgctcctctgccatctcgccaccaccgcctccgcgcaccagaacgacatccacgtcctcggcagcgtcgaccgctccagcgacggcagcagccccgagtccgaaagccgcgtcgtctacgcggccatgaagctggctgatacggaatccgatgcgccggcgccggcgccggcaccggggccgtcgtctggttgatctgagaagcgtgcgtctagccaagcaaggtggtcaaaaccgagaactaattaaaggctcgattgtgtgtccggctactactgttcttgccataattatatagagatacg

SEQ ID NO: 10705 - DNA, 439 bp, Zea mays
  unsure at all n locations
  Clone ID: LIB148-004-Q1-E1-F6
gcaaaactgtatatgtatcagatctgtagagccttggcatacattcacaacagcattggagtgtgccacagggacattaagcctcaaaatctcctggttaatcctcatacccatcagctaaaactgtgtgactttggcagcgcgaaagttctggtaaaaggcgaaccaaacatttcttacatctgttctagatactacagagctccagagctcatatttggtgctactgaatacacaacagccattgatgtttggtctgctggctgtgtgctcgctgagctgcttctaggacagcctctgttccctggagaaagcggtgttgatcagcttgttgaaatcatcaaggttctgggcacacccacacgtgaagaaattaagtgcatgaatccaaattataccgagtttaaattcccgcanatcaaagctcacccgtggcata

SEQ ID NO: 10706 - DNA, 427 bp, Zea mays
  Clone ID: LIB148-004-Q1-E1-E10
aggctcggcgtgatggcttacttgaaacggtcagggtaatagcttgaggcaagcacggcagggactacggagcacggttttgatcgtctttgtgatacaagtgccacttcatcggaattggcagaatggctgtgtaagtaattcttgtgagagaggaaaaaaatgaagattttaataatactactgtcaaggcagtgaatggtcccttcatacaagtacacggaactgatcgagtttttttttggtgggttgagacttgagagtcaccatggctgtcagcttcgtcacgattgtatttattatcataaaaacacatgattcattgtacaagaagagtcatgatagaccttcttcatgcagcgtctggctgattagaatttatccaaggcgatttttgtccatagttacgagctcttgctgcaaactg

SEQ ID NO: 10707 - DNA, 344 bp, Zea mays
  Clone ID: LIB148-004-Q1-E1-E11
aggggacagataaacatgttgatcctatctactgggtgatacattggtgttttgacacacggatatgtcagtcctattggttgagagagcatgctggatcttcggccatatgctgtaaatcgcttgttaatttttgttctactagtacacgaagaaatcaaggaaaaaaaaccttgactacgggaagaaaatcacggccacaggggtattttaacctccttcctaatgcgcatatatctatcgaagttgagtaaactttgatataatgtattcatgggtcacgtccaaccaaccctgtgattggttgcttgtaaatttttgtggccttaatcatggcttcaatg

SEQ ID NO: 10708 - DNA, 147 bp, Zea mays
  Clone ID: LIB148-004-Q1-E1-E12
aattttttggtaatgtgatctggccaacaaccttttcctttagctgagaagatgaactgctacagcactgcagtgtagtggttcagctagttatccaatggattgtgtgctgtaacctgtaacatttgtttgaaattgaccttatgg

SEQ ID NO: 10709 - DNA, 418 bp, Zea mays
  Clone ID: LIB148-004-Q1-E1-E2
gacccgacccgtccacccacgcatccggagagacgcatgaccgccggcgacgatcgacgatggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaatgtcacggccgataccttcttggacatcgagatcgacggcaagcctgcaggccggatcgtgctgggactgtttggggacaccgttcctaaaacagcagagaacttccgagcactttgcacacgggagaaaggaattgccaagtccggcaagcctctgtggtacaaggggtcgacgttccacaggatcatcccggggttcatgat

SEQ ID NO: 10710 - DNA, 444 bp, Zea mays
  Clone ID: LIB148-004-Q1-E1-E3
gacccacccgtccacgacaaggccgggtacctgccgtggaatggcgacttcgggctcaagacgctgtggtacgccgagtacgccaaccgggggcccggcgccgacaccgccggccgcgtcacatggcccggctacaagaaggtgatcagcaaggaggaggccgaaaagttcaccgtgcagaacttcttgcacgccgagccgtggctcaagcccaccgggacacctgtcaagtacggcttctgggcgtgagcacatattcttgtggagaccagaggatgtcgatgaagcagaggaagtcatctatgcctagtttgcctatgcatggtggtaaatcactaatcgtccattgttgggagcatgttcatccacggacggacgagataaggtgctgagttgatatgaccataatccatgtacagtgtgtcacctgaacacttgtttgta

SEQ ID NO: 10711 - DNA, 441 bp, Zea mays
  Clone ID: LIB148-004-Q1-E1-E4
acggacgcatgggcggacgcgtgggcgttcatcagcagtgcggcaatgaaggcagccgtggccgctctgctggtgttcgccgcggtgtcgcctgccgcgcgcgcggtggcggcggaggcggaggcgaaggcgaaggctgtgggaagcgcgccgtcggtgcccgctggctcgctggacatcgcgcagctgggcgccaagggcgacggcaagtcggacagcaccccgatggtgctcaaggcgtggaagcacgcgtgcgaagcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaactggatcgagattcagaacgtcgacaacctgtccatc

SEQ ID NO: 10712 - DNA, 135 bp, Zea mays
  unsure at all n locations
  Clone ID: LIB148-004-Q1-E1-E6
acgcgtccatcgtgttcttgctcctccgcttcgtctgcttcgctgtcgcggcggtcttgttcgcttccgtcgcgttggtngtgtcggctgctgggctcgtcttcgtcttccttgcgtctgcttcttcctccttcc

SEQ ID NO: 10713 - DNA, 398 bp, Zea mays
  Clone ID: LIB148-004-Q1-E1-E7
catccatctcatgcttcggtccacgcacccacccagccccaccagcggcagctccgcggcgccggcgtccagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgacctcgtctgcgccggcagcgtcaacccggagcacttcgacttccgccgctacgacacgctagactcgtacgtccacgacctcctcgcaatcctcgacgcgctccgcatcgcgcgct

SEQ ID NO: 10714 - DNA, 427 bp, Zea mays
  Clone ID: LIB148-004-Q1-E1-E8
accggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcgttggtgaaacggaaggagcatacggaggagggcaacgagggcgacgggttctacggcggcataaggaagctccgcggcaacgatgacatctccaagtggaggcagctgtggccaacagacgtcctggagtaagcaggaaccgcatcccttctcacaccgacattgatccatcgctcaaatgacacgcctttctttcatcatcatattgaccaaattcgtcgtctctgtcgcgctgttgt

SEQ ID NO: 10715 - DNA, 321 bp, Zea mays
  Clone ID: LIB148-004-Q1-E1-E9
aagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgat

SEQ ID NO: 10716 - DNA, 425 bp, Zea mays
  Clone ID: LIB148-004-Q1-E1-F10
acgagacgacgcttgaacgtgtgtcgggattgtttggatctctttcaattcttccacaaaaggaacagcccaaaggaactatacgtagacaaagcagcatgacggatgtcaaattaaggagctctgaaagtacaagcaacttgccaaagcttagaagaaatgcatctagttcctctgatatgagtagcatggcttcacaaggtccttcaactaatacagctcctcttagacgcacaagcagttggacttttgatgacaaaattttagtacaagcgttatacaaggttcttctttcagtatcaaagaactaccctattgtactctatataagagatatcgagaagttccttcacaagtccccaaaaatgtatctcctgtttgaaaaactattaaacaaacttgaatggacggtgttagtccttgga

SEQ ID NO: 10717 - DNA, 397 bp, Zea mays
  Clone ID: LIB148-004-Q1-E1-F11
acggacgcgtgggggaaaaggagcgaagagagagagagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaaggggtcgacc

SEQ ID NO: 10718 - DNA, 238 bp, Zea mays
  Clone ID: LIB148-004-Q1-E1-F12
ccacgcgttccgccaatccatcttgggcgggcgccgctcgtcgagggctagccaatgcttgccatggcggacgtccggtctgcctgggtccagcaccatcaccgtcgttccgatgcgtcgtctccggcatcctccgcggttgtgccggctgcgagggtcgctgacgccctgcgccaacgcccgcggggtctcgtgcaggtgtcgtagcgggaccagggctcgttgtcgactgagcacc

SEQ ID NO: 10719 - DNA, 377 bp, Zea mays
  Clone ID: LIB148-004-Q1-E1-F2
agttgccgacgtcggattctgggtcatgaacctcgaattcgcgcgattctgaccttggtcaatgtctatcatgcctcacaagtcgaaccatcaggactgggagatgatgttagtgctggcgaagctgtctgacaaagagcgcttcatggtgtcagaccacgaccggctggcgaagctgaacgggtcgaagcaacggaggatggggcagctcgcgatcgactccgacatcttcaacgtgaaaccgatctttcacgtcgtcgacgtgacgaagtccgcaggcgagacgctggcgtatgacatgttctgcatcagcggcctaagaatttcactcagcgacatcggcatgggcacccgatgtgacgtcaacatggatccct

SEQ ID NO: 10720 - DNA, 415 bp, Zea mays
  Clone ID: LIB148-004-Q1-E1-F3
acttacattctgcaggatctaagcaaagacttgatttagttatggacggattggtaggcctcttgaaagttcccttggtccggggtatcaaccttgcctaccgcgacgcaagaggcaccgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatgaacccgcgggaggagagtctgaggaacggcgccatcatcaggtccgagcggccgagcgccaggaactgcctcgccga

SEQ ID NO: 10721 - DNA, 321 bp, Zea mays
  Clone ID: LIB148-004-Q1-E1-F4
acccgcccgtccaaatccttgacacccctcacctccgtcaccccaccacatccggccagcccaacgaaaatgtcgcgcgccacagctgcggtcctcttctacatcctcgccgtcgctgccctcagcgcggccgaggcaccggcagagtcaccgaacgcaggcagtcctgccaaggcaccggccgagtcaccgaaggcatgcagtcctgcagctcctgccaaggcacccgagtctgctgccacgaaaacttgccccgcttagggaactccagccgccttcaaccccgccgttggcggttgcccatccttctcctcctccaag

SEQ ID NO: 10722 - DNA, 381 bp, Zea mays
  Clone ID: LIB148-004-Q1-E1-F5
caagcctctactctgagtcgtactacgcgcgtcgagggccagccaaagcttgccatggcagccgtccggtccgacagggtccaccaccaccaccgccgctccgatgcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgctgcggtcggcggcgttcccaccccgccgcccggggccggggcgccgctctcctcagcgctgccaatgccacctcaacatcagggagcagcgctcctgcagcgaggtggccggctgcaccgcg

SEQ ID NO: 10723 - DNA, 385 bp, Zea mays
  unsure at all n locations
  Clone ID: LIB148-004-Q1-E1-E1
gtcctcctcctccgccttcttgggcctccgttcggccggcttcttcccgcaggccctggttaaggttagggaaggcagggaacacggtggcgccttcaacccgcaggtcgccggcatctgctctcgcaccccgttcccggaggtgtgcacgtccaccgccgggcggcacgcgtccaagtacccggtcatcgacaacctggccgtgctgaacatgcangtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcaacgggccatcacgttcaaggacacc

SEQ ID NO: 10724 - DNA, 401 bp, Zea mays
  unsure at all n locations
  Clone ID: LIB148-004-Q1-E1-C5
acggacgcgtggggatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcngctgaggtcaccaaggcctgcaacaccacctgcgcccaagagaagcagcctctgctcagcgagaactgcaggaggtcctgcacccctcctccttcctgaacgcagagcacgcccgccggt

SEQ ID NO: 10725 - DNA, 441 bp, Zea mays
  Clone ID: LIB148-004-Q1-E1-C6
agtcgttatcgtcgtcgtcgtgggccttcatttctcctagaaggtagaaggtcgagaggagaagaaggcgagacgtgcagtccgtcgggcaccgatcgagaacagggaagcaagaggctgctagagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaggtggaggacaaggcggtgaagctgggaactgtggccaaggacatcgccagcgccatggccaccacgacggaggagaagacggcgttctgggaacctgaccccgagaccggatactaccgtccggtcaccggcacgaaggaggtggacgccgccgacctgcgcgccgagatgctcaagcggaggat

SEQ ID NO: 10726 - DNA, 440 bp, Zea mays
  Clone ID: LIB148-004-Q1-E1-C7
acggacgcgtgggccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcaacaaggtctccgatga

SEQ ID NO: 10727 - DNA, 440 bp, Zea mays
  unsure at all n locations
  Clone ID: LIB148-004-Q1-E1-C8
aaccagtgcgtgtgctcatccgtgcacgccggcaatggtgtcctccgcccgtgcgctcatcggcctcctcgtcgccgcggcctccctcgccgtcgcgctctcggatggcggcgggatggcggcgccggtgtacgggtacgcggcggggagccccaacgggccggagaactgggggaagctgagccccgcgtacaagctgtgcggggaggggaagcagcagtcgccgatcgacatcgtcaccaagcaggccgtcnccgccgccaccctcgacaccctcaaccgcacctacggcgccaccaacgccacgctcatcaacgacggccacgacatcacgctggcgctcgagggcaaggttgggacggtgacggtgaacggcaaggcgtacagcttcgagaagctgcactggcactcgccctccgaccacaccatcaacggccaga

SEQ ID NO: 10728 - DNA, 416 bp, Zea mays
  unsure at all n locations
  Clone ID: LIB148-004-Q1-E1-C9
aggctcctgcccagggcgtcgactccgaggcgtaccacatgcgcatcctcgccaccgcgctcggcagcgaggagaaagccaagcgggcgctgatctacagctacaaggccgccgctagcgggttcgccgccaagctcacgccggcgcaggtcgccgcgttgcagaagcatcctgacgttgtgcaggcgctgcctgacgtgaagtacacccttgaggacaggaaccacctcaactgaaccgagtgcggctttcaccaacacgatacatagctcggcactagtgccatctcatgttagcaagtgtgcatgtgcccacaccctagggtcagaatttatataagcatgctatgtgtgggctagtgatggtaatttagtctcttcatanagattgaatgctgtacccggagcgtacgtaca

SEQ ID NO: 10729 - DNA, 398 bp, Zea mays
  Clone ID: LIB148-004-Q1-E1-D1
ccaaccctccgagaaatcaaccggcaagggctccaatccggcgaacaacttccgcgtcaacctaaccgtcctcctccgttccgccggttggaacggcgttcaaaaccaacttccccactaagttcatcaagggccgcgtcaattgcaaaacttgcggcgccgggttcgtaacaaatgtcaccgagtaaatcgcgggcgcaaaggtgaggctgagatgcaagcacttcggcaccggcagctcgagcgctccatcaacggggtgaccgacgggaacggcacgtacacgatcgagctcaaggacagccacgatgaggacatctgcgaggtggtcttggtggagagccgcgcaaagactgcgatcaggtgcaggcggacagggaccgcgccggcgtcctgct

SEQ ID NO: 10730 - DNA, 414 bp, Zea mays
  Clone ID: LIB148-004-Q1-E1-D10
agatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggcacactgcaggaacggcaagggaatgatagctagcgctcttaattgatcagctgatcagatgatctgccgccacgcacacgtcgtcttgtatgggctggctgctacaatgcaaccggtagatctccctgcttagtttcttgagatcgagggctccagttcttgctttgcattctgcaaccgttgtccaaatgtccacaatctttgccttccgtcaaattttaatacatggtcggaacat

SEQ ID NO: 10731 - DNA, 375 bp, Zea mays
  Clone ID: LIB148-004-Q1-E1-D11
aaccaccacctttaccaccgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacg

SEQ ID NO: 10732 - DNA, 434 bp, Zea mays
  Clone ID: LIB148-004-Q1-E1-D12
agtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaa

SEQ ID NO: 10733 - DNA, 439 bp, Zea mays
  Clone ID: LIB148-004-Q1-E1-D2
aatttcttaactgacactttgactctgaccaatctctctggcctgctgcttcctgataatcgatcagttccccagtcttgctccttgcactcctccctccatctccagcattgtgttctgattcaccttgctccaatggctgttctttctgctgctgatgcttccccggtctcatctatcgggtttgacggctatgagaagcgccttgagatcatattcactgaagcacctgtctttgtggaccctcatgggcgtggtttgcgtgccctctccagagcccagattgagtctgttctggatcttgcaccgtgcacaattgtgtctgagctctccaacacagagttcgactcaaatgtcagttctgagtcaagcttgtttatctatcctctgaagattgttatcaataactgtggcactaccaagctcctgctcaccattc

SEQ ID NO: 10734 - DNA, 438 bp, Zea mays
  Clone ID: LIB148-004-Q1-E1-D4
taaagtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatccagctcaaggacagccacgaggaggacatctgcgaggtggtcttggtggagagcccgcccaaggactgcgaccaggtgcaggcggacagggaccgcgccggcgtcctgctcaccaggaacgt

SEQ ID NO: 10735 - DNA, 422 bp, Zea mays
  Clone ID: LIB148-004-Q1-E1-D5
gggccgacccaagcgtccatgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtg

SEQ ID NO: 10736 - DNA, 438 bp, Zea mays
  Clone ID: LIB148-004-Q1-E1-D7
agcgtctgcaacaccgggatcaaggcgtcgctcaacttccgcatccagggccactacatgaagctggtcgagctggagggctcccacaccctgcagaacacgtacgactcgctcgacgtccacgtcggccactgcctctccgtgctcgtcgacgccgaccagaagcccggcgactactacatggtggcctccacgcggttcatccacgacgccaagtccgcgtccgccgtcatccgctacgccggctccagcgtcccgccggcgccgaacatgaccgagccaccggccggctgggcctggtccatcaaccaggccaggtcgttccgctggaacctgacggccagcgccgcgcggcccaacccgcagggctccttacactacggccagatcaacatcacgcgcaacatcaaggtcatggtctcccgcgggcacatcgac

SEQ ID NO: 10737 - DNA, 150 bp, Zea mays
  Clone ID: LIB148-004-Q1-E1-D8
aatcgccgacgccggattctgggtcatgaaccgcgagttgctggccttctgctcttggtcaagctcgaacaggcttgacaggtcgaaccctctggagtgggagatgatgtcaaagctggagcagatggctgagacagagcgcttcatggt

SEQ ID NO: 10738 - DNA, 404 bp, Zea mays
  Clone ID: LIB148-004-Q1-E1-D9
aaggcttcgtcagtcgttgcacaggtaaagattgatgatttgatgtaactttgaaccgctctaactaactaaatcgtcctcgagtgtgcggcgggtgcgagcaacaaggccgtccgctccttgttcgtccctgcatgtgttccgttcggttccatcaattccaccacgaaataaggctgtataaatctttcctgggcgttccctctctctcctgtgcatcgccggacggaaccaaacgccaaacgctgctgcgctctctccttctcgtcctgaccccccagagcgagagggaggggcacccagaggagcctgtcgttttgatcggtgtctctgcccccgttcccgcgaggagagaacaacctggagaaaatggcgccgatctccggagccacggcagtccttgt

SEQ ID NO: 10739 - DNA, 448 bp, Zea mays
  Clone ID: LIB148-004-Q1-E1-C4
actcggttcagccacgccccaccagccagccagccagggacccgtcgctgccctctggcgatgagggatattacgggtctgccctgaccaccgcccacgcgcagccaggggtagaaacgaccgcgtcaccgtatttgacccctcaccgtcgcacaccagtgtcggcgagtccctcctgtgcctcgtcctccccctttcccctccgagtccagcccggcgccacccactcagccgcggatccgaggcgcagatccgatccggcgatggcgtccacggcggcgaggcggctgcgggagctgcaggcgcagacggggaacaagacctgcgtggactgcgcgcagcggaacccgcagtgggcgagcgtctcctatggggtgttcatgtgcctcgagtgctcgggcaagcaccggggcctcggcgtgcacatcagcttcgtgcgctcggtcac

SEQ ID NO: 10740 - DNA, 434 bp, Zea mays
  Clone ID: LIB148-004-Q1-E1-A8
acccaagcgtccagacttggtctcatggaagatttgcaacccaggagataaccctctgcttgtgaagacaaggctcaggcactgggctcaagtagtggcttgttcagtgaagcactcgagctgatcctcgtcagtgttttattcacgctcttcgtcgatacataatacccgtacaagtggttgcgatggcgatgaattagtcgtgtccgagtgaaactagatcaattgaccttgttgctcgatctaatgtcgtcccaggtcacattgttgtggacagatttaattagcgtcgggttggcaaattaaaacatgtatatgcaaagtactgttaaaggttggcatggtgtaaacagtgtgagctatctccctaaatcattatgtcacatatttgagacagtctttccgtatctgcgaaaacaaacttgtctcgttta

SEQ ID NO: 10741 - DNA, 406 bp, Zea mays
  Clone ID: LIB148-004-Q1-E1-A9
cccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccg

SEQ ID NO: 10742 - DNA, 422 bp, Zea mays
  Clone ID: LIB148-004-Q1-E1-B1
ccgacccttcgatccaccaaattattaaggaaaggcccggccctttccttcggacatcaacagggggaaggggaaaccacttccattcacccggcggcaataatggcctcggttccggctccggcaacaacaaccgccgccgtaatcctatgcctatgcgtcgtcttctcctgtgccgcggctgacgaccccaacctccccgactacttcatcaagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcaactacacgatcgagctcaaggacagccacgaggaggacatctgccaagtggtgctggt

SEQ ID NO: 10743 - DNA, 385 bp, Zea mays
  Clone ID: LIB148-004-Q1-E1-B10
gggccgaccaacgcgtccacccacgcgtccgctgataatgtcggtgacaatgttggtgacattgctggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactc

SEQ ID NO: 10744 - DNA, 388 bp, Zea mays
  Clone ID: LIB148-004-Q1-E1-B11
acccacgcgtccgcaccaccacctttaccaccgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacg

SEQ ID NO: 10745 - DNA, 399 bp, Zea mays
  Clone ID: LIB148-004-Q1-E1-B12
acactaatccaagacaaaacatggctgtgaatgtgagaaccatgtggtcgtcgatgcgggcacatgttgcgatggctgtggcgttggtgttcttggtgagcggcgcatggtgcggtcctcccaaagtcgccccaggcaagaggatcacggccacctatggcaaggactggttggacgctaaagcgacatggtatggcaagccgacgggtgccggtcccgacgacaacggtggcggctgcgggtacaaggacgtgaacaagccccccttcaagagcatgggcgcatgcggcaacatcgccatcttcaaggatggtctgggttgtgggtcctgcttcgagatcaagtgcgataagcctgtggagtgctccggcaagcccgtggtggtgcacatcacggaca

SEQ ID NO: 10746 - DNA, 449 bp, Zea mays
  unsure at all n locations
  Clone ID: LIB148-004-Q1-E1-B2
agaaaggactactccgaggcgccctcccgctccgcgaggcacgactccgttcggcggcgacctcaacttcggcccgagcacgcgcttctcctccatggacttcggcgacaacctcgacctcaccgccagccncgctcgggagcccatgtcaccggccaccggcgcgcaacgggatattgaggtcgagatgcggcgcctccggctggaactcaagcagaccatggacatgtacaacgcggcgtgcaaggaggccatcaacgccaagcagcgggccaaggagatgcagctgatgaaactggaggaggagcgtcggctggaggaggccaggcacgccgaggagactgctctggcactggccgagatggagaaggccaagtgccgcgcggccatggaggcagccgaggcggcgcagagactggccgacctgnaggcgcagcggcgccgcaacg

SEQ ID NO: 10747 - DNA, 319 bp, Zea mays
  unsure at all n locations
  Clone ID: LIB148-004-Q1-E1-B3
ccgaaacggcaaaatcagcaatggccgcctgcgcaaccaagcccaagacccttgaggggcaggccccagctgaggccgccgtctcaacacccaaggttgcgcccgaggccactccaatctccgttgaggttgcggctgatgaacaggtacctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgangaggagaagccagcggcagcagcccatgc

SEQ ID NO: 10748 - DNA, 460 bp, Zea mays
  Clone ID: LIB148-004-Q1-E1-B6
gcgggcccgaccaagcgtccagctggggcagggcgggttcgggtacgtgtacaagggcgtgctcgccggcagcgggaacgaggtggcggtgaagcagctcaagtccggcagcgggcagggggagcgcgagttccaggcggaggtggagatcatcagccgcgtgcaccaccgccacctggtgtcgctcgtgggctactgcatcgcgggcaaccagcgcatgctcgtctacgagttcgtggccaacaacacgctggagcaccatttgtacgccaaggacggccctgtcatggactggagcacccgcatgaagatcgcgctcggctccgccaagggcctcgcctacctccacgaggactgccatcctcggatcatccaccgcgacatcaaggccgccaacatcctgctggacaacaacttcgaggccatggtggcggacttcgggctggtcaagctcacgacg

SEQ ID NO: 10749 - DNA, 412 bp, Zea mays
  Clone ID: LIB148-004-Q1-E1-B9
agcagagcagggttgttgactggaacatggtgaagaaaggggaggatgaggaggagaagaagctgaatgcaacatacataatcagtgttgctaggaagctaggttgcactgtcttcttgctacctgaagacataatggaggtgaacccaaagatgatcctcaccctgacagcaagcatcatgtactggagcctgcagaatcaagggccatacaagagttcaggaccacaggatgctcttctagaggaagaggaaggcgaggaggaggaagaagaagaagaagaggaggaagaggaggaggaggatttcgaaggaggtgtcgaagatggtgtctctgaaacgaccacttgataagaattgtcacgcttgactagccattgccggtaaagtcactggtctattaagggcatata

SEQ ID NO: 10750 - DNA, 340 bp, Zea mays
  Clone ID: LIB148-004-Q1-E1-C1
gtaacccaaaaggtattcaaaaaaacttgcggtttgaaaaccatgaccatacaacagctgaatgggtcaccttccaacggtgacaagttgagcggcgtagcgaatcttaaggctgggatttctctgctcaatataagactgagggcacttgaagatgaccaggagtttctcaagcaggtgttgagttccctccaatgcggtagtgatggactgcagtgtatacaggagataagcggccatctagcagagttgcgaagagttgtgactcgctaaggaaaatggttttgccccgagtccaaattgttaggtcatcatgacgtcttcccatgcagcagactaa

SEQ ID NO: 10751 - DNA, 396 bp, Zea mays
  Clone ID: LIB148-004-Q1-E1-C10
atggccatcgtcgtgtccgcgtcgttcaaggccaggttcccagccccggcctacgccgtcgaccccgccgggtccacgccgccgcaggccgacttcgtgtggcggatcatcctgatgctgggcgcgatgcccgcggcgctcacctactactggcgcaccaagatgcccgagacggcgcggtacacggcgctggttgccaagaacgccaagcaggccgcggctgacatgtccaaggtgctgcaggtggagatctcagccggcgccgccgaggaggacgccgtggctgcgactgcgactgcgcctgcgccggcgtcggcgtcggcgtcctttgggctcttctccggggagttcctccgccggcacgggctgcacctcctgggcacgtcctcgacgtgg

SEQ ID NO: 10752 - DNA, 428 bp, Zea mays
  Clone ID: LIB148-004-Q1-E1-C11
acgaccccaccgggccaccgttccttgccaactgccaagcatcaccgcgaaatctaataactcgttgctcttcgtcttcgctccgcgatcgatccaggagggggaagcagaaggagggatggcggagaacccgcagctgtttgggaatgggatgccggtgccgttctacagtgagatgttcgtcctcgcccgggatggcgtcgagttccacgtcgacaagatcccatcagctcctggtggtcatgtgaaaacaaaaggcacaatttacctgtctaatataaggatggtgtttgttgccaacaagcatgttggcaacttctttgcttttgatatgccactgttgtttgtgcacggtcagaagttcaatcagccaatatttcactgcaacaacatctctggattcgttgagccagttgttccagacaaac

SEQ ID NO: 10753 - DNA, 414 bp, Zea mays
  Clone ID: LIB148-004-Q1-E1-C12
acggacgcgtgggcggacgcgtgggtccccggcaaggtctcgtgcgcagacatcctggccttcgcggcgcgcgacgccgccgtggccgcgggcctcccgagatacgaggtcgcggcggggcgccgcgacggcatgcgctcgaacatggacgacctcccgggcaacttccccgtgccgggccaccacgtgccgcgcctcaccgagctcttcagccagcgggggctctcccaggaggacctcgtcctgctctccggcgcgcactccatcggcggcgcgcactgcttcatgttctccaaccgcatctacaacttctcccaggacgccgacgtcgaccccacgctggacccggagtacgccaagtggctgcgccagatgtgcccgccgcggcagcccggcgacgaacccgagcaagcg

SEQ ID NO: 10754 - DNA, 369 bp, Zea mays
  unsure at all n locations
  Clone ID: LIB148-004-Q1-E1-C2
gggaaaactctcttcctcntcctcctcctctcgaattcggtccctggcccctgtcgcctccccgcggttccgccgttttttaagggggaaaggaggcggcggagaagaatgatgagggaggaaaggttggttccgtgtgaggcagccctcgccggcggaatcaccgccgccttcgtcgctggactcgtcggtgtcgaccattccatgccgggctccgactacaactacctcaagttgccacgtaatctctacgaagtcgaaatcctcactgggcagcttcagaactaaactagtgactacaccctacacgtgttgggtatgttattgcgctgtgtacatcttcatgcagaccttcatgattccaaggac

SEQ ID NO: 10755 - DNA, 184 bp, Zea mays
  Clone ID: LIB148-004-Q1-E1-C3
ggaaggctcggtcccaatcgcgcctctgctcctgctccccctcctcctcctcctcgtctccactgcgtccgctgcacggaccgtgggcgacaccgtgcaggacgcgtgcagcaagacacaattccccaagatctgcgtggacagcctcaccgcaaagccagagaaccagaagggcgacccgcgc

SEQ ID NO: 10756 - DNA, 422 bp, Zea mays
  unsure at all n locations
  Clone ID: LIB148-004-Q1-E1-A7
agccttggagtcatggaagatttgcaacccaggagataaccctctgcttgtgaagacaaggctcaggcactgggctcaagtagtggcttgttcagtgaagcactcgagctgatcctcgtcagtgttttattcacgctcttcttccatacataatacccgtacaagtggttgcgatggcgatgaattagtcgtgtccgagtgaaactagatcaattgaccttgttgctcgatctaatgtcgtcccaggtcacattgttgtggacagatttaattagcgtcgggttggcaaattaaaaaatgtatatgcaaagtactgttaaaggttggcatggtgtaaaaggtgtgagctatctccctaaatcattatgtcacagatttgaaacagtctttccgtatctgcganaaaaaacttgtctcgtttt

SEQ ID NO: 10757 - DNA, 332 bp, Zea mays
  Clone ID: LIB148-003-Q1-E1-H12
cgcgtctagcgatggcgacattgtggcggtggacatcaaggagaatggctccgatacgtacgagcctccagtgcactcctgcggctccatctcgtcggtcgcagacagagagatagtgagagagagggagggagagagggaacccggagaccgccaccaagcgtgaggcagaggaggagcatggcggcgccgccgtcgaggtcccggggcgactacgaccacctgattaagctcctgctcatcggcgacagcggagttggaaagaattgcttgctgctgcgcttctctgatgacacattcacaacaagcttcatcaccaccattggcattga

SEQ ID NO: 10758 - DNA, 389 bp, Zea mays
  Clone ID: LIB148-003-Q1-E1-H2
agggccagcatctcgcggatcagggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgta

SEQ ID NO: 10759 - DNA, 375 bp, Zea mays
  Clone ID: LIB148-003-Q1-E1-H3
agctgccagccagcttgcactacacgagcccataccatgttgcggcacagaacgtgaaccccagactgaggcgtcatcagatggaaatagagaggtccctgcaccagatctggttcttcctctttgtgtttgtgctgctgtgcctgctcttgttctgagacggaggactgttctatatgcctctttgtagatattgaagagggggagagagggatactaatggatgatgcgtatagtagacagggtaatggtctgtatcgacaagcatgtgtctaaagcatgctgatatagagttgtaatatgatgagacatgggaggtgaaatgtatatttcattcttctcgtcataacgtcagcggtttcctgatcaaaaaga

SEQ ID NO: 10760 - DNA, 393 bp, Zea mays
  Clone ID: LIB148-003-Q1-E1-H4
aactggacgcagccgcgcatctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgttcatctcgattctggatgagcgtgaacctgaggaggtgcaggctgtggatgccttccgccagcttcttgtacttgaagagctgctaccatcgcagcatgatgactaccacatgatgctaag

SEQ ID NO: 10761 - DNA, 387 bp, Zea mays
  Clone ID: LIB148-003-Q1-E1-H5
agcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaacgacac

SEQ ID NO: 10762 - DNA, 325 bp, Zea mays
  Clone ID: LIB148-003-Q1-E1-H6
acagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcataaattgaaaccatccctcttagaccgtctccagcactttatccatatggtccccccctcttag

SEQ ID NO: 10763 - DNA, 355 bp, Zea mays
  Clone ID: LIB148-003-Q1-E1-H7
ttgcactagattaacgcataccatgttgcggcatacaacgtgaaccccacagtgaggcgtcatcaaatgagaatagacaggtccctgcaccaaatctggctcttcctctttgtgtttgtgctgctgtgcctgctcgtgttctgagacagctgattgttctatacgcctctttgtcgatattgaacatggggacagagggatactaatggctgacacgtatagtatacagggtaatggtctgtatcgacaagcatgtgtctaaagcatgctgatatacagttgtaatatgatgaaacatgggatgtcaacatgtatatttcattcttctcgtcataacgtcatcggtttcctgatc

SEQ ID NO: 10764 - DNA, 335 bp, Zea mays
  unsure at all n locations
  Clone ID: LIB148-003-Q1-E1-H8
cgcgtccgcaagaacgagccgcgcacgtcgggcgcgctccacgactgccaggagatgctggggtacgccatcgacgagctcaagtcgtccttcgacaagctaggcggcttcgagatgaccaacttcaacaaggccgtggacgacctcaagacgtggctcagcgccgcgctcacgtaccaggacacctgcctggacggcttcgcgaacgccaccaccaccgaggcctccgccaagatgcagaaggcgctcaacgcgtcgcaagagctgacggaggacatcctgncggtggtggaccagttctccgacacgctgggagggctcaacattcggccgcg

SEQ ID NO: 10765 - DNA, 422 bp, Zea mays
  unsure at all n locations
  Clone ID: LIB148-004-Q1-E1-A1
cgggccaaccaanccttcgaggcccttgcaagggcgacttgacaatcaagttggatggcaaccggctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtatgactgcaagatccttcccaactcgctggtgatggacttcgtgaacaacggggaggtgtccggggtcacgctgctcaactccaagttcttccacatgaacatgtaccagtgcaagaacatgctgatcaaagacgtgaccgtgacggcgcccggggacagccccaacacggatggcatccacatgggcgactcatccggggattcacatcac

SEQ ID NO: 10766 - DNA, 434 bp, Zea mays
  Clone ID: LIB148-004-Q1-E1-A10
agtgagttccaccccaaaacgaagcaacacgccttgcccggtgtgcaccgacgaaaccagcgacagcagcacagagacgaacggcgtggtatcctcctgtctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaggtgctacaacctgttcaagagcaactgcgaggacttcgcgatatactgcaagactggccttcttgtcgctgagcagggcgttgtcgggcagagcgggcaggctatctccatcatcggtggacctctcgccgcggtggtctcgaccccattccgcttgggttacacgaaca

SEQ ID NO: 10767 - DNA, 399 bp, Zea mays
  Clone ID: LIB148-004-Q1-E1-A11
gaagagagagagagacgcaggcccgccggcgacgatcgaggagggaggaacgccagagacccggcggcggcgacgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcctcgacatcgagatcgacggcaagcctgcaggccggatcgtgctgggactgtttggggacaccgttcctaaaacagcagagaacttccgagcactttgcacaggggagaaaggaatggccaagtccggcaagcctctatggtacaaagggtcgacgttccacaggatcatcccggggttcatg

SEQ ID NO: 10768 - DNA, 386 bp, Zea mays
  Clone ID: LIB148-004-Q1-E1-A12
agtccctcgctcctgcgccgcccgtccgatccggtcactggccggggagggctcagaaacctttcatccaatacatacatctatctgagccctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcatgcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgctgcgggcgctggcgatgta

SEQ ID NO: 10769 - DNA, 442 bp, Zea mays
  unsure at all n locations
  Clone ID: LIB148-004-Q1-E1-A2
aatcgccatacgcgcaccgcctccccgtgtcncctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatc

SEQ ID NO: 10770 - DNA, 283 bp, Zea mays
  Clone ID: LIB148-004-Q1-E1-A3
cgtccacaaagaaacaggcacatatgaacgttacatcaagttggccttcaatccgggaacaggttgcaatggctgtggtgttggggttcttggtgaccggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatg

SEQ ID NO: 10771 - DNA, 432 bp, Zea mays
  Clone ID: LIB148-004-Q1-E1-A5
acccacgcgtccacaaagaaacaggcacacaagaacaaatacctcgccaccaacaatggcctccaggtcctccatcctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcaccacctacaagaccacactcagcatctaatcagcctctgatga

SEQ ID NO: 10772 - DNA, 442 bp, Zea mays
  Clone ID: LIB148-004-Q1-E1-A6
acatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgttcctcaagat

SEQ ID NO: 10773 - DNA, 409 bp, Zea mays
  Clone ID: LIB148-003-Q1-E1-H10
cgcggtcatggacggcaatcatgctgacgttcgacaacccgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaaatcactgtactggggttctcaaaaaaatcattgtaatgggagttatatatataac

SEQ ID NO: 10774 - DNA, 379 bp, Zea mays
  Clone ID: LIB148-003-Q1-E1-F5
aaggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaagtgcggtgcgtggacagccctagcgggtgcaagcccgacgcggcagcgctggtggtgaacgtgaccgacc

SEQ ID NO: 10775 - DNA, 328 bp, Zea mays
  Clone ID: LIB148-003-Q1-E1-F6
acttcacagcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgag

SEQ ID NO: 10776 - DNA, 364 bp, Zea mays
  Clone ID: LIB148-003-Q1-E1-F7
agcggggaccttctgctacatcgacccggagtaccagcagacgggcatgctcggcgtcaagtccgacgtctactccttcggcgtcatgctgctgcagatcatcacggcgaagccgcccatggggctgtcgcaccacgtcggacgcgccctggagcgcggcgagctgcaggacatgctggaccccgccgtgcccgactggcccctggaggaggcgcagtgcctcgccgagatggcgctccggtgctgcgagctgcgccgcaaggaccggccggacctcggcgccgtcgtgctcccggagctcaaccggctgcgcgcgctcggcgaggacaacatgcagtactgcggcgccatcatcaggggtggc

SEQ ID NO: 10777 - DNA, 348 bp, Zea mays
  Clone ID: LIB148-003-Q1-E1-F8
ggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccat

SEQ ID NO: 10778 - DNA, 398 bp, Zea mays
  unsure at all n locations
  Clone ID: LIB148-003-Q1-E1-F9
acaagcatttgtatcgtaatgttgggcgtcatcagtgctgccctggggacatactcctccgtgaaaaagattgtagaaaactactaagctcttcgacaataattgcctgcctgcaccagactccacgtatggaactcgaaatgttgaggcatctatatatacggcgacgactactgtacaatcagagtacaccttatgtacagtcaggatcagctagcactatattcttagaacttggtcgagtgcagcgaggatgcatgttcgttggccttttatggtgccaccatggtcgaagccatagcctgagcatgataatggcgccatgcactgttgtcttgtatcatatgcgctgttctatctcaagttcnttttgaaggaagcaagcttgatttgtttgt

SEQ ID NO: 10779 - DNA, 339 bp, Zea mays
  Clone ID: LIB148-003-Q1-E1-G1
gcgtctacactaaaccacgacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacgggcacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgct

SEQ ID NO: 10780 - DNA, 307 bp, Zea mays
  Clone ID: LIB148-003-Q1-E1-G11
aatccgcttgcggcatgtatgtaatcgttctgatcttacaccgaaattgcattcgtgtcagagacgactctacccaatatggatcaggaagaaatgtatcagtgatcgcatcgataaacacagtttgtctgaactctaaacttctctgtgacaccattctattcttcaacaaactaaactcccttcactaattttaggatgtactcgcatcaatctgttatattttctcagaaatattaggctgtgtacacctcacgatagagatgcacagggtggagtgtatattatattaaaaagttctttgtct

SEQ ID NO: 10781 - DNA, 336 bp, Zea mays
  Clone ID: LIB148-003-Q1-E1-G12
ccaggtcgacccgcgcgtccagcaggctcacggaggccgaggccgccgtgaaccgtgccgtcgccgggagccacgtggggaggtacttcaagctggacgcgcgcaagagctccttcaccaaggagctccgcgccggcgccgccacgttcctcaccatggcctacatcatctccgtgaacgccgcaatcctgaccgactccggcggtccgtgcacggcgcgggactgcacccccgtggccaccgccaccaactcgacgaccgcggactgcgcagtcgtcggggctaaggctaacccggggttacagcagtgcctggcgcgcaacaagagcgacctga

SEQ ID NO: 10782 - DNA, 267 bp, Zea mays
  unsure at all n locations
  Clone ID: LIB148-003-Q1-E1-G2
acaacaaacannnatcaaacgagtgggcaaaactgaaaacggcaaattggaaaacccaaatttccgggtccaacacaaggaccaggctaacacatttcaggatccccacaattacagtggcttcaacaactctggagaccaagcacgcttcaacacaagtaaagaatcacttccgatgcaattcttccacaggcaatccaattttaaagtttgagcaacatctccctactaccaagtgtcccctccccctgagcacagtttgtcccc

SEQ ID NO: 10783 - DNA, 412 bp, Zea mays
  Clone ID: LIB148-003-Q1-E1-G4
gaccgacgcgtccagtgccaaccaccctcctctcgcggtcgcgggggtagggccgggtgagcacgagcgctgcccgctcgctgaaccatggcgggctccgcggtggccgtcgtcctcctgtcggccgtcgcgctgctctgcctgtaccacctccttttcctctccctgtccgtcccggacccggcagcagcagcagcagccgtcccccgccgcgccggtggccaccgtggcagcaacgttccgtccgggtcaggaaccgccaacgtcgtcctccgcttcggcctgtccgggcagccgctccgcctccacgaccccgccgccgccgccggcctcccggacatcgacaccttccgcggcaagctccagcggctgcttcctcccgacgaccacgaccccggctggtcgcgcggct

SEQ ID NO: 10784 - DNA, 366 bp, Zea mays
  Clone ID: LIB148-003-Q1-E1-G5
aaaaccattcccaggcaggcccgacctcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggagacatgtacatctacagccg

SEQ ID NO: 10785 - DNA, 419 bp, Zea mays
  Clone ID: LIB148-003-Q1-E1-G6
gtacagggatgctgcaatgatcgaaattggcatgcttgagaagcttggtaaatatggtgaaagcagatccagttgtgttcaaattcggaactggtttgactatcgtaaccatatctgtattgtctttgagaggcttggaccaagcttatatgattttctgaggaaaaacaattaccgctcattcccaattgccctagttcgggagtttgccaaacaactgttggaatgtatagcatttatgcatgaattgcgcctcatacacactgatttaaagcctgagaacattctccttgtttctccggagtacattaaagtgcctgattacaaagtctcatcccaatccccaaaggaggggtcctattacaagcagttgcccaagtctagtgctatcaaggtgattgatttcggtagcactactt

SEQ ID NO: 10786 - DNA, 408 bp, Zea mays
  unsure at all n locations
  Clone ID: LIB148-003-Q1-E1-G8
acccacgcgtccgaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagattccctcgtacctgngcccgccctggaaggagttctcgcgcctcgtcatcat

SEQ ID NO: 10787 - DNA, 400 bp, Zea mays
  Clone ID: LIB148-003-Q1-E1-G9
attccagggcgaccacgcgtcgaccacgcgaccgagagcaccctccacttggtgctgcgtctcaaaggtggcatgcagatcttcgtgaagacacttactggcaagacgataacccttgaggtggagtcctcagacaccattgacaacgtcaaggccaagatccaggacaaggagggcattcaaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggaggtggagtcgtctgacacaatcgataatgtcaaagccaagatccaggacaagg

SEQ ID NO: 10788 - DNA, 388 bp, Zea mays; identical to SEQ ID NO: 6427
  Clone ID: LIB148-003-Q1-E1-H1

SEQ ID NO: 10789 - DNA, 416 bp, Zea mays
  unsure at all n locations
  Clone ID: LIB148-003-Q1-E1-F4
aagcttgctcctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtanatattacacacatgc

SEQ ID NO: 10790 - DNA, 308 bp, Zea mays
  Clone ID: LIB148-003-Q1-E1-D4
acccacgcgtccgcccacgcgtccgcccacgcgtccgtttgactgttcgtgctgaaacggagacgccggttattgcggtttcaattagaaggattccaagggttccttcaaacatgcctttgtatgaaatacccaatgagtttcagaaaggaattagccaaatggctgctgttgtaaaggctaaacctaaaaactgaaccaccgcctgacagaactgaaccaattagggaaccatttgggcaagcaaatttgacggttacctgtgttaccaaaggctgaagaaagtgcacacaatgtggttgtggata

SEQ ID NO: 10791 - DNA, 206 bp, Zea mays
  Clone ID: LIB148-003-Q1-E1-D5
aaaaaaaaaaaaaaaaaaaaaaaaaaaaaaaaaaaaaaaaaaaaaaaaaaaaaaaaaaaaaaaaaaaaaaaaaaaaaaaaaaataaataaaaaaaaaaagggcggcccccccaaaggtttaaaaactggggtaccccttaaagggaattaaaaattcttccaaagggtccccaaatttaaattcattggccgttgttttaaaattt

SEQ ID NO: 10792 - DNA, 374 bp, Zea mays
  Clone ID: LIB148-003-Q1-E1-D6
aacagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtg

SEQ ID NO: 10793 - DNA, 204 bp, Zea mays
  Clone ID: LIB148-003-Q1-E1-D7
aatcaccaaaggaaaacacaagagtactcttggaggaaagtttagcattcaatttaaaaaaccttaccaactcatgccttatttgaatgcaataatgcatgttctgttgccatgctgttgcttggacacatgcttggcatggctattttctggttatgtcacaactcatatctcccatgtaaatttatggctatgatatgcatc

SEQ ID NO: 10794 - DNA, 371 bp, Zea mays
  Clone ID: LIB148-003-Q1-E1-D8
ggtctagaactcgcgggccgacccaagcgtctatggaaaatctgtccatcatctttacaaggtcaattttcgggccatcatcacacgcctactataattttagaagcagttgcttcacaagatttatggatttggcatgctttttttggattacctggctctctcaatgacatcaatgttcttcatcgatctcccctgttcgcaaaattatcaaatggagaaagtccacaagtgaattatagaataaataaccatgactattcaatgggatattaccttgcagatggcatatacccttcttgggcaacattggttaagaccataccagaaccacggggcaataaaagaatctactatgtgaaggcacaaga

SEQ ID NO: 10795 - DNA, 401 bp, Zea mays
  Clone ID: LIB148-003-Q1-E1-D9
acgtgctaacggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagccaccgcgggagcacttcgacctcagcatg

SEQ ID NO: 10796 - DNA, 351 bp, Zea mays
  Clone ID: LIB148-003-Q1-E1-E10
agtgccgcagtcggtggcggacagcgtgacgcagtaccggctgacggcgacggcgggcaccttctgctacatcgacccggagtacaagcagacggggaagctgggcgtcaagtcggacatctactcgctcggcgtgctcctgctgcaggtggtcaccgcgcggccacccatggggctcacgcaccacgtcgagaaggccatcgacgcgggcaccttcgcgcagatgctcgacatcaccgtcaaggactggcccgtcgaggaggcgctcggctacgcaaagctcgcgctcaagtgcacggagatgcggcggagggaccgggccggactcgcaaccgtcgtactgccggagct

SEQ ID NO: 10797 - DNA, 401 bp, Zea mays
  unsure at all n locations
  Clone ID: LIB148-003-Q1-E1-E12
ggggaatggcttcggtggccaacaatggggaaccaaccggtggcaacaatgacaactaataagcccttcttcttcttcgccctggggtcggcgctccttggtgcggcgccggccgccgcaaacgcgcccggcggggcgttcagcaactgggtggcgatgaaccagcagagctacgcgctgtacgcgcaaaaattccgtcggggacgggggcaaggagcccctggacaagaagctgtcggaggcggtgaagaagaaggtcacgtacgtggtggaccccagcggcaagggcgactacacgaacatcaccgcggcgctggaggatatcncggtgagcaaacacaagcgcgtgattctggatctcaagcccggcgctcagttacgcgagaagctgttcctgaaca

SEQ ID NO: 10798 - DNA, 370 bp, Zea mays
  Clone ID: LIB148-003-Q1-E1-E2
gccgatgccgactctagattgaatcttggcaggcgccgcgcgtcgagggccagccaaagcttgccatggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcatggagcaccgctcctgcag

SEQ ID NO: 10799 - DNA, 423 bp, Zea mays
  unsure at all n locations
  Clone ID: LIB148-003-Q1-E1-E3
ttggcctcacgatatgccgagtcatattacanataattccaattcatatatgaacatttttgcctccttatttcttgaaaatgtggaattggaattcctttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaagatangcctaataagaaaacaaataattccaattcatatatgaacatttttgcctccttattt

SEQ ID NO: 10800 - DNA, 270 bp, Zea mays
  Clone ID: LIB148-003-Q1-E1-E4
agccgggacaaaaccgccgctcctcctcctccgcccctccccgctctttctgtgaggcgggaagcgaggcggatgccgaggcgacggggctcgcgcaccgcacgcgtgtgcccgccgcccgggggccaggcgaggtggtgaggtgaggccgagcgcggttttaaattgttcacccggccgcccttctcgccgtagttttcagtggtacaagcaagggaggaacgaacgtgagggctgcctgcctgcctgcggacatgggctccacctcaa

SEQ ID NO: 10801 - DNA, 303 bp, Zea mays
  Clone ID: LIB148-003-Q1-E1-E5
gcaagactctacactgagtcgtattactacccgcagatgcggcgcgcgcacgtcgccctcatctacctcgccgcgccggtcgtcgcgttctgcgacgcgtacgccttcggcgtgacggacatgaacctgtcgagcacctacggcaagctcgccatggtgctcgtgggctccagcgtggggcgcaacgacggcggcgtcgtcgccggcctcgtggcctgtgggatcgtgatggggaccatgtccaacgccaacaaactgatgcacgaactcaagaacgggtacctgacgctgaactcgccgcac

SEQ ID NO: 10802 - DNA, 412 bp, Zea mays
  Clone ID: LIB148-003-Q1-E1-E6
acgaggtgctagcccgccagatcgacgccggcaagggcgtgggccgccccgcgggcgtgctcatcaacggcaagggcggcaaggacctggaggccgcgcctgccttcaccttcgaggccggcaagacgtaccgcctccgcgtctgcaacaccggtatcaaggcgtcgctcaacttccgcatccagggccactacatgaagctggtcgagctggatggctcccacaccctgcagaacacgtacgactcgctcgacgtccacgtcggccactgcctctccgtgctcgtcgacgccgaccagaagcccggcgactactacatggtggcctccacgcggttcatccacgacgccaagtccgcgtccgccgtcatccgctacgccggctccagcgccccgccggcgccggaacatga

SEQ ID NO: 10803 - DNA, 115 bp, Zea mays
  Clone ID: LIB148-003-Q1-E1-E7
agtaatcttgagatgcatgccctctcaaatcactgtactggggttctcaaaaaaatcattgtaatgggagttatatatataactttatctcaccatttatttacaccaacaagtc

SEQ ID NO: 10804 - DNA, 99 bp, Zea mays
  unsure at all n locations
  Clone ID: LIB148-003-Q1-E1-E8
cgaaactgaacatgtgcgatatgtttatcaacctattgaaggtttatatcctctacttatcacanacaagcagagcaatattcttgaagatctggacac

SEQ ID NO: 10805 - DNA, 363 bp, Zea mays
  Clone ID: LIB148-003-Q1-E1-F1
tacactcaggcgcagggctgggcggtcgacggaggccaattctccaacttcctccctccgtcgatcatccagcaccagcaggagaatcccgtcgaatccccctctcaaccaagggcgcgcgcgcgtgcgtatgcctcctccagatccaaagcaacagacagcgagggggcaccggggtccgccgcatgtttgcgatttatggaggatcatgctttcttgcttactacattagctcctgacgcgccgccctcccctcgcgttcattgatttcggttataattactaccgagctactatctccacattattattggtaaagaaagaaagggcgcctcctcaaatttgatgggcattccgtttcct

SEQ ID NO: 10806 - DNA, 287 bp, Zea mays
  Clone ID: LIB148-003-Q1-E1-F12
gacccacccgtctacgcccggacccggccgttcgggggaccgcaccaggcgggcccccccggcggccgcacaaccgggtacccaaggccgcccgcgcgcgccttcaacctcgtctgctgtcgctcctccgtgatggccgacgtcgacgtggacgccaacaacgaggccgagcaaaggacgcgctcggagccggggacctccatgtcgccgtcatcggaggccgacgacgacacggccagcagtacacccaacgagtccccggcgcgcgccttcgcggggcaaacgct

SEQ ID NO: 10807 - DNA, 403 bp, Zea mays
  Clone ID: LIB148-003-Q1-E1-F2
accacacgtccgcagaggtgttgcccaggaatacagcttggaagccggcaaaaatttgtgattttggtgcttctactgtcatttgttgttatgcttgcctttgccatcctcatatgggttggtagaggagacaatcctatcgattcttctctactgaaaagggtttatttggatgtattttcagtagtagttattgtacttggtggtgctctggcatgttacggtgcagtgttattctcgaagatgagcaaagttcgttctgaaactgtatcaactgagaagtggaaggttgccagtttagctgctgtctcgctgatctgtttctcgtcttctgctatacttgcacttgtgactaatgttccagtgcttttgtattggtactcaacagatgtggacatcatca

SEQ ID NO: 10808 - DNA, 406 bp, Zea mays
  unsure at all n locations
  Clone ID: LIB148-003-Q1-E1-D3
aattgaagcatgagaatgttgtcaaactcgtcggatactgcgccgaagggaacacccgcgtccttgcttatgagtatgcaactaagggatcattgcatgatatcctccatggtaaaaagggtgtcaaaggagcccagccagggccagtcctgtcatggatgcagcgagctangattgccgtatgtgctgctcggggtctcgagttcctccacgagaaggccgatcctcgagtggtccaccgcgacatcaagtcaagcaacatactgctctttgaccatgatgtttcgaagaatcgggaactcgaaatcccanaccaggcccctgacatggctgcgcgcctccactctactcgcgttcctggcaccttttggctacatgcaccagaatatgccatgactggacagct

SEQ ID NO: 10809 - DNA, 173 bp, Zea mays
  Clone ID: LIB148-003-Q1-E1-F3
tcagaagacaacgcaaaagcaggattactggatctggtggaaataagggttgaaggagatcacatataccagttgcatgcttgacaaacttcgtcaactagcaagccctctggcattgtcctttgctctggaagtaaaatttactattccaatagaatacatgacttagacat

SEQ ID NO: 10810 - DNA, 424 bp, Zea mays
  Clone ID: LIB148-003-Q1-E1-C1
acgggtaagagggctcgcttacaaccccaccctgcactcaaggagtgctttggactatcatgagcaaggtagcagatgcatccaaggaggagatccactccatcgagtcggtgaaggaggcaaatgcacggccggctcagaaaatcaacagccgcgttgttcgctactacaaagcagcaggagccacagaagcgccggcgccggcgccggcgccagaagcaacctgatcgaggagaacgttagaacagtagctcaccctcccgagagtatgggttgaaaatctttggcgaattgatgtctcgatgcaaattaaacaggcatgccatctttgtgtaaacagaaattttacacactaagttccactccctatactactaccataattttagtaatgtaaatactttgaaagaatgcttaaatataa

SEQ ID NO: 10811 - DNA, 424 bp, Zea mays
  Clone ID: LIB148-003-Q1-E1-C10
gacccgcccgtccaaccacgcgatcggaaatctcgccctcgttgcggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctgggggggccaggagagagctacgacgccttcacggcctgcttccccgccaacgagtgccgctacgccgtgttcgattttgacttcgtcactgacgagaactgccagaagagcaagatcttctttatctcttgggccccggatacat

SEQ ID NO: 10812 - DNA, 242 bp, Zea mays
  Clone ID: LIB148-003-Q1-E1-C11
gccaaatcctcccgaataacttggtgccgggttttgtgacgaacgtccagattcgcgggatcaagctgctcaacagcaagttcctccacctcaacatcctccagtgcaagaacgtgctgatcgacaaagtgacggtcaagggccccggggacagccccaacacgggcgggatccacatcggcgactccagcaacgtgaccatcaacagcaccaacaaccgggtccgggacaaatggatcccc

SEQ ID NO: 10813 - DNA, 376 bp, Zea mays
  Clone ID: LIB148-003-Q1-E1-C12
acgcgatcgcgacagaatggcttgcacagacaatgcaatgaaagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaagtggatggcaatctgctggcgaacacggacctaagccagtacaaggaacatggtaat

SEQ ID NO: 10814 - DNA, 415 bp, Zea mays
  Clone ID: LIB148-003-Q1-E1-C2
ggtcgatgcccgcctctacaatgagtcatgtgaacgcggacttcatcgcccacgaggccatctcgtcgagcgtggccgagttcagctgggacctcaagttcccgggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgaccagcacggcgttcctgctggtggtgtacgcggacctgctgctgcggacggggcagacggtgctgtgcgggaaccagccgctgcccccggcccggttgcacgagttcgcgcggcaacagatggactacctgct

SEQ ID NO: 10815 - DNA, 366 bp, Zea mays
  unsure at all n locations
  Clone ID: LIB148-003-Q1-E1-C3
acctcgacaacctcgtcgacgagtacgaccgcatcgctgcgacctcctccggcggaggatcctcgcgcacctcncggatccgcctcttcctcttccccgccaagcccgagtcctcgtcatcgctcggctccctgctcgacgactcttcaaagtccgagaactggttcgtcgacgccctcaacagcgccatctccggctcgctcgacggcataccgagggggatctccaccgattcagcctccgtcaactgccttctcggcctcgaggacgactcctccgtgcactcccgtagtggagtaaccaactcggctcccacggaggaccagcgcgccagccagccgaagctccccggcggcgccgccgctg

SEQ ID NO: 10816 - DNA, 378 bp, Zea mays
  Clone ID: LIB148-003-Q1-E1-C4
taaagagattcgctatatcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaggtggacgtggcgccactgatggaggcggtgagcatg

SEQ ID NO: 10817 - DNA, 339 bp, Zea mays
  Clone ID: LIB148-003-Q1-E1-C5
ctcgcgggccgacacaagcgtcaagtacgtctgccaccagaaggtctgccccggcaagcgaagcaactcctcgcatgtctccatcaagaacgtcaccttccgcaacatctccggcacgtcgtccacgcccgaagccgtcagcctgctctgctccgagacgcagccgtgcagcggcgtctcgctcatcgatgtcaacgtcgagtacgccggcaagaacaacaagaccatggctgtgtgcagcaacgccaagggaaccgccaagggaagcctccaggccctggattgcctcgtctgatcaatgaccttgcatttgcatgcattcttcttccgtttcacttt

SEQ ID NO: 10818 - DNA, 411 bp, Zea mays
  unsure at all n locations
  Clone ID: LIB148-003-Q1-E1-C6
ctcgcgggtcgacacaagcctctagatcgactcattatagagatctatcgatcgagctttcgttatcctcctcttacattacaggtcatagctaagcaggtctgacaggatgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggangcataactgtgaagaagacagggcaagcgat

SEQ ID NO: 10819 - DNA, 393 bp, Zea mays
  Clone ID: LIB148-003-Q1-E1-C8
ggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgcctcaca

SEQ ID NO: 10820 - DNA, 351 bp, Zea mays
  Clone ID: LIB148-003-Q1-E1-C9
tacatcgctagctcgccaccaacaatggcctcaaggtactctatcctgcttgccacaacgacactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcaag

SEQ ID NO: 10821 - DNA, 390 bp, Zea mays
  Clone ID: LIB148-003-Q1-E1-D10
ctgtgaaatgttgagaaccatgtggtcgtcaatgcgggcacaggttgcgatggttgtggcgttggtgttcttggtgagaggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcc

SEQ ID NO: 10822 - DNA, 391 bp, Zea mays
  unsure at all n locations
  Clone ID: LIB148-003-Q1-E1-D12
acattggtgttaatgttaaaaacaagttggcctccattccgggaaaaggttccaatggttgtggctttggggtccttggtaaaaggcccatggtgcggtcttcccaaattcccccaaggcaagaacatcacggcaacctatggcaaggactggctggacgctaaagcgacatggtatggcaagccgacgggtgccggtcccgacgataacggtggcggctgcgggtacaaggacgtgaacaagccccccttcaatagcatgggcgcatgccgcaacatcnccatcttcaaagatggtctgggttgtgggtcctgcttcgagatcaagtgcgataagcctgtggagtgctcccgcaaacccgtggtggtgcacatcacggacatgaaactat

SEQ ID NO: 10823 - DNA, 419 bp, Zea mays
  Clone ID: LIB148-003-Q1-E1-D2
aaacgaagacagctaaccagctagtaacaagaacaaaaaacaccatcatcccatccgcccgtgtcaacgccaccctagccctgtgatatacaatggcggcccagagcacgaggatggtggcgctggccctggtggtcctcctggtggcggcgacggcgttggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcatcatatacaatcgctgctccgtcgctcacgtcagcccatgcataatctctcgacccgggccattgaatc

SEQ ID NO: 10824 - DNA, 388 bp, Zea mays
  Clone ID: LIB148-003-Q1-E1-B7
aaaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgag

SEQ ID NO: 10825 - DNA, 377 bp, Zea mays
  unsure at all n locations
  Clone ID: LIB148-003-Q1-E1-A12
gtgccgccttcggtggcggacaccttgacccattaccggctgacggcaacggcgggcaccttctgctacatcgacccggagtaccagcagacggggaagctgggcgtcaagtcggacatctactcgctcggcgtgctcctgctgcaggtggtcaccgcgcggccacccatggggctcacgcaccacgtcgagaaggccatcgacgcgggcaccttcgcgcagatgctcgacatcaccgtcaaggactggcccgtcgaggaggcgctcggctacgcanagctcgcgctcaagtgcacggagatgcggccgagggaccggccggacctcgcaaccgtcgtactgccggagctcaaccggttaaggaacttcgccacgcg

SEQ ID NO: 10826 - DNA, 401 bp, Zea mays
  Clone ID: LIB148-003-Q1-E1-A2
agctcccctaatttaagccctacattgaaaattggttttggtcatcatgcgtgtgatgacaaaaattgtggcaatgcagattatgttgatgatcttgatgacatttcccaagaagatacctgtggtagttctgatcctggcaatggaattgcggaagataaatttgaggtcaatggatctgctcaaataaagcgtccaaaatttcaaaagggtgtcttacgtacaaactgtatagattgtttggatcgcacaaatgttgctcaatatgcctatggcctagctgctttaggacaccagttacatgcacttggttctgtagaatctccagaagttcatctagactctcctttgtctcgacatttgatgcatttttatgaacgcatgggtgacacacttgcttt

SEQ ID NO: 10827 - DNA, 336 bp, Zea mays
  Clone ID: LIB148-003-Q1-E1-A3
cgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggcgacggcgtctccgtgatggggtccagcgatatctggatcgaccacctgtccatgagcagctgcgcggacgggctggtggacgcggtggacggctcccacgccatcaccgtctcc

SEQ ID NO: 10828 - DNA, 331 bp, Zea mays
  Clone ID: LIB148-003-Q1-E1-A4
tctagagtgaatcgtattcatcgcgctgtcgcgggggtaggggctggtgatcactatcgcttgccgctcggtgatccatggccggctccgcggtggccgtcgtacccctgtcagccgtcgccctgctctgcctgtagtacgtccttttgcgctccctgtgcgtcgcggaagcggcatcagcgtcagcagccgtcccccggcgcgccggtagccaccgtggcagcaacgttccgtctgggtcacgaaccgtccaactcgtcctccgcttcggcctgtccgggcagccgctccgcctctacgactccgtccgccgccgctggcctcccggaca

SEQ ID NO: 10829 - DNA, 370 bp, Zea mays
  Clone ID: LIB148-003-Q1-E1-A5
ccgacccaagcgtccaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctca

SEQ ID NO: 10830 - DNA, 349 bp, Zea mays
  Clone ID: LIB148-003-Q1-E1-A6
gcacgcctctacagggcatcttgtcatggcgcaaggtggcgcccgctcctatggagccggtggcggacgggaccgccgcgctgacgtcaacgaccggctcgtgtagcgtcaagtatgactggcaaggttcgtggccagccgtcaacaagttcatggccgacgccgacgtcacgctggcctataagcccgtcaggaccagagcgatcgcgcgctcaatcagcagcatgatcgacatcacggggacctacagcatcgatctcaccgaagttgctcaacatgacatacggaaccatgatgcttatgttcagtggcctcatcgacgccactaccgcctagcacatcattgatc

SEQ ID NO: 10831 - DNA, 378 bp, Zea mays
  Clone ID: LIB148-003-Q1-E1-A7
acaaaaacaaggacggtagtttgtcacttgaagagctgaaggagggtttccggataaacgatcatcctgttccagaggaagagataaagatgttgttacaagcgggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggatggtcgcatcagttacccagagtttgaattgatgatgaaaa

SEQ ID NO: 10832 - DNA, 363 bp, Zea mays
  Clone ID: LIB148-003-Q1-E1-A8
acccacgcgtcggctcatcccctccgtgtcccggagcccagggagcggacgcgggcgggccggcgggcggccatggacgtggactgcgtctcgctgcccgacgccccggcgggcgacgtggatggcggcgccgcccggccgtggcccaaggacgtgaccaacagaggcgtccacgagctgctggagtgccccgtgtgcaccaactccatgttcccgccgatccaccagtgccccaatggacacacgctgtgttccacatgcaaggccagagtacacaaccgttgccctacctgcaagcaagagctgggcgacatcaagtgcctggcgctggagaaagtcgccgagtcgatggagctcccctgc

SEQ ID NO: 10833 - DNA, 425 bp, Zea mays
  Clone ID: LIB148-003-Q1-E1-A9
ccaaccaagcctccgagcccctggctcctggtccgttttggttttggggcaatggttcccaacaacggcaacaccaacggttacaacagttcattcccggaaggcggggctcacctctcgccaaaaaggctctggattccgggcgtggcggagggatgtgctgaggccggacaggacggccggcgaagcttgggcgccgccggcgcccaaggccaacagcaacgtcccaggagggcccttcggtcgtcgttgactcatccagatccagtcgcacccgcccaatcgccatcgtttcatgacacatcgaccagaagatagctagcaattcccatctcactggtgtgtgttattttagcttcttttaacgatgaagaactagtggcgatgattgaaataatacaacttaatgcaacgaaaattaagaa

SEQ ID NO: 10834 - DNA, 389 bp, Zea mays
  Clone ID: LIB148-003-Q1-E1-B1
gtcgaccgacccgtccactgaagcatttatcacgcaaagatcaatgggcaatggagaatctggtgtatatcagaatgataatttgcacaagtcatcagtgctacatactgggctgattgatactgatccaagtgtgaacttgcacggcaatggtggcctctctgtgtcttcgtctcaaaatccagttgtggactgtgtttctaggagagaggatccccttcgtgattggggcaatatcgcctgcagtgaaggaataattggatgtgaccataccaccaccgataatgaacacataaagctagcacacaggctgcacgataatgttcaaatgaatgtacctgtcatagttgaggacgtgactgataatgtgccttcaggcattccatcat

SEQ ID NO: 10835 - DNA, 438 bp, Zea mays
  Clone ID: LIB148-003-Q1-E1-B10
acgccgcaagagcacttcgacctcagcatgcccgcgttcctccagatcgcgcaggagaaggccggcatcgtgcccatctcctatcgcagggtggcgtgcgcgaagcagggcggcatccggtacaccatcaccgggaacaagtacttcaacatggtgacgatcaccaacgtgggcggcgccggcgacatcgcggcggtgtcggtgaaggggagcaagcgcgtcaagtggacggagatgaaacgcaactgggggcaagtgtggcagaccggggaagacctcacctgcgagtcgctgacgttccgggtgatgactagcgaccaccgcaaggccacctcatggcacgttctccccgctgactgggagttcggcgtcacgtaccaggcgtccaagaacttctaagtagccactttccctcctcttcttcaacctgcatgcccg

SEQ ID NO: 10836 - DNA, 414 bp, Zea mays
  unsure at all n locations
  Clone ID: LIB148-003-Q1-E1-B12
acgcctccctccctcccggccgggacaaaacggcggctcttctccttcggcccctcccggctctttctgtgaggcgggaaccaaggcggatgccgaggcgacggggctcgcgcaccgcacgcgtgtgcccgccgcccgggggccaggcgaggtggtgaggtgaggccgagcgcggttttaaattgttcacccggccgcccttctcgccgtagttttcagtggtacaagcaagggaggaacgaacgtgagggctgcctgcctgcctgcggacatgggctccagcctcaagtaccgatctggcctgtgcctcatcgtcgccgtcgtgctgatctgggtcatctctgccgaggtcacgcaggggatattcacanagtacagacatccatttgcagttacttacttgggggcctccct

SEQ ID NO: 10837 - DNA, 354 bp, Zea mays
  Clone ID: LIB148-003-Q1-E1-B3
cgtcaacctggatccaacccctacgaagcggacgaggatagccattgccgaaatgcagcggggccctctccggcggtctctgccagctgggtcggggcaggacgcccgatctgttggtgctccgccgaagcccaccattggcggcgccctatcgtggatgtggtggcagtcctgagcagcgaaagctctgtgcccggtgcgcggggggtcctatcaccttcgctcggtctgctccaatgcccattctcggcggtgccatgaccttggcgggactgggctccatggcggtctccttgcagcgaaagctccatgtcagtacgtggaaggtgcccacctttgcaaggcccacgtcat

SEQ ID NO: 10838 - DNA, 373 bp, Zea mays
  Clone ID: LIB148-003-Q1-E1-B4
acctgtacctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaag

SEQ ID NO: 10839 - DNA, 238 bp, Zea mays
  unsure at all n locations
  Clone ID: LIB148-003-Q1-E1-B5
aacctggatctaacccctacgaagcggacgaggatagccattgccgaaatgcagcggggccctctccggcggtctctgccagctgggtcggngcaagacgcccgatctgttggtgctccgcgaaacccaacatttggcgggcccctaccttgatgttgttggaatcctgaacaacgaaagctcctgtcccggttccccgggggtcctaacaacttcgctcggtccgctccaatgccca

SEQ ID NO: 10840 - DNA, 359 bp, Zea mays
  Clone ID: LIB148-003-Q1-E1-B6
agcagagggagagattggagggaggcccctgcccaaggcaagagaaaccgcggcgcgcggagagggaggaagggcagacgcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagct

SEQ ID NO: 10841 - DNA, 365 bp, Zea mays
  Clone ID: LIB148-003-Q1-E1-A11
atgtctaacatcactacaaaataacaacgaagctcaccaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatg

SEQ ID NO: 10842 - DNA, 290 bp, Zea mays
  Clone ID: LIB148-002-Q1-E1-G7
gcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctcgcggtggaggagcgcaacctgctgtcagtcgcctacactaacgtcagcg

SEQ ID NO: 10843 - DNA, 400 bp, Zea mays
  Clone ID: LIB148-002-Q1-E1-G8
ctatcatcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaacgactacgtggtcaaggcggctg

SEQ ID NO: 10844 - DNA, 392 bp, Zea mays
  Clone ID: LIB148-002-Q1-E1-G9
atcaccggaacgggaaaccttgaccggcagggcccaaccgtgtggagcaggaactcctgcaccaagaagtacgactgcacgatacttcccaactcgctggtgatggacttcgtgaacaacggggaggtgtccgggatcacgctgctcaactccaacttcttccacatgaacatgtaccagtgcgtgaacatgctgatcagcgacatgaccgtgacggcgcccggggacatccccaacacggatggcatcgacatgggcgactcatcagggatcaccatcatcaacaccgtcattggcgtcggctacgactgcatctccatcggccctgagacctccaacgtgaacatcactggcgtgacctgcggcgcctgccacagcatcagcatcggcag

SEQ ID NO: 10845 - DNA, 157 bp, Zea mays
  Clone ID: LIB148-002-Q1-E1-H1
caagtgccggcctcgccattagatctccaagcgaatcatgtcgagatatcaccatcggtccaggctcttgcagaaacgaggaaaaaatacatgtcatctcgctgggttagggcggctgtgtatccgatgttctcgacgacaggggtagtgctgggga

SEQ ID NO: 10846 - DNA, 287 bp, Zea mays
  Clone ID: LIB148-002-Q1-E1-H10
gcctctagctgagttggttaggtggtctgagtagcactcctcaggtcctgggttcgactccccgtgggagcgaatttcaggctgtggttaaaaaaattccctcgtctgtcccacgccaaagcacaggtctaaggctcagccccggtcgtggtcgttctcacataagcttcgatgccgctgtgtatgggtggggcaggggttcgggggttttcttgacctgtgtgagaaggtcttcttcttaatacaatacccgggggctgtcttaccccccgcaggtcaagttttaa

SEQ ID NO: 10847 - DNA, 411 bp, Zea mays
  unsure at all n locations
  Clone ID: LIB148-002-Q1-E1-H11
ggaggtggccgtgaagcagctcaaggccgggagcgggcagggcgagcgcgagttccaggccgaggtggagatcatcagccgagtccaccaccgccacctcgtctccctcgtaggctactgtatcgccggctcctcccagcgcctgcttgtctacgagttcgtgcccaacaacaccctcgagcaccacctccacgggaagggtgtgccggtgatggcctggccggcgaggcttgccatcgccctcggctccgccaagggcttggcttacctgcacgaagattgccaccccaggatcatccaccgtgacatcaaggcagccaacatccttctggacgagaatttcgaggctaaggtcncgggtttcggactttgccaagctgacacagacaccaacacgcacgtctccacgcg

SEQ ID NO: 10848 - DNA, 393 bp, Zea mays
  unsure at all n locations
  Clone ID: LIB148-002-Q1-E1-H12
caaggttgctatcatccaccacaaggcaagagctgcagacgtcaatccagaatacgaggctgcagggatcgatacctggccagaagatgagggagcaatcgtagagtcatcagacgacgcaaggcactggacgtcagacaacgttgcaatgtccaagtctagaatgtcagctcattggtcagaacagatcggctgcacagaacgctagattgatatcagcacaaagacagctcatccattcctcagaattcaaggcctctcgtggagtacaacagtatacagtacaaagaaggatatccagtgatgacagacaagtaatgcatagctatcacaaatttgctggcaacgacgatgaagacgatagtgacatggaaactgattttgctancatac

SEQ ID NO: 10849 - DNA, 305 bp, Zea mays
  Clone ID: LIB148-002-Q1-E1-H2
gggcaaacatgcagtagttgagaaggtggaggaggacaaggaggaggcactaacagtggcggcgaaacatgagccagcaggcatcattgagcctcatcagattgctagtgaggtgaccacttcgggagtggcggtcgtcgttgtcgaacctgagaacagagtcgacgaggaagttgtggagaagaccgtcatcgagaaggagatgccatcagcagtccatgcagacgaaaatattgccaccatcaaggtggcaaccgagcccaggacagtattgaagaacgacaccgtggaggagatatagatgg

SEQ ID NO: 10850 - DNA, 333 bp, Zea mays
  Clone ID: LIB148-002-Q1-E1-H3
cccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcggcgccatctgggcgttcagcgtcgtcacctacttcccgctgtacgtgctcaagttcggcatccgctacgcgctctccggcaaggcctgggagaacatcagcaacaagacgggcttcaccaggcgtaccgactactgcaagggggagcgagacgcgcagtgggccacgggacaaaggacgctgcacg

SEQ ID NO: 10851 - DNA, 407 bp, Zea mays
  Clone ID: LIB148-002-Q1-E1-H4
gcacatcggaaccaacgcccaagaaacaccggttccatcttcattctgatttttgtcagatgttcgagatggtgactttggcagcaaactatctggcagaagatcagaatggttactagcatcctctattggaagcaaatcacacggaccgtgacctaaactaatttaactatgaagtgtgaccaatagaggagatataagtggggtcacaatggaggagaccaaagcggggagatcgaagacaaaggaggcctcctgtgcatggtttgtttctgttttcccctttcgagttctttcttgcgacaatcttgggtcgcacaaatgggtgttgtaagtaatgatctgtagctacaaatgtatgatgggggagtgattgcttcccatacatgttccttccggggctatgt

SEQ ID NO: 10852 - DNA, 385 bp, Zea mays
  Clone ID: LIB148-002-Q1-E1-H5
cgagtagatacctcgcgatggctggagcctgtgtagtgctcagcgtcctcgcagctgccgtcgcggtccaggtagcgcggccgcgatctgcacgcgggggagccgcgcgagttgcgcggcatcgcatgaacacactgtcacccgacctgtgcaccagaactgcggagaatcacgtcagtaggtataacgtggtagatgctgtgacggtgctagaaatgcaagtggacgcttacaagatacgtgtcaaggccgttcggatgctcgccaacgatgaggtcaacactgcagcgacgcccgacgtgctgatggagcagaagctctgcagtacctactatctggacgtcgccgacaagctcggtacctgcaagcgctccatcagtttccg

SEQ ID NO: 10853 - DNA, 408 bp, Zea mays
  Clone ID: LIB148-002-Q1-E1-H6
ggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcgggaccagcaacaagaccatggctatatgcacgaacgccaacggcagcaccaatggttgcctcaagga

SEQ ID NO: 10854 - DNA, 391 bp, Zea mays
  Clone ID: LIB148-002-Q1-E1-H7
gacggacggtccgccgggcggcggcgccgctaggtaagtaggtagctagagcgctgcgccaaccacgacgtagcacatgcaatggcactcgcggccgtggcgctgccgtcgtcctcgatcgtcggcctggtgtctagctgcacggaaccgcagccatgcagacgatctcgaccgtacgccgtgtgtagccggccccggccaccgcccactgctgccaactgcccagtgatgacgacccggccatgtccgccgtacgcacggtcctgcctctcgatcgtacgccgtgagcaacaggagttctgtccggcgctggaggtcggtccttgtcctggctagagctagcccgcccgccggtcacacggatcggatctctccatccactcccagctgt

SEQ ID NO: 10855 - DNA, 406 bp, Zea mays
  Clone ID: LIB148-002-Q1-E1-H8
cggacgcgtggggcaagaacatggggttccacagcacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgactgcgcacgggcgcaccgaccccaacatgaagtccgggctcgtcatccagaactgccgcctggtgcccgaccagaagctgttcccggaccgctcaagatcccctcgtacctgggccgcccctggaaggag

SEQ ID NO: 10856 - DNA, 401 bp, Zea mays
  Clone ID: LIB148-002-Q1-E1-H9
ctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaatgacagccacgaggaggacatctgcg

SEQ ID NO: 10857 - DNA, 382 bp, Zea mays
  Clone ID: LIB148-003-Q1-E1-A1
ctcacgggccgatacacgcctctagagtgagtcatcctatggaagctctcttctttcttcctcctcctcgtcctctcgaattccgtctcttgtctctgtcctcctcgctcggcttccccggttcttgagaggggaaataggaggcggagccgaggagagggatggggagggacgagaggttcccagtgtgggacgccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgc

SEQ ID NO: 10858 - DNA, 256 bp, Zea mays
  Clone ID: LIB148-003-Q1-E1-A10
cgccgcaaccgcaacatcagccatgggcgcctgcgcaaccaagcccaaaacgcttgaggggcaggccccagctgaggccgccgtctccacacccaaggttgcgcccgaggccactccaatctccgttgaggttgcggctgatgaacaggtagctgagaaggtggtggtggaggagccggctgccgcggccgacgttgagcatcaaaaggctaatgaagtggtcgctccagaagcggccgtcgccgagcccgattac

SEQ ID NO: 10859 - DNA, 404 bp, Zea mays
  Clone ID: LIB148-002-Q1-E1-G6
cgcgcgcccacgctgccgtccccaaggtgaacggtggcaagtctgcggtggcggatgtggagcacgagaccataactgtaccttcgtcggtgccgaggactttctacaaccagcttcccgactggagcatgctccttgctgccatcacaaccatcttcttggccgccgagaagcagtggacgatgcttgactggaagcccaggcggcctgacatgctcactgacacttttgggtttggccggatcatacatgatgggctcatgttcaggcagaacttctccattaggtcctatgagattggggctgataggacggcatctatagagacaatgatgaaccatttgcaggaaacggcacttaatcatgtgaagaccgctgggctgccaggtgatggattcggctcc

SEQ ID NO: 10860 - DNA, 407 bp, Zea mays
  Clone ID: LIB148-002-Q1-E1-F12
gactaactgtgcattcttattgtcatcagttactagtttcattgacacgtcaatgattttattaattttattgctttgtgcagatgctgttaactaggacacgttgcatatgctgatttgtttcgcactactgcattgtagtttttggctcaacatttgaattcatatgcaatcaagaactttatcttagtgtgctaatttgtctgtcatgttagtcataaataatacctttagttcttaagagttcatactagatgttctctgatctgagtgctgcattctttcgaactatagtgctaagcttgtcgatcaagctcttgcctccggaaagatttacgatggagatgggttcaactacatcaaataatcttttgaaagtggtactcttcaccttactgggttgttga

SEQ ID NO: 10861 - DNA, 412 bp, Zea mays
  Clone ID: LIB148-002-Q1-E1-F2
ggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcaaggcccagccgtgtggagcaagaactcctggcacaagaagtacgactgcaagatccttccc

SEQ ID NO: 10862 - DNA, 400 bp, Zea mays
  Clone ID: LIB148-002-Q1-E1-F3
cacacgcgtccgcccacgcgtccgggcagcggcgattgcatcgagaagaatcacaaagtgatcaaacgatgctcattctaccacgtcggttccaagacaacttgctggcacagcatttctgttgaactttgcttttactacatgatacttcgaggtggcattgagacgtagggttgccttgggaatgtgaacttcaccacatttcctggtcctgccctgaccctgaggcatattgggcttgcgataccagggctctagataagtaagatatcccactttgggtattggttgttgatgctcctgccaatggcagttagctggatccaacgggaaggttcagcaccagctggtggtgatgtaaaatccttcacttcatgaattactgtaccattaccgtttc

SEQ ID NO: 10863 - DNA, 415 bp, Zea mays
  Clone ID: LIB148-002-Q1-E1-F4
cagacgcgtggggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagttt

SEQ ID NO: 10864 - DNA, 389 bp, Zea mays
  Clone ID: LIB148-002-Q1-E1-F5
cggacgcgtgggcggacgcgtggggtacgcagatggccatggagggtcgtcgtcgtcgtcgtctcgttctgtggctcgtgatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtagccctccgccgtatctgtcgcttgcacccaacggctccagccctctgctcgcgcagactgctctc

SEQ ID NO: 10865 - DNA, 349 bp, Zea mays
  Clone ID: LIB148-002-Q1-E1-F6
gtgagctcagcacctcaagtagaggtgactcctcgatcatgtccagtcataccaccaccatctccagttgagacactagttccaccatcacagtcatcgccaccggaagaagcagttagctcaacacctcaagcaccagtgtcgtcatctccacgagctcctgtacgctcagtacctccactgaagtcctcgccgcctcgagtagtagagagcgcaccaccaccgacaatatagtcatcacttccactggctccactgagctcaccagctcatgtatgagaagacttctcgcatgacttgcacgagtcaactcagcagctccgtcatctacgtcatcagtaccagtagc

SEQ ID NO: 10866 - DNA, 398 bp, Zea mays
  Clone ID: LIB148-002-Q1-E1-F7
gagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgcctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctg

SEQ ID NO: 10867 - DNA, 406 bp, Zea mays
  Clone ID: LIB148-002-Q1-E1-F8
atctcctccatcaccaccaccaagctcaacaacagccagctcgcgaaaataatgaagagccgcagcatggcatcatcggccgcgctcttggtgctagccctcgcgctagtggcggacaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctgtcaggaggagtgcgacaaggcgtacgtggtgaaggcggccg

SEQ ID NO: 10868 - DNA, 225 bp, Zea mays
  Clone ID: LIB148-002-Q1-E1-F9
ggaactcgcgcgcacgacaacaaggcgcagcataggtacacccgttgcacccgcgttgctggccctctgcgcgtgttgccggcatcgccgaagaggtcagcggccgcagatttcaaggcagggacgagcaacggtaacgcagtcagcgtcaaatcaatccatgacgacgtctgatagatcctgtgagatgacctgaaggtgacgttactaggcgtgtgtattttc

SEQ ID NO: 10869 - DNA, 412 bp, Zea mays
  Clone ID: LIB148-002-Q1-E1-G10
cccacgcgtccggttaccccttcggcctccacctatcaccacccgggacgtcttccatggcctcctcgtagtagaatagttctatctcaccgcaacaactcctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctggcgcgggccgaggacccgtacctgttcttcgagtggaaggtgacgtacgggatcaagtccctgctgggcgtgccccagaaggtcatcctcatcaacggcgagttccccggccccaggatcaactgctcctccaacaacaacatcgtcgtcaacgtcttcaaccagct

SEQ ID NO: 10870 - DNA, 354 bp, Zea mays
  Clone ID: LIB148-002-Q1-E1-G11
gccggatctacagcatccatctgagcgtctgcgcgcggcggctctcacactgaacacacgcatggtgcgcataggcgaggccaaggccaccgcgagggatcgtgtggtcagctgggatggcaatgcgatgcacctccgccgcgctgctcgtgctggcgctcgtcgccaccgtagtgcgcgcggaggacccctaccacttcttcgagtggaacgtgacgtatgggacgaacagcatcatggggactccgcagaaccgtgattctcatcaatgatctgttcctcggacgtaacatcaactgcacattcaataacaagatcgtcatcaatgtcttcaatatgctcgagcaactgctc

SEQ ID NO: 10871 - DNA, 405 bp, Zea mays
  Clone ID: LIB148-002-Q1-E1-G12
ccgcacccaccgctgctccaccttctccacgagcccggcaacgggaaccaaggaaaccgaagccccgatgacaagcttcttcagggacgcgcgcctcccgcagcagcgcgtcgtcgagggcgtccccttcccggcggtgctcgtcccgagcgctcgtgcgggctcctgcgccggcggggtcgacaagttcctggcggccgtgcgctgcgagagggcgtcccggctggagccgctggtgcgggacgcgggggccctgctgctgcgagggttccccgcgacgacggccgccgacttcgaccgcaccgtcgacgccttcgggtacgaggagctgccaatcgtcggcagcgtcgcgccgcggaccaacgtcgtgggccgggtgttcaccgccaacgactcgccgcccga

SEQ ID NO: 10872 - DNA, 350 bp, Zea mays
  Clone ID: LIB148-002-Q1-E1-G2
gatccccccacaccttgagacctgcgttgtcacccacccatcgaggttggggccgccagcaggttcagccgttcctgttcttgataaaacgagagaaggatggcagtgtttcagggagctgtcctagtcttgtttctcctcctcgtcgcatcagatgtgggaaccatcgatgccaaaatgggagtagccatgcacatgcatgccttgataatggagaaagcgacacagcatgacacggcgaagaacgaggagaatatcacggataaggaacagagtcaatgcttatcgccgagtctccaattcgagggcttctgcttcaacagtgacagatgcgcccacgtgtgcatgaa

SEQ ID NO: 10873 - DNA, 390 bp, Zea mays
  Clone ID: LIB148-002-Q1-E1-G3
gatacgcgtacgcttcaatcctcgctccgcgagctggagatggaggatggagaggggacaaggtttccggggccgagtccgagacggaccccgcgccggcacgatccggtggatgaagtgcatcacaccttgagggacgccccttggacagcagtttgtgctgcaaattctatatagctctgtcgcagcatggcctcggtgggcgtggcacgcgcttctttgggatttcagaatggcacaagttctagcagtgacccagatcgtcatcccaacgagttgggcagtatgagcattccggacgacaaggacgttgacgatattgtagtcaatggcaatggggcggaacctgggcatatcatagtgaccagcattgatgggagaaatgggcaa

SEQ ID NO: 10874 - DNA, 409 bp, Zea mays
  unsure at all n locations
  Clone ID: LIB148-002-Q1-E1-G4
gcaccgcgaaggccaagatgctaaagggcatcggcgtggtcggaatgatcgtggtgaccccggagttgttcggtccggtaatcatcccgaggccgcacgccatcccgacggtgcaagtctctaacgcggcggggcagaagatcaaggcctacatccacaaggcgcgggacccgacggcgacgttcgtcttcaaaggggcagcgttcaacaccccaaggtcgccgatggtggcgcccttctcctcgcggggcccgaacaggaggagccgtgggattctgaaacccgacatcatcggccccggggtgaacatcatcgccggcgtgccctcgatcgangacgtggacctgctgcgcaacgcggaggtgcccacgttcgacatcaagtccggcacgtccatggccgcgccgca

SEQ ID NO: 10875 - DNA, 406 bp, Zea mays
  Clone ID: LIB148-002-Q1-E1-G5
gccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagacgacgacaccacgagccccaag

SEQ ID NO: 10876 - DNA, 400 bp, Zea mays
  Clone ID: LIB148-002-Q1-E1-F11
gccggagaactacaagtatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacc

SEQ ID NO: 10877 - DNA, 402 bp, Zea mays
  Clone ID: LIB148-002-Q1-E1-D7
cgacaccagcaagaactccgacgtcatgcgcgccctaagcaacgccgtgcacgcgctctcgtggcgctctggcaccaccggtgccgctgtagaagcgtgccactgggccgacgggtacccgctcaacgtgctcctctactgctccctcctccaggccatctttgatctgagggagagcaccgtcgtgctcgacgaggttgacgagctcctggagctcatcaagaaagacgtggccgacgctcggcatcaacaggatgctgcacagcgtgtgcttgtcgtgggtcttcttccagcagtacgtgatcacgggccaggtcgagccggacctcgccgctgcggcgctcgccatactcgttgacgtggcagccgacaccaagcacgggagccgtgacccgatgtacg

SEQ ID NO: 10878 - DNA, 398 bp, Zea mays
  Clone ID: LIB148-002-Q1-E1-D8
ggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggacgacgccgcgagaaggtacttccaccagctcgtcagcgccgtcgacttctgccacagccgcggcgtct

SEQ ID NO: 10879 - DNA, 286 bp, Zea mays
  Clone ID: LIB148-002-Q1-E1-D9
gccgttttcacctcgtgttctgaccatccagtctaactaatccattcctgtgctgctcggcgaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtttaaaaaacaatcattgtaatgggagttatatatacttttatcttaacatttatttacaccagcaagtcctggtgtatgc

SEQ ID NO: 10880 - DNA, 64 bp, Zea mays
  Clone ID: LIB148-002-Q1-E1-E1
ctggggttcatgatccatggaggcgatgtcactaagaggatgggcagtgtgggctagtcaatct

SEQ ID NO: 10881 - DNA, 413 bp, Zea mays
  Clone ID: LIB148-002-Q1-E1-E10
cccacgcgtccgcccacgcgtccgagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaaatgcaccgagcagaagggcatcacggcgccggccatgaaggtctgccaggaggagtgcgacaaggcgtacgtggtgaaggcggccgatgtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggggtgacgtggcg

SEQ ID NO: 10882 - DNA, 407 bp, Zea mays
  Clone ID: LIB148-002-Q1-E1-E11
ggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggtggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaataaacttcagcagtgatgccctcattg

SEQ ID NO: 10883 - DNA, 409 bp, Zea mays
  Clone ID: LIB148-002-Q1-E1-E12
cagagctcctgactgttcctctctccctcctcacgggcgggctccgtctgttccgtccatccaacgccccggtcgtctcccggccagatccctctcctgcatggtttctttgcgagtggccggagaagatgattggcgggttcctctccaaagtcctcctgctggcttttggctatgcctatcctgcctatgaatgctacaagaccgttgaactgaacaaaccacagattgagcagctcatattttggtgtcagtattggattttagttgccctgttgacagttttggagagaattggcgattttagactatcatgggtaccgttttactcagaatcaaatgtgttgatctatgtagatttgtggtaccctaagacaaagggaactacgtatgtttatggcactttctt

SEQ ID NO: 10884 - DNA, 415 bp, Zea mays
  Clone ID: LIB148-002-Q1-E1-E2
cattcctgcctcgcaaggatgagtggccggctaggctagctggtgcttggacgtcataagctgcctcctgcctgccgtttgattcctgtgcaacaagaaggctgacaaaaataaaagggggtgggtcagtgaatggacattttaaaaccagttagcaccggcatctaccgcaagctagtttgaagttggtataataggtgcaagcgaataagacggacacgtatcagtggacactgcaagtaaatccaccgccaaatttgccatcctagggaagaaaaatgattccctggttaacttgtggaacccgatttaatttgagacaagacaacaataccagggttgagcttgccacttggtcatgacacacacgagaatacgagatgaccaagtaaaaactggacagaatgcactcaca

SEQ ID NO: 10885 - DNA, 411 bp, Zea mays
  Clone ID: LIB148-002-Q1-E1-E3
gaagccccggtccctcggtcgtcgcaaggcgccggcagccccgtcccctcctgttcttcaggacgtgttcatggagccccagcccgggtcgccgacgtcgtcgcccttctctccgatgggagcgccggacgagccagaggaggaggccaccgaagtcgatccgggcaggaagtcgacctccagctcgtcctcctcctcgtcgtcatccgcgtcgtcggctgatgacatcccgtgccacatcgacgtcgagctcgtcaaaccgtttggcgcggtgctgcccgagcacgaacacggagcggaggccaaaacggtccgatcggcgacgccgaaggaggaacgagccggagccgcccacgtgcacggcgagccggcggactgcgcggtgacggaggacgtacaacaggccggtcc

SEQ ID NO: 10886 - DNA, 415 bp, Zea mays
  unsure at all n locations
  Clone ID: LIB148-002-Q1-E1-E4
cgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcangaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaaggga

SEQ ID NO: 10887 - DNA, 395 bp, Zea mays
  Clone ID: LIB148-002-Q1-E1-E5
cccgactacgcaacctgtgtgaagatctccactgatgcttccatcaaggagatgattcctccgggcgctctggtcatgctgactcccctcatcgttggaaccctctttggcgtcgagactctctccggcgttcttgctggtgccctggtttctggagtgcagatcgccatctctgcttccaacaccggcggtgcatgggacaatgccaagaagtacatcgaggctggtgccagcgagcacgcgaggaccctcggtcccaaaggatccgactgccacaagggcggctgtgattggtgacaccattggtgaccccctgaaggacacctccggcccgtccctcaacatcctcatcaagctcatggccgtggagtccctcgtgtttgcccccttctttg

SEQ ID NO: 10888 - DNA, 407 bp, Zea mays
  Clone ID: LIB148-002-Q1-E1-E6
ggcgcaacggcgacggcggcggcgaccagctcgttgtcgccttcgagacgtaccagcagctgagccgcgtgtctatccgggccatgacggccatctccgacctggaaacgatccacgaggacgtcgtcaccagcgcgcaccagaagcgagccgcgctcatcgtgctccccttccacaagctccaccagatcgacggccacatggagtcgcttggcgaccagtaccagcacatcaaccagcgcgtgctccaccacgctccctgctccgtaggcatcctcgtcgaccgcggcctcggcggtgtcgctcaggtggccgccagcgacgtgtcatacaccatcgttgtcatcttcttcggtggccgcgacgaccgcgaggccctggcctacggcatgcgcatggtcgagcac

SEQ ID NO: 10889 - DNA, 219 bp, Zea mays
  Clone ID: LIB148-002-Q1-E1-E7
cccacgcgtccggagatatcaacccatcggctcacatgggcttctactcaaggcttatcgtgtgttgtgcctccgttgcgactacggggatattaggttgtgtgtgtatgtggaccgacaccactgttgagctgtcgacccattagggctatggtcatttgagtctatatattgtaccccatctcctatgcaatacaatcaactactacagattcctgc

SEQ ID NO: 10890 - DNA, 333 bp, Zea mays
  Clone ID: LIB148-002-Q1-E1-E8
atggcctctaccgcaaagtcatcgcaatcatccacaaggacttcgacgccacgataataatcagctgctttggcgctacaatcatcgtcgatgtcatcttctctatgaaagggtgaatcaaattcttctcccattcctccatataaatcgtcactgtcattagcgtcaacatcatgtaaaacatctactatgtctaactctcaacatgggaagactaatacgtcgtcttcatcgtcttcatcgtcagatcatacagctgcagtgataactggccttgtacttgacgtcgtgggcttcgatctgctcatgttaaatccaggtgtacgtgtgttg

SEQ ID NO: 10891 - DNA, 411 bp, Zea mays
  unsure at all n locations
  Clone ID: LIB148-002-Q1-E1-E9
gtccactctcgtgtcggtcccgcgatgggcatgttcgcatcggccgcaaagagatacagcagcggcaagaattttctccgcaccgcgggcgtgtgctgttgttcgccgtccgcctccgccaagcttggaggtgtgcgcggcaaggaagagacatcgacatcggcgccagctttcgcgccggatagcatcaagaaaaggtggaggaatacgacgttctggaaaaagaagatgaatgccaggaatgagatcggcgggctggtggacctcgtcaacgatatttcggccaagtcagatgagagcctacgggttagcaaccacaacatgcccagcagggcgctgacgttcagtcagctgagcgccacatcngacgggttcagttcgcagaacctgctcggagaaagcggctttgga

SEQ ID NO: 10892 - DNA, 399 bp, Zea mays
  Clone ID: LIB148-002-Q1-E1-F1
gtcatctcctccatcaccaccaccaagctcaacagcagccagctcgcgaaaataatgaagagccgcagcatggcatcatcggccgcgctcttggtgctagccctcgcgctagtggcggccaccgccccacatgtatcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgttcggcaagattcagtgcaagggcaaatgcaccgagcagaagggcatcacggcgccggccatgaacgtctgccaggaggagtgcgacaaggcgtacgtggtg

SEQ ID NO: 10893 - DNA, 410 bp, Zea mays
  unsure at all n locations
  Clone ID: LIB148-002-Q1-E1-F10
gcaaaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgangggcatgct

SEQ ID NO: 10894 - DNA, 404 bp, Zea mays
  Clone ID: LIB148-002-Q1-E1-D6
gggacagagagttctgctttctggtttgctcttggagggaaacagagttacacaaataaaaacactcctcaggatattattactagagagcctcacttgtatgcattctcattcaagaacgggagactggaggttactgagatcttcaacttttctcaagatgatttgttaactgaagacatgatggtacttgacacacatggtgaagttttcatttggattggtcagtatgtggaatcaaaagagaaacagaaggcatttgacattggccagaaatacgtggagcatgcaaattctattgaagatctttctccacatgtaccactatataaagtcatgggagggaatgagccatgcttcttcaggacgtacttttcttgggataacacagaatctttggttca

SEQ ID NO: 10895 - DNA, 419 bp, Zea mays
  unsure at all n locations
  Clone ID: cC-zmpo14820021a03a1
gaaacgccaaacgtggttggtgggacaaagttcacgcttagccaaggttatgcggcgacccaatggcggaagcacggtnnttgggggggggcccagccggccagcccaatgcaaataggtgaaatcttgggtgggggactgggggcccaagttccaccaacgcacctacacgctcagaaaagctccagcttttacagggaactgcgcgcgagtttacgctgcagcactgagagtaatccagaagagagatgatggagtcgtgaaaaaggcgccgcatttttctcttccctgaccaaatgaaccgctgctgcaccggcacgtcctcctcgtccgtcgctgaagctctgccacccctccctaaggaggaggaggaggcaagagagtgggtgtccggcttcagtcgtaggggttcctgaact

SEQ ID NO: 10896 - DNA, 550 bp, Zea mays
  Clone ID: cC-zmpo14820021a04a1
tttgaacaacaacatatctccattccagcaaacaacatgtgagcctaaaactcggaaaaagatcaatacaatgtgcagggaaaacaacggcatgcagctaattcccagcagaatcctcggtggcggtgcgcctccttagcttggcgcgcgtcacacggatcgtctcctccatcagcgtctcctcgagcgcagggtcaagctcttccgcgccctctgcagcatcaccactgacctcatcgattgccatgttgtctacttcttcggtctcagaaagtggtggggcactaggctcggattttggtgaatctgcacttgtggctggagtttgaactgggtcgacagcaggtttgacctcacctttctttgggctaccgccaggttttggtgtggatgcagctgctgcaggctttgtggatgccaccgaaccaggtctccctgatgtttgacgcttgatcttgggtgaagatggaacgggtatagtctccagagattgctgtgccattgctgcttgccgagcaacaatagatgctcctctgcgcatacaggtgct

SEQ ID NO: 10897 - DNA, 390 bp, Zea mays
  Clone ID: cC-zmpo14820021a05a1
aacacctgaatttggttggtatttagagaaaaaattttataccctcaaattcagggtgttacaccgtcgaacataatatagctgtcggatgtctgtcattttactgttgtgcgttaccaatggatagcatgtaatgggcaatgcaaggacgagagaaaaattataactagagagatgggtcagtcgacggagggtctagaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcaggctaacggcctccggggtggaggaggtgccggtgcggacgcgtgg

SEQ ID NO: 10898 - DNA, 461 bp, Zea mays
  Clone ID: cC-zmpo14820021a06a1
actgagttgaacgtgttcatcacatagtactatctacaccaagtctggtagcagcatgtacatggataaggcaagagcggactgtaatggagaaggatacaggagatcatgtgaaattctggactcaattgaaggcgccaaaggagatgtaccagactgcaatctggtgcaagcccgcgaagatacgtgcacagcacagaggttaaaaggagaaaaaatgaactagacaacctgcggctctcatcgaaatcttcaaataaaggtcgaatcagttggtctttcgaaatctttaaagaaaggtcgaatcagttggtcttctttgacgaatcatcctgagaggacgtagcgtcgttactgctgttatctttgttgccgtcgctgttattttcaaggtcaggaactactgctgtagacggttccacgttagatagacgagctgcgcctataacttgctctgggag

SEQ ID NO: 10899 - DNA, 536 bp, Zea mays
  Clone ID: cC-zmpo14820021a07a1
gcccttgaatcagtgcgctttcaagtttgaacagtgaacagtttaccatcacatacatgcccactcaattggggggggggcgaatgaacgacagagattacgacgcatgtccagtacaccgactgagatgaccaaccagccagctgcacctgcactcacactcactgggcatggccgaggatcgtgaagtgtgggtcgaactgcggcagctcgtcctcgtcgccgtcgccgtcgaggtcaatgccgccgtcgggcagcaccaccccgacgccctcgggcctgcacgtcctgtccgtggccgggttgcacccgtacgcggagccgccgggcgtggcggcgtccgcggacctgacgagcagcacgcaggcgaatgccagcgccagcgccatggcgagcaagcgtgcgcgcggcggggacgtcgtcatggagatcgatcgattgccagacagacacacaaacacaaagggtaagctttttcgggaaggtggagtggaggccgacgcgatcgcgcgctaacacggaacggaagtcccttt

SEQ ID NO: 10900 - DNA, 557 bp, Zea mays
  Clone ID: cC-zmpo14820021b01a1
taacaattgtgttgccttgttcttgatttatagcctttgagaacaagtgaccaacattggcgcccaccttgtcacaaccgggttttaggggtctaaagcccggacgtgaacataatcaccaggtgtgctgggaccaagtctcacacatatgatgaatcatggcacaagatcgaatgtcatatctttactacataacatgaattctatacaaaataaataattaaattataaggagacaacggtccagcaacccaaagttgactgggagacgacgacctagaccactcacgaactcatcacagcatcctccaagcgcttcatcctgtggtacctgttcttgacctggcacttgagattccagttaccagggtgattctttggatactcgaaacctcgcgacgacaagtccgtggcggcaacaatttcggccacggcgcagcgcatgccagcccttcgaagcatgcccaggtctgcccaacctcaggggcacgacgacggacccgtaccggcaaggaaacgccatggtccgagggcatcatccctacatcccacgctta

SEQ ID NO: 10901 - DNA, 361 bp, Zea mays
  Clone ID: cC-zmpo14820021b02a1
agacaaagcagttcaatcacattatatattgttccaggtttacaaatcgtaagacaaccaaacttgctttggggtcgaatcacaaaattatttgccaaaacgatacaataaaattatataaacaaggggggaaaaaatgccgaacgaaggatgggtggtgttcaacggagcggccacgcacaatcccagggcatggagactgctaattaattaatgttggcgtgggtgtcgttgtttggatgcattcacagggcctttgtttacgaggtagttcaccgagcctttcaaccaccatgttgcacttgccaggggtcatggcttcgtcgaagatgccgatcacaagcgcctgtccgggtttttt

SEQ ID NO: 10902 - DNA, 503 bp, Zea mays
  Clone ID: cC-zmpo14820021b03a1
tgcttaaagcgacagacttcaattacaaatgcaaatactagagcagttcagcaagtgatgatggaaggaaacacccaaacattacccagggggccaggacacaaacaaaggtttttcaacaccacaacctggctcgacagccaaacagattcatgcaagcagatcagtattcctcctcctcgtcaccgtcatcactgccggcctctgcggcgacctcctcgtagtccttctccagggcggccaggtcctcgcgtgcctcggagaactccccctcctccatgccctcgccgacgtaccagtgcacgaacgcgcgcttggcgtacatgaggtcgaacttgctgttgatgcgggagaacacctcgacgacgctggtggagttggagatcatgcacacggcacgctgcaccttggcgaggtcggcacccggcaccacagttggcgcctggtagttgatgccgcacttgaaccccgtcgggcaccagtccacgaactggatggtgcgc

SEQ ID NO: 10903 - DNA, 589 bp, Zea mays
  unsure at all n locations
  Clone ID: cC-zmpo14820021b04a1
tttttttttttttttttttttttttttttttttttgggttttttttttttttttttttttttttttttttttatttattataacaatctatttatttttactctattatacggggcaaaaaaaaacacaatttttttttttttaaaaaccctaaaaaaaaaaaaaaacccccgcccctggggcaaacccgaaaaaaacccaacccacccccaaggccccccccctttcccaaaaaggaaagcaataaaaaaggggcaaaaaaaaaaaaaaaccatttccctaggaaaaaatttttatctctacaaatccccaaaaaaaaaaaagccgaaaaaaaaaaaataaaaacccgggggcccaaaaaagggacaaaacccacctaaaaaggggtgcccccaacgccccctaacaaaaaaaaaacagccccccccccttataaaaaaaaaaacccaccacccggaaaaaaggccctttataaaaccgccccccaaggttttttttttttttccaaaaaaaaaggaaaaaacttgttctccccacccccccccccccaaaaaaaagagaanaaaaagtacccctctctttttcccac

SEQ ID NO: 10904 - DNA, 532 bp, Zea mays
  Clone ID: cC-zmpo14820021b05a1
gaatgaattgttgaatggattcaaacaaatggcaagcgatgaaatgatacaagtgttaatccctctctcaggggaagaacatcagcggcatgcatcaattcgttaaattaaggagaaagagggaacaaagaaaaagaggacaaaaggtgtgtcgaatcaaaaaacatgcccacgcatcggaatgcgcgcagccatgtcactctctctccccttcgtctcttcctcggcctccgggcgccccggccggctcactgaatgtagtaggcgaagaaggaggcgacggcggccccgagggcggcgccgacggcgggcgcgacggcggaggagccgctggtgggggccggagccggagcctccgcggcgagcgccacggtggccgccgaggcggcgacgaggacggcgcaagcgatcttcttcatctccatccctgaatgcggcggcggcggtggagggcgggacggaatggaacggaggccaggaataaggacgggcgcggcgagcaagctggcttgctgctggctggctagctagc

SEQ ID NO: 10905 - DNA, 478 bp, Zea mays
  Clone ID: cC-zmpo14820021b07a1
acaaacaaaacggataccttggcatcataaaaacaaaacggatacccttcctcctcgacgagggatgagggaaaaaacgagaagttaataaaattaaaaaaaaaagcaatataaaagagcagaagtagcagtacatctgcatgcatgcagatttaggcccatcaaaagaagcggatcgaacgtttgcttacgaggccaggcccattatcgctgccctcgaatgcagtgcatagacatacacaatacaaaaaacgcggaaggcagctaccatcttcaattcttgggcgagcgggcagggcagcaatggatgcaggcatgcacaggacggaggacgatcatggcgtctcggaggcgtccttgagatcgtacttctcgaggagggcgccgcactccttgagcgggtccttgcggaagaaggcgatggggttggcgtaacggacgccctgctgcttgatgccgttgttggaggtgagcggga

SEQ ID NO: 10906 - DNA, 483 bp, Zea mays
  Clone ID: cC-zmpo14820021c01a1
ttatcataaacagagttacgctatattaaagattccaaagtactttttagtgttagatctggaaggagatggtgctgttgggcgggttgtaaaactggacggtcctgccgttgagcggctgcgtggggcgcgcgtcgctcccgggcagcggcgccttgagcagctgcagctggtcctggctgatctggcgcaccttgccgaggacgctccagacgacgttctctgtgcatggcggcacggtgagggagcccgtgtagcggaagtagctgccggtgcgcttctgcagcgagcgcaggtggatgaggccggccttcacccgcgacttcttcttcttggggaagtcgcaccggtcctgggccatctcgcccagctgccgcttcagctggtagtagaaggagtccggggcgcccagctggtagaggatcccgatgaccgtcagcgcgccgttggtgcttctgtggaccaggtgcagcttcagcggga

SEQ ID NO: 10907 - DNA, 295 bp, Zea mays
  Clone ID: cC-zmpo14820021c02a1
ccaaaaaaaaaaccccaaaatgttttttttaaaaaacccccttgggggaaaaacggcaaaaaataaggtttttttttttaaaaaaggaaaccaattttttttcccaattaaaaaattttttcaaggagggggggcttttttttttttccaattgataaaaaggcctcccccaatttaaactcatgaaattattttagggggggcttttcttttccaaaatatatcccccccggggggttttttataaaattaggggggggcttggttgcccctttggggggggaaatttttcctt

SEQ ID NO: 10908 - DNA, 135 bp, Zea mays
  Clone ID: cC-zmpo14820021c03a1
gggtggggcacatctcaccccaacttgttttttctaggaataaataagccattacacaccctgggccgttacgggggcaaaaaagcttattgggagggagataccggccaatttggaaacttgccggacgcgtgg

SEQ ID NO: 10909 - DNA, 454 bp, Zea mays
  Clone ID: cC-zmpo14820021c04a1
ggaattggcacattgatttacattttttaactctggccccgtatcggagggcatgagcgaaaaaatgaatatgcctgcatgaggcatgttatcatctgcatgggtgcttgggggcatgcaggttgaaaaaaaggggggaaaggggctacttaaaagtttttggacccctggtacgtgacccccaactttcagtcaggggggaaaacgtgccatgggggggccttgggggggtcgtttttcattacccggaacgttagcgactcgcaggggagggccttcttgggttgccacacttgcccccaggtgggcttaatttccggccaattgacgcgcttggttcccttaaccgacaccgccgagatgtccccggccccgcccacgttggggatcgtcaccatgttgaagtacttgttcccggtgatggggtaccggatgcccccctgttttgggcatg

SEQ ID NO: 10910 - DNA, 466 bp, Zea mays
  Clone ID: cC-zmpo14820021c05a1
aaaattaaaaaaaaaagcggtataaaagagcagaagtagcagtacatctgcatgcatgcagatttaggcccatcaaaagaagcggatcgaacgtttgcttacgaggccaggcccattatcgctgccctcgaatgcagtgcatagacatacacaatacaaaaaacgcggaaggcagctaccatcttcaattcttgggcgagcgggcagggcagcaatggatgcaggcatgcacaggacggaggacgatcatggcgtctcggaggcgtccttgagatcgtacttctcgaggagggcgccgcactccttgagcgggtccttgcggaagaaggcgatggggttggcgtaacggacgccctgctgcttgatgccgttgttggaggtgagcgggacgcgggcgcggtcgcggaactccttgatctccgcgcaccccgggtcggggctccgggccagcaccacctcgcaaatc

SEQ ID NO: 10911 - DNA, 553 bp, Zea mays
  Clone ID: cC-zmpo14820021c07a1
gaatgaattgttgaatggattcaaacaaatggcaagcgatgaaatgatacaagtgttaatccctctctcaggggaagaacatcagcggcatgcatcaattcgttaaattaaggagaaagagggaacaaagaaaaagaggacaaaaggtgtgtcgaatcaaaaaacatgcccacgcatcggaatgcgcgcagccatgtcactctctctccccttcgtctcttcctcggcctccgggcgccccggccggctcactgaatgtagtaggcgaagaaggaggcgacggcggccccgagggcggcgccgacggcgggcgcgacggcggaggagccgctggtgggggccggagccggagcctccgcggcgagcgccacggtggccgccgaggcggcgacgaggacggcgcaggcgatcttcttcatctccatccctgaatgcggcggcggcggtggagggcgggacggaatggaacggaggcgaggaagaagggacgggcgcgcgagcaagctggctgctggctggctggctaactagctctgtgctccccgacgcgtgg

SEQ ID NO: 10912 - DNA, 66 bp, Zea mays
  Clone ID: cC-zmpo14820021d01a1
tcctctagagcggccgctcgcgatctagaaccggacgcgtgggcggacgcgtgggcggacgcgtgg

SEQ ID NO: 10913 - DNA, 404 bp, Zea mays
  Clone ID: cC-zmpo14820021d02a1
agatgggcttgtgcctgggccaagccggcccacatgttatgttaagaacggggaatgggtgacagcagcaagtgaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtagtacacgcggccctggatgacgtagtcggggaggttcgggtcgtcagccgcggcacaggagaggacgacgcataggcataggatgacggcggcggtcgtcgttgccggagccggaaccgaggccattattgccgccgggtgaatgtacctgttttcccctccccccttgtggatgtc

SEQ ID NO: 10914 - DNA, 448 bp, Zea mays
  Clone ID: cC-zmpo14820021d03a1
aagtattaagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggtggcgctggttccggcggttgctcctcgtcagccacgtccggcagaacctcctgggacgggctcttcttgttcatgtggttgtagctccccttctccatgaacagctg

SEQ ID NO: 10915 - DNA, 473 bp, Zea mays
  Clone ID: cC-zmpo14820021d04a1
tggctcaagaacacaagaacgataattttttagatcttgataccatgagtcgatacagttaactaacaacatgataacacattgaaaatcaaacagaaagaaaaagagggagagcaaggatgtatccatggatgagtggatgaccacacattatcatggttttaaagacattgctctcatttttcttccatgtcttgttccaaatttaaccgggccgacgtgtgtggcctcaattggtggagtcatcatcgtcatcctcattgcctgacaggccttcgacaccctgggggccaggtgcagcagccggcccgctaggtccatcggctggcgcgtcagccacaggggcatcggcggactttgcctcggccatcggtgctacgaccatggcgacgaagaggagagcggcaatgacaaagacgacgctagcgcgagccatgggtacggtgtctagctttctagggttggttgatagc

SEQ ID NO: 10916 - DNA, 530 bp, Zea mays
  unsure at all n locations
  Clone ID: cC-zmpo14820021d05a1
ttgtgaaactttgtttatattactatagaaaaaaaggcgagtacatgcatattatgtattttctgctgggagtaaaaggtgttgtaaacccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcgggagacgggggcggggcttggagcaggtgactcggacacggtatccttggccaccttacccttacccaccaccactgcttcgacgggcttgcgcgggatcatgttggaatcctcatgggttgccgctgatggcttgatcttgcgcttaccacccttgccgcggcggccgggcgccgngacgggggaaggcaacgtcggcgcaaaatgggctcgctgatctccatg

SEQ ID NO: 10917 - DNA, 379 bp, Zea mays
  Clone ID: cC-zmpo14820021d06a1
gtatcccgggggtcggccaaaaccaacgcttgcctactccacgttggggcgtcccaacggacgagggttggaatcaacccctcttaagcgggccaaagacccacttgaataccacggggttttgttttcctttcactatcccgtttgcaaggaatctccacgaattggagtctcttgcccttacaagtttttgatcacaaatgaaacacagagtaggggggggaagcaacacacaaatccacaggaaaagcgcacacacacggccaagaatcgagctcacaagactatttcagagttcttacttagaacagagcttgaattacttagaaacacaaacgaatgcgcagagacttagtgtggatgatcaaaaatgctcaaa

SEQ ID NO: 10918 - DNA, 450 bp, Zea mays
  Clone ID: cC-zmpo14820021d07a1
tcagttggaatggagggtatattaacatggatttcctatacactctggcgaatgttacagacggggtgttacatcacagtcacacctcgcggttttcttcccatgggacgacgctcccgcacgcacgcgggaccgtcacctatggctatatttacaaagggcatcttgcctgctgcagccggccaccaggaggaagaggacgacgggcatgctcggtcacttcatggctccgccggctcgcacagggcaagaggatcgaaagacacgaccctgtcaacccatgatatataccaagggtcgtcgtgcgtgtgctgccgagttactagttagaggagggggtcgtcagaagtctatgatgggctcgccgatggtgagggtgcgctccaccgtccacgggaggttggagagcttggccgtgatgaacttgaagatcttgttcacgttgatgtt

SEQ ID NO: 10919 - DNA, 326 bp, Zea mays
  Clone ID: cC-zmpo14820021e01a1
tagaaaaattgcaaatattgcttaagcatccataggatgcgaggagtacaaatgaacgaatagcctgaatccataaacaaatgttgggctgaacatcttcacacaagggatggatccctgcgtggtgatggcacgattcaggcaaacagaattctgctcaaaccgatacatgtacccagggggcatgcatcaacactcatttacttacagaagcgcaaagggcttgttacatcgacatctttttatcttttttggggcaagggggggtgataacctcgaacaaaaaaaaatcacacattttggctatcttataccacaccacattt

SEQ ID NO: 10920 - DNA, 450 bp, Zea mays
  Clone ID: cC-zmpo14820021e02a1
ccacccaggcaagggtttccttgtttgccaatacctggtaaacgtacggagccacatttacagacttcatatcgtataatcgtatatatttagggtaaaaaaaccagctgggcaggcgtccccccctcatgcagcaggggattcacatccccacccctgggatgttgacccaggtgaggggcaggacgagctttccggtctcggggtccctgaccttgaccaccatgtcctgggaaaccttgccgtccttccacgtgatggggctttcgggggcaaggcaattgcccttttccgggcggatcgtttttatcaccgtgccgtcggggacgtcgctcaggtcctgttttgcgatctccacaaagttgaggatgcaaaacttggcgttgcccatgctgtcgtccttggtgaacgtgtcggggtcaaaaagtccaatcttgaccgggtttatta

SEQ ID NO: 10921 - DNA, 418 bp, Zea mays
  Clone ID: cC-zmpo14820021e03a1
ctgcattaccattagattattacatggcaaacagcgcatacatgctagctatctctgagactgttttttcatcatcacatcagccccgatatccggggagtatcccccaagcaatgcatacatgtgaatccaacattgacttcgttcttcagatccatccagcaaagatgaaaaccacaggcaaacgaaaacaaaaaaagaacctttttatcccgaagattgcagaacaacaatcttggcgagtactggataatatatgcccatggcgttcggcggacagctcgtattataacctgcgcggtgcatttgtgcgtacggcgctcggggaggagagaccagtcgctgtccctgctgctggtgctgaggccgtcaccatcaccatggttaaggccttccccgagccccttccctttcttct

SEQ ID NO: 10922 - DNA, 450 bp, Zea mays
  Clone ID: cC-zmpo14820021e04a1
tttttattcattgagaacaccacatgtatttttgcaagtagcctcatcaggcatctcattaaaattgaataggtcgaacatgtgtccaaaatgacaagtgagaagcattaggtagcaacaatagacattacagtcttgatgaataggagaaagcggctgccgacagaccggcagaaaactttgttcatgctaatgaagaaacagcaacaaaaggagaaagaaacggggcgggaggctggcgataatggctcctctcggctttgcatctcttgggcccaaagaattagaagcatttcctgtgcacgatggacgggccagactcgtcgtactcagccttggcaatccacatctgctggaaggtgctgagcgatgccaggatggatcctccaatccagacactgtacttcctttctggaggagcaaccaccttgatcttcatgctgctaggag

SEQ ID NO: 10923 - DNA, 547 bp, Zea mays
  Clone ID: cC-zmpo14820021e05a1
tcctctagagcggccgcggtcaggagcagcatcgacagcgccagctccttcttgtatatccggttgtgcttctccttcttcttcttcacggtggcggcggcggcggcagcgtccttcctcgatgccgccgccaggtgctcctccttggcgacggcgtcgaggttcggcgcggagcccgtcctcgtcgcgtgaagcttcacgggctccttgggcggggccagcgcgatgaggtcgccctccgacgagcggcccgacttcttggtcaccacccactcgtacgcgctccccagctggaacagcccggagatcatcgcgttgaacttggtcacggacatggtgttctcgaagagcaggtacgggatgatgaaggggaacgacttgggggacggcaggatgttcagcagggacatcagggccgggacgtagcacaccacccagtcggggagctcggcctccggcacgaacatcgtcatcgggaggatgatgcagaacagcgtgaaggagtagaaaggcagtatgagcttccggagcaggaagaaaaggaata

SEQ ID NO: 10924 - DNA, 504 bp, Zea mays
  Clone ID: cC-zmpo14820021e06a1
taaaaaatcatacacaaaggtcacctttttttatctttgaaacacaacacaatacttaaagacatacacgatcgagattcgtaagagtacagacgttgccgaacggaaagctcacttcgaccgagtttaagtggattctgaacacaaataagccaaagcaatagcacacatgttggctgacgcacatctttctcacagggagggtggcacaatggtccgttaagcagccagcgtggccgtggccgtggcatcggccgggccttctgcctccggagccaccagctgggcgatgttctccacagcacatatcctgccgctggccagtccggccgtcaggtcctcgacttccattttcaccacatcacggcggttgccaatatcagctgcatacctgctcgcgcagtacaccccgacggccatcaccgccatcccatagatgttcgtggtaaccaagcggaatggggtcgagaccaccgcggcgagaggttcaccgatgatggagat

SEQ ID NO: 10925 - DNA, 474 bp, Zea mays
  Clone ID: cC-zmpo14820021e07a1
tttaacccctgaatttggttggtatttggagaataaattttataccctcaaattcagggtgttacaccgtcgaacataatatagctgtcggatgtctgtcgttttactgttgtgcgttaccaatggatagcatctaatgggcaatgcaaggacgagagaaaaattataactagagagatgggtcagtcgacggaggggctagaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcaggctaacggcctccggggtggaggaggtgccggtgatgttcttgaaggtgacatccttgacggtgaccttggaggcgccgttggcagtacacaacttgttggggcagtactttatgtcgatgaagat

SEQ ID NO: 10926 - DNA, 333 bp, Zea mays
  unsure at all n locations
  Clone ID: cC-zmpo14820021f01a1
caactccaaccaggctcaaattgattttttcaggtacaaaaatccatccctcgtantaggaggggaagcaatatctccctaacagggatgtccattatgtgtttcatcacaattctctcacatcatacttgctttatataccttgggttgctaaaaataatgccggcgcccggcccaaataagggggcctttgagtttgcctggaccccaacaccccccccttttccgttttcaaagagcaacccgaatcaccccgttggtttttttgggcaaccaacaacaaaggggttttttggggggggtgaaccggcgggggcggcggcaagggccctt

SEQ ID NO: 10927 - DNA, 206 bp, Zea mays
  unsure at all n locations
  Clone ID: cC-zmpo14820021f02a1
tttttgaacaagataatgaaccttgagctcattagaagataattcatacatgaacaaaataataaatattgagttattcataacatgctgaatacgtgaacaagataatgaaccttgagcatacatgaacaaaatacatgacagtcatcaaaatatacatgacantcaccaaaacatacatgacattcgtcataaataagaacgag

SEQ ID NO: 10928 - DNA, 462 bp, Zea mays
  Clone ID: cC-zmpo14820021f03a1
gtaacgagcggtgatatttacatgctgtctgcttacataaaaaaaactaccaatcaacttgagttgaccagcaggatacataaaatccattagataaaatgtacagacaacaacatatactcctgtataaatggatcaaccacgaactcgccaaaaaaatcggcataggtggtttgtgatcattctgcttaagtaactagtaactagtgccagcttctgtgacgaacaattacaacaagttgaaggagcgttgcagcttttgggtcaagaacaggcatggaactacacaagaacctgcgacttggccgcacgacgtgagcatttggtgcgagcattcttattcaagctgcaagcacaaccttccagcagctcgaagtcttcatcgcatactagtatggatgccatcttcggacagtccaataacatcttagagctaagatatccagcaatgctccaagtttg

SEQ ID NO: 10929 - DNA, 378 bp, Zea mays
  Clone ID: cC-zmpo14820021f04a1
gatgtatatatatatatttatatcaaaaaaacgtccatgcatagtgatgttggatggcgacaatgtacgtgggtgttctaaaatacacagaagacagggacattttgacttttgagcatgcatgcattgcatagtattattgtcacgcgagcgaatccgtacgtttttttctgggggatatggggcgagcacctacatactggagtttgtctcctccagttcagtcttaaggggggggggcaacccatttgagctgcagggggatgaccccggaatctactttcccgagcctgaggaggaggtcctgcacgacgtggcccttgtcccaaatgatgtggctcttgggggggaggcatattcccgtgcccccggggcgga

SEQ ID NO: 10930 - DNA, 338 bp, Zea mays
  Clone ID: cC-zmpo14820021f05a1
ggacccgcggcccaaaaaatcgggggggattgttccacaccccaacttctttgggaggggggtccaaaaaaattccctaaaagaggccggcccccttaaaagattgtttcctcggcgcccccctccgaaacccaaaaaaaatcccaatcccgggtaggggctccaaaccccgtaggccccccttaaggtggcatgcccccctgtacaaaaactggggccacccaagggcccccccccccccccttggtagaaaaaggggggggggggggggggtaaccaataccggggcccggaccttttgggccaaaacccaaaagttaaaaccaccccccctttcc

SEQ ID NO: 10931 - DNA, 267 bp, Zea mays
  Clone ID: cC-zmpo14820021f06a1
gggggggctttttttttttgttccctggagaaagggctcctttctctcttgtcataatcatggacttaggtgttttctgagtgtaataaccacactctgagctgtccaaatgggggccgggggaaaaatgggcaccaatttcttccgggggacgggggttaaataaaagaagggttttttttttcatggaaaagggcccccggattttttattcctgtaaagcctaccggattagggaaccggcccccgctctttttgaggccaaaa

SEQ ID NO: 10932 - DNA, 532 bp, Zea mays
  Clone ID: cC-zmpo14820021f07a1
gaaccactgaatatggattgaatgaatctggtcaatataaacagggattagactaaatgccaggcctatccgaacagcactactcgtttacacatcagagcagcttgtggaacgggcattctgcttcccagattcattcaatcgttcataatcataatgtgctgaatggcctatccaagctgtggagggggcatgcgaaccgtttttgtcatccagccacacgggcccgtcgatctgaactaatgaagccactgcatggctgcatgttgatatgtacaggtgctcggtgctttggtgatcacgacgcgcctacagccatttctgatggtttttcttgtgcctcgtccttgcccaacaatgctggtgtgactgaaacaacaccgatcaggaatagcagcgctatcgactgggtgtcgtaaaggtcgcttagcgaagttaattctccaagagcgattccagccctgacagtcacataagaagctgggataggccaatgagagtcccagtaagatatgtggtaggggacatctac

SEQ ID NO: 10933 - DNA, 492 bp, Zea mays
  Clone ID: cC-zmpo14820021g01a1
ggtggtgtaaataaatggtgagataaagttatatatgtaactcccattacaatgatttttttgagaaccccagtacagtgatttgagagggcatgcatctcaagattacatatatccattcatttgttccccttcactacgcttctttcgtatttgttcttttgagtttggattggatggtcagaccacgaggagaaaacgaggccttcgtcgtcttagcgcgcgggggcgtaggacggcgggctagcacctcgtggtccttggtgtaccagtctccgatgagcaccacgtggtcgttctccggcgggggctggtcgaacgggaccgggatgaggagggggctgaccacgctgatggccccgtagccgcccgccgcccgctgcatgccgatggacgggaagtagaagaagctgccgatctggtccttgggctgccacttgtacgtgaagttggtgttaggcaagatcggacactgcgtgcctggcatcccgt

SEQ ID NO: 10934 - DNA, 412 bp, Zea mays
  Clone ID: cC-zmpo14820021g02a1
gatctgaagaagagcacgtcttatataattaaccatgcacacgtttggtttcttaacgaacaagacagatcgatcggattgatggatcgtgcagtgagtcgttctcctcgtcatcgatcaaaggtcacgatggccggcggcggcgggcgctggcagctggccgctgttggctatgacgaccttggccttgggcacgccggtgagctggccctcggcttcgatcttgcgcacgacgtccatccctttcaccaccttgccgaacaccacgtggcgcccgtccagcttcttgggcaaccggttttcgtctacggtggtgatgaagaactgggagccattggagtcgggcccgtagttagccatggacagcgtaccggctttagcgtgggtgtgcttgaagttctcggacgcgtgg

SEQ ID NO: 10935 - DNA, 494 bp, Zea mays
  Clone ID: cC-zmpo14820021g03a1
ggtgttgaacatatggagcatcaaagaatctcataatgtaataatggcaaccagttaactcaactgaactcttttagctgtttggttcagaaacatctcaaggcccaaattacataaaacaatttaactgtgagaatcttaagcagagctcaaaaactgccgagctcaggggcatacatcttacatacggaaataccaacccaaccctaaatatccagcaccatcatcatcatcatcatccaaaagctcctagatgatccaaacctcgcttgacaatttaggacttggttgcaatgttgctggacagccagtccaggccttcatacaatccctcacccgttgtagcacaagtgctttgaatgtaccaatgacgttggcgaagtgaatgcagtccaagcttatcagtgatctcagcggcattcatagcatttggaagatcttgcttgttagcaaaaacaagcaacacagcatcacgtaactcatcctcattcagc

SEQ ID NO: 10936 - DNA, 441 bp, Zea mays
  Clone ID: cC-zmpo14820021g04a1
acttttagaaacactgtttctatatattctcatgaagctgtacgaaaatatccaccatgccactgttatacaacatacaacttctgaaaaatcaattgtactatataaattgggacttgaggcccgacagatctgatgctaaatttacccggttcttgttctccaaacggtaatgtcagggcctgatcatctactactctctatcatgggttagtttttgactttttgtcgacactggatttctcagacgacttgagcaagaacctcccgatgcggcaatcccaatgtgacggatgagctccacccggtgcggcaagcccagcctcgatcttgtctcgtctcgtctcgtgaggtctggccatggtcatccaatccaggaggagggaaacgactaagacgagcagagggaggcgaaatcaagccataactggacaggcgagt

SEQ ID NO: 10937 - DNA, 67 bp, Zea mays
  Clone ID: cC-zmpo14820021g05a1
aaaagaaaaccctgggctttcattagctcgtttttttttttttataagcaaaacgggcgcgtgggtt

SEQ ID NO: 10938 - DNA, 535 bp, Zea mays
  Clone ID: cC-zmpo14820021g06a1
ttgttggtgtaaataaatggtgagataaagttatatatataactcccattacaatgatttttttgagaaccccagtacagtgatttgagagggcatgcatctcaagattacatatatccattcatttgttccccttcactacgcttctttcgtatttgttcttttgagtttggattggatggtcagaccacgaggagaaaacgaggccttcgtcgtcttagcgcgcgggctagcacctcgtggtccttggtgtaccagtctccgatgagcaccacgtggtcgttctccggcgggggctggtcgaacgggaccgggatgaggaggcggctgaccacgctgatggccccgtagccgcccgccgcccgctgcatgccgatggacgggaagtagaagaagctgccgatctggtccttgggctgccacttgtacgtgaagttggtgttaggcaggatcggacactgcgtgcctggcatcccgtccatccacgagttcttcctgtgctgcatcccgttccaggtgaaaaggagcggatggt

SEQ ID NO: 10939 - DNA, 380 bp, Zea mays
  Clone ID: cC-zmpo14820021h01a1
ttctttcaataagccccaggatgttgtattatcagaaccgcatggagggaaaacgggagacatcacatgtttgttttgattacaaggtgaccctttctctctcccgacttaaacatgtatgccaataaccgttctatctttttcttccacatttttcattaagcattattcaattgacatgcagtcaattaccttaacgatggcttctctttcttcatctatatcttctgcttgggggctttcttcaattctgactggggctcggctgccaccttgttggtggcaatatttttctctgcatggactgctgatggctttttccttctagaagacggtctggggggcaacttccttatcctctttgttctaaggctcgacat

SEQ ID NO: 10940 - DNA, 402 bp, Zea mays
  unsure at all n locations
  Clone ID: cC-zmpo14820021h02a1
tgtgtaaatccttttagggtttatttgttactctaggattcacctcattctatatatatgaagttgattgaggtagaaatttatacttcagtccacctcaatacatgtaaattgagatgaatactanagtacataaacaagatttggacaggacctacttgagaatgtgtaaaaccaccttcctctctctccgcttctcactttggcgacggcggcggtgcgtcagtgacagaaagagaattaaggaaaaagacgacgtcttgtccaatgcacgtggattaaggttaaaacgaatatttcttagggattgaggagatgttgtgatggattgaaaaagggggaaaaagatgattgagataggatatgctggagcggctcttttcacctaattcggacgcgtgg

SEQ ID NO: 10941 - DNA, 486 bp, Zea mays
  Clone ID: cC-zmpo14820021h03a1
aacgcaaagaattacacatggtgtagtattgatgatcctttaattgcactaggaaacataatgtggatcatagtaaagatggcctttttttattgcaggcggtcgtgatcacaatcccaatcagagacgggtgaatgaaacatgttaaaacaataatgtcaaaaaataaagcaaaaaaggacggaaattcaagccatctttgggctcaaaccctcaacacttggccatgcatgcagcattcttgggtgggtcgtcgatcagtggccgccggtcacggtgtccttgacacccgccgccgcgccggtcaccgtgttcgtgacgcccgccaccgcgccggtcaccgtgttcgtgacgcccgccgtcacgcccgccaccgtgttggtgacgccaaccgccgcgcccgccaccgtgttcttgacgcctgccgccacgccctggcccgtctgcgccacctgctcaacggtgccggtggcgcggtgctgctgc

SEQ ID NO: 10942 - DNA, 313 bp, Zea mays
  Clone ID: cC-zmpo14820021h04a1
agcttttcctactactcagctagaacatcgtgagagccagccctagcgcatgatgaatacccataaacatggtaaggtcaaccgtgtccaccacatgcacgtcagaacaacaggtttatgaaagacgcacgaacgatcaagaacaacaatgaaagaggatacagttccttccctcctcccacccattgcatgaaaatatttcggaaataggaaaaaacgccagctctccatgaatccggtctgcgccctcacactcatctggaaccgatcaatcaaccaagcgttggagaatgctcatcgttttcctatgagg

SEQ ID NO: 10943 - DNA, 297 bp, Zea mays
  Clone ID: cC-zmpo14820021h05a1
cttcccccccccaaaaaaaggtttcgggggcccggggtagtctttgccccaacaataacctccccctcccccccttagaattccacccaaaccaacacctttcaaatacaccctcccccattttctccacaaaaacaaaaaaatttccccccaaaaaccccggcccccctaaaaccactcatgaatttcgttaacaaaaaataccaaaagggttttctcccccaaaaaaggctctcccccccccaaataaatttgcccttccccgggttctgcccctccccccggcccaaaaatttt

SEQ ID NO: 10944 - DNA, 435 bp, Zea mays
  Clone ID: cC-zmpo14820021h06a1
tcgtcaaaatggtaccggagattattattagaaggaggtgttacagagtacatacaaagtgctcttcaatttatccaagtatacaggtgtaagttgaacaacaaatgcaacaggaagacaggttacatgtattatatgacgctagagggagttccatgtgacaaaaaatcgaatcaccagtcaatcaatggctttggaaggcaggcaaataacgcaaataagctatctacaacctacactcagcgatgtgcagctcggcggaaacgaacccttccgacgaggcctgtcggaagcggctctttagctagagcagcaggagcctttcgtgacgggggacgactcagcgacgttaatggtggtcccttgcatcgagcgcccgttggtggacgcggactcttgcgcggcgagcgcctttttgctcaccgtttgatggat

SEQ ID NO: 10945 - DNA, 533 bp, Zea mays
  Clone ID: cC-zmpo14820022a01d1
ccacgcgtccgcctgactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctcttccggcatttgatatgccaatttcctgtaggctggcttttggctatgcctatcctgcctatgaatgctacaagaccgttgaactgaacaaaccacagattgagcagctcatattttggtgtcagtattggattttagttgccctgttgacagttttggagagatttggagattttacaatatcatggctaccgttttactcagaagcaaaggtgttgttctttgcatatttgtggtaccctaagacaaagggaactacgtatgtttatggaactttctttaagccatatatttctcagcatgagaatgaaatcgaccgaaatcttcttgagctcagagctcgagccaccgatatggttgtcctttac

SEQ ID NO: 10946 - DNA, 459 bp, Zea mays
  Clone ID: cC-zmpo14820022a02a1
tatccttcaaacgtcattttttcttcatatatttctgcaacatgttacatgtacagtctggtagaaggcactgctcccccacagtccctctctacacgtttcattggggaggacaacagcagcagcagcaaagggctcaaagcccaaccacgtacagctatacataaagaatgggtgtcgaacccggtttgagtctctagctaagacctcacacgcggacatacccctcttctttccctgcaaaatgtggaaaaattgcaggatcttccgttgggactatcttgaggtgaggtggttgtcgtccatgtaactggactcctaacagccagcagcccttaggaaattgtcgtacgggctcgccgccggtagcttcagagactgctgttggaagtcctggcctggctgtgcgtttgtcccgttgggcccgttcatgtactgtgggtatccctgaacgctctc

SEQ ID NO: 10947 - DNA, 251 bp, Zea mays
  Clone ID: cC-zmpo14820022a02d1
ccacgcgtccgtctagctgagttggttaggtggtctgagtagcactcctcaggtcttgggttcggctcccagtggaagaagcacaggtgtaaggctcagtcccggtcgtggtcattctcacatgagcttcgatgccgccgtgtatgggtggggcaggggttcaggggattttctcgacctgtgtgagaatgtcttcttcttaatacaatgctcgggggctgtcttaccctcgcaggttgagttttctttaa

SEQ ID NO: 10948 - DNA, 532 bp, Zea mays
  Clone ID: cC-zmpo14820022a03a1
ttgatcatagaacccagatgtctctgttacaaaatatattatatacacatcccgttagtcccgggacgacatgcaaaatgcactagccaactcgcacgaacacgcaagtacattaatgacaggaaacttgggcagaaattatctgcttctgcactagacagccataaatccttgggtaacccatggaaataatcgatcggcggcggccacagccactcctagatagatgtaattatggttgtggtggttcatgctgtggtgtggccggggagtccggtgcgatggtgaaatgcactccccttccttggcctgactgcaggatgaatgccacctccgctgcagctagagcagctgcctcctgtctctgtctgcggcgctgcaagatactgattgcccaagccatgatgtagaacggaagcaggaaaccagcagcacgcaacagaaaaagtgaaaacatcgctgaagtgtcgtcgtcatcttcatcagttagagtcagtgcgtgtctcaacaataagagagccatttaaacaag

SEQ ID NO: 10949 - DNA, 532 bp, Zea mays
  Clone ID: cC-zmpo14820022a03d1
ccacgcgtccggtccgcttcatagacggaactaccggtgagaaatcaggcgacgacaaagagaccaccaacgaccaacactcctagctgtctcgtgtagggatccatcgtgctgtgtgttcttctggctgttgtacctgatgctcagagtagacgctggctgctgctccgcaaggaaactgactcccccgaccgccgttcatgctcctggctggctggctcgctggccgcctcgacgggaacgctgccgtagaatgacgactggggctggtgttgttgttacagtatggtccttttttctttcttctttcccctttcatccattaagctctgtgatgtagctgcccgtgctgttgattcatgaaatcatgctagagattttttcctggcagtaagtgcgtgcctgtaaaactgtcgaactatttggacgaaaattgtacactgcagtatgtaaccatcaaaatctcccccccaaaaaaaaaaattttctccttattcttttataaataaactattaatcaattttggtattc

SEQ ID NO: 10950 - DNA, 211 bp, Zea mays
  Clone ID: cC-zmpo14820022a04a1
aaaagcagcttaatactgataatatttctcaattggagctacacagggacagctacacaatcctgcaacagcgagcagtccgatagaaccttggccttacctaagatcaaaagattaatcccaccccccctcacatttttattccgtttgactggttggggaatggatcaccacattctatcaaatacaaggttttttttcggacgcgtgg

SEQ ID NO: 10951 - DNA, 647 bp, Zea mays
  Clone ID: cC-zmpo14820022a04d1
ccacgcgtccgcggacgcgtgggcggacgcgtgggcggacgcgtgggttcaagcaccttctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaagccaggaaggagaagcaggcgcagcatagctgaccgactgtccgtgcatgcccgtgccaactaatataattattggctgatgatacctgatgatcagtgtgtgatccaacaaggagacgacacttgaattctctacagttggcatagccgcataggtccgcagagacac

SEQ ID NO: 10952 - DNA, 479 bp, Zea mays
  Clone ID: cC-zmpo14820022a05a1
aacgaaggacatcattgaagccatgattaaggccacaaaaatttacaagcaaccaatcacagggttggttggacgtgacccatgaatacattatatcaaagtttactcaacttcgatagatatatgcgcattaggaaggaggttaaaatacccctgtggccgtgattttcttcccgtagtcaaggttttttttccttgatttcttcgtgtactagtagaacaaaaattaacaagcgatttacagcatatggccgaagatccagcatgctctctcaaccaataggactgacatatccgtgtgtcaaaacaccaatgtatcacccagtagataggatcaacatgtttatctgtccccggccatggtgaagttggtcccaacaaaacgaagtttcaactgagttgcttacttcttggctcctgtttttccatttggagttttctttccttcagttccgccggacgcgtgggtcgacccggga

SEQ ID NO: 10953 - DNA, 551 bp, Zea mays
  Clone ID: cC-zmpo14820022a05d1
acaaatttaatatatttaaactccatgaataatcgattcgatcaaatgattacaccaaattaaacatgcctcctccgcccaagcatatacccgtacgcacctaattaatccgtatgccgaccctactacctacatcaacctccggtctcaccgcggcggggcgtcggcggcaccggcaccggcggcgaggactgcctcgagcgtggtgacgaccctggccatggagggccggaccttggggttctggctgaggcagtcgtacgcgaggcgggccacgcgctgcaggcccatctccgagcagacctcgcccatccgccggtccaggatccgctccaactttttgggccggataaggatgggccgcgcccagtccaccaggctgccgtcgcggccccccgcccggctcggctccagcgcgcgccgtcccaccagcatcttcagcagcaccacgccgaagccgtacacgtcgctcatcaccgtcaggtgcccggtggctacgtacttcggcgcggcgtagccgtaagtgcccatgaccctggtggacacgtgcg

SEQ ID NO: 10954 - DNA, 263 bp, Zea mays
  Clone ID: cC-zmpo14820022a06a1
gttgaaaccgggcccccaataaaaataaaaattatggaatgggatgaacaatataccctcatagaagggaaaagttcaaagatgggggggggatgggcaaaaaaaaaatacagcgcggggttttgtgattacccaaagaaaaaagaaaattcatccccgggcaaatttattttggggggcacttgatacatccaaagaaaaggaggggttgcaaaaagggaatttttattaaacatatgccaatggagtcaatgggtgtaaat

SEQ ID NO: 10955 - DNA, 305 bp, Zea mays
  Clone ID: cC-zmpo14820022a06d1
gataatcacaactcaccatccctttcaatatgcttagaatatagctttttataatttttcaccctacaatacaaaattgttctatgaaggccatggtacatcatcatatcctatattatcaaccaaggatttgtctatttcgattaataatggcattgagtcaaattttggttgtttcaaatgatagacttcgacatttgttatgatttatgagttgattcttgatagcattactaaaaaatgacctgcatctgaaccaattgactaacatgcatatattatatactaggtatacggacgcgtgg

SEQ ID NO: 10956 - DNA, 453 bp, Zea mays
  Clone ID: cC-zmpo14820022a07a1
tgacaataacctgttgcttaaaatagtttttttctatattacagaaaaaaatacattcttacgcccaacaactggcatagccatgcacatatgctccgatataccgatccttacagaaaaaagaactgaagaatggtcacaagtaaaatgaacctggaatgaaatagtacatatataataattcacttaggaaataaatagaaatatttgagaattgtatcgtacggaagagatcgagcatagtccacggatgatgaatctcttatggactacggttagcagtgggcggggggtctgaaataaatgatgtaataataacgatgcatgcaatgtgaattgagtatatagtgcggatgcgttgttgcttggtcgttgatggacgatgacggacagttggtccggctcctgacgatgtcgaggctcatctcgctggggtcggcggcccggacgcgt

SEQ ID NO: 10957 - DNA, 212 bp, Zea mays
  Clone ID: cC-zmpo14820022a07d1
gtactctgatgaatgtctgactaatgatagatggtgcaatgctgcatagggcacaaatccaagaacacctcgtatacaacaacctaataacgaatcagccaaaaaaaaattaaccagaagaccttattagtcaatcttgaggtcgttgcacgatcaaagattgggcgactctctctttgattcttaactctttcttgttagcggacgcgtgg

SEQ ID NO: 10958 - DNA, 227 bp, Zea mays
  Clone ID: cC-zmpo14820022a08a1
aaaaaaaccaaacccccctttttttaaaaatttaactgaaaaaaaaaattaatacaacgggggggggcacagggggggggtttaataaatttaaacaccgttggggcgcccccctgggtcaccccggaaattcgggacgggacccggggggggaaccagttttccttatgggggggggaattaggggggggggaaaaagggggaaaaggggttccgggggggaaaag

SEQ ID NO: 10959 - DNA, 444 bp, Zea mays
  Clone ID: cC-zmpo14820022a08d1
gccggaacccattattttccgcggatttctggaggaaatcgatttattccccggacaaacttcggggatggccggagcctgaaacgtgacaaaacatttttggcctccccttcctggtttcccttccgggttgggcacaatacaatcttatttaccccggagctggactggactggactggactggactggaccagaaactggtcgctggcttttgactgggctcccttggttttcacccaaagggaaacccaacaagaacccgagcttccttccaaggcccaacccctgtatgtacaggcgatcgtagggtttcgttccgtcccgtcccgttccgggcggtcagtttcgcaacgcgacggggggcttgtgcaccaacgacccggtggcctgcgcgaaaccgtgcgccttccggttcgggggcttccgggacgaaccggggccg

SEQ ID NO: 10960 - DNA, 300 bp, Zea mays
  Clone ID: cC-zmpo14820022a09a1
ggacaatagcaagaatccagccctcaaaatttggtacacccaccccattccatttttgtttccctttcctttcgcaggtgcagatttggaaaccaggggaaaaggatttggggtttaatgccacccaatttgcaaaaactgggggcggtcctcaaccacctgctattacatattgaacggcgccgtcgatgggctattactggacggcggcgtcgcccgagtccaactgtttgagcagcgaggcgcaaaagggccacggcccttccttgaggtaacccaacgggttggcggggcccaagt

SEQ ID NO: 10961 - DNA, 399 bp, Zea mays
  Clone ID: cC-zmpo14820022a09d1
ggaaaaaaaattcccggccaagggcttaattaataagggggaccccatccgcagttgccccacatggaacgtgtggtctaaaaaaaaaaaccccgggggggaaaaaaagggggaacctccagggttaatttttccccggggggggcccgacaaaggggtcttttcgcacctttggcaaatgggaaaaaattcaaggggcgccctcttgtttgatcaccagttccccccctgacaattggggtatctcctccaatttttataagggggccctctccccgatccgaccataagatgtttgggcccccaatttcctgttccgggcacttacggcgcctttttgttcccccccccgtcttgggggctccggggggggggcaacctttcccgtcggatgggctg

SEQ ID NO: 10962 - DNA, 452 bp, Zea mays
  Clone ID: cC-zmpo14820022b01d1
cggacttccctggtcgacccacgcgtccgggagctcgcctgcatctgaaccaattgactaacatgcatatattatatatataatcactcttcgtaacctctctctttctcacgtactctcaagtctccaccgaatatataatccgctggttcgtattttctttcttctttggatcatcacaaaaccaaccgatgtaattattattagaccgacgcctcacaatcttggaacttattcattatgctagtgtatatctgtaatcccattccataatgttaatgttgatttgtggtcaaaaaaaaaaaaaaaaaaaacaaaaaaaaaaaaaaaaaacaaaaacaaaaataacaatgctgatacatgaaactaagaaactaaaaaataaaatacaaaaattaaaatcaaataattaaaaataaaataacaaaaaaaaaaggggggcgttcttcaaa

SEQ ID NO: 10963 - DNA, 242 bp, Zea mays
  Clone ID: cC-zmpo14820022b02a1
atggggccgggtgattttttctatgaaaaatggggcctaaccctgaaatgcacaaacttttcccgaaaggaatcccacttaaaacatggggaacccaagagaaaacctgggcgcacaggggaaatggtatcccccttgctgaaacagaaaaccgaacaggggtaaacaaaaaatacaaacccgggggagaaaaagaaaagactggacccccaaaaaaggggataaactaaaaggacccttat

SEQ ID NO: 10964 - DNA, 185 bp, Zea mays
  Clone ID: cC-zmpo14820022b02d1
gtcgacccacgcgtccgatctatgcatgcatggtaacgggttgtgttatttaattattattattacgtagacattactatttaaaattcatgtgttcgcgtcaagtcgttctgtaatcttgtgatggaatatatatgatatttccttttaaaaaaaaaaaaagcaagggccgccgatctaaagga

SEQ ID NO: 10965 - DNA, 477 bp, Zea mays
  Clone ID: cC-zmpo14820022b03a1
gaaacaaatgatgcgacagtttcatcatgaagatttgcaggttcagttacccgatggaactagtgttcctcggtagagatgagcaaaaggttaaagcaaggccaaacaccatggctgaaataattaatgccttccatcgtgtctcggcgctcccatcatcctggatcacttgagctgctgcacgatccgttctcctttcgagtcagcacagcagcacagcgagcttcgattcagcagccacagaaggcccacttcttccgtttgggcggcgtgtactggttgccgtcgccgaagtcgggcctgtacccgccgtcgccgccgccgtttctgaaggccggcggaatgcctgcgcgcgcgtttccagccccagggccggtggtggtcttcttgtcgtcgcgggccttctggaatatgacggggaagccctcggacgtggccggattcttcacgttccactcccccggacgcgtgggtcga

SEQ ID NO: 10966 - DNA, 576 bp, Zea mays
  Clone ID: cC-zmpo14820022b03d1
tccctggtcgacccacgcgtccgcccactcgttgagcccgccccccgccaccggccggatcgacagcatccatctgaccgtctgcgcgcggcggctctcacaccgaacacacgcagggcgcgcataggcgaggcgagggcccccgcgagggatggtgtggtcggctgggatggcaatgcgaggcgcctccgccgcgctgctcgtgctggcgctcgtcgccaccgtggcgcgcgcggaggacccctaccacttcttcgagtggaaggtgacgtacgggacgaagaccatcatggggacgccgcagaaggtgatcctcatcaacgacatgttccccggccctaccatcaactgcacatccaacaacaacatcgtcatcaatgtcttcaacgtgctcgaccagccgctcctcttcacctggcaccatgtgcccgatccagcccaacaccaacttcacgtaccactggcagcccaaggaccagatcggcagcttcttctattaccccagcaccggcatgcatcgggcggcgggcgcctacgggctcatcagcgttcacaggcgtgacctgatcccggtcc

SEQ ID NO: 10967 - DNA, 589 bp, Zea mays
  Clone ID: cC-zmpo14820022b04a1
ccccctcctttttttttttttccctccccccccccccccccccccctttcttttcccttctcgggggggccccccccccccgggccccttttttttccccccccccttcccacccccccccccccttttgcccccccccccccccccccccctgccccggaaacccccccccccccgggggggtttccccccccccccaaccccccccccttttttccccgcccccccccccccctacccctttgggggccaagccccctgttcccccccctcctccccccccccccgttcccgcgcccccccccccccctaagggccccccccccccccccggttaaaaatgggcccccccccccccccccccaatatccccccccccccccccccttcccccccgggatcagggccgttacccccccccccccccccccccactcaattccccccctgtggggggggtgggttttaatgggcccctttcccccgccctcccccccagggtgccccccccccccccccctcaaaaacccccccccccccccgggcccccccgtaacccccccccccccccgccgcccccccctccctt

SEQ ID NO: 10968 - DNA, 515 bp, Zea mays
  Clone ID: cC-zmpo14820022b04d1
ttccttggtcgacccacgcgtccggccggaggaagccgtgctcaagcagatccaagagtcgccgatccctttgaacatcatcctggcgatcgggcacgcggcgttcgtgcgtggggagcagacgggcttcgagatcgacccggccaagggggtggacgccagcgaactgtacccggatgtcaagtacaccaccgtcgacgagtacctcaaccgcttcctctgagcctgaggtctcaacaaacaggacgtcacgtacggccttggcgcgcggggccatgatgtgtggagtgtggacgtcttcatcgtcagctgctagtcgctagcgacgacgtgccaacctaaacatcactagcagcataccgtagtgtacgctacggtagaaatggaaagacaatatgttttctaaataataagatagattaaggttcatggcaaaagagatttatgatgagttatatcatattgttgagctcataaaaaatatgcttaaaaaagagtaacactatcatagctac

SEQ ID NO: 10969 - DNA, 360 bp, Zea mays
  unsure at all n locations
  Clone ID: cC-zmpo14820022b05a1
gggggggaaaaaaacaaaaaacccccccttaaaattttgcccccccccccccgacccattttggtttcctttccttttcccaaaacaaatttgaaaaccccgggaaaagggtttggggttttaacccccccaattttgaaaaactgggggctgcccccccccaccccttattacaaaatgggcgggggggggggggggcttttacttaatgggngttcccccccaacccaactttttaaacaccggggggcaaaagggccacctccccttcttttgggacccccccgggttgggggggcccaaatttttttttatccccccctttctggggaacaaaaacaccggggggtccctttcccc

SEQ ID NO: 10970 - DNA, 516 bp, Zea mays
  unsure at all n locations
  Clone ID: cC-zmpo14820022b05d1
atgttaatattgtgttgtatcgtgtacttaaaaaacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcatcaggtcacctggttgttgcagcagcaggagcaggaccaggagggaagttcacccactgcagctgcagctgtatctccccgctctcgacgttcctgagccggaggatcatgtcctgcgcgaacttgccgctcctacagcacacgtggctatctgcggcgaggcagttcctggcgctcggccgctcggacctgatgatggctccggtccttagactgtgcttccgcgggttcatgctcaccgtcttcatcagtggcgccacgtncacctccgcgtctcccatgggngtcgctctgctg

SEQ ID NO: 10971 - DNA, 497 bp, Zea mays
  unsure at all n locations
  Clone ID: cC-zmpo14820022b06a1
ttcttattagntctcttggtatgtgtacattaatgaaaacattagatcgtacacttttacagctttacaatatgtgcagaagaactttcttgaagctgaattctgtcgcaaggtgtgttgatttcaagttttcaacctgtattgaaattattatgtatgcaaggcatgctatccgcaccgccttctgtctgtacaaaattcttgagtacaaagaacgtgatatacacactaccggttgcgctcatcctgtactcaacccactagcctggcaccatcagtctccgtgtatctcaggacatgtcagacgattaccacctgtgtccgataaatcttcactcaaagttgtgtgtagaaaatggtcgtgtatgttgaaatggtaacgatagccccattggggacgtgtgttccatggcacgtttaaggtttctttgcttgtacctttntcaggtattttttgtgaagtttcaatgcttcagcgcaagcttttttaacatcta

SEQ ID NO: 10972 - DNA, 390 bp, Zea mays
  Clone ID: cC-zmpo14820022b06d1
aagggaaatttggatcataccattaaaagatcatcactttggatccataccattactatctcacttacatgtgggtccacatgagtcaatgacatgtggggcccatggtatatatctaaagtttggatcttttaatggtataaatccaattgttccaaaaataaaatccaatcgaggggaaaaataatccttttcccgttcttctgaaactgtcctctttttcccgtcgcttcgccgtcccgcaccagggaggaaaggaggcttcaccgcaaagctcgccatgatctcgccggtaaccactatgcccgttcccccgcattatcttttatgccgcgcttttgacaaatggttcggtcggttgtaaattggtgctgaatctgtatacggggc

SEQ ID NO: 10973 - DNA, 548 bp, Zea mays
  unsure at all n locations
  Clone ID: cC-zmpo14820022b07a1
gaccaaaaaaaatttatattattcattcataagacatcaataaccaatgacaatccgaagtagcctcatcaggcgtctcattagaattgaatggaccttaacatattgtgtccaaaaatcacaagtgagaagcataggtagcgacagttattgcggtcttgatgaataggggaggaaagcggcggccgatagaccggcacaaaactttgttcgcgctaatgaagaaacggcaacgaaaacgggggcaggagaggctggcggcggtaacggctcccccacggcttgcatttctcgggcccaaagaattagaagcatttcctgtggacgatggatgggccggactcgtcgtactcggccttggcgatccacatctgctggaaggtgctgagggatgccaggatggatcctccgatccagacactgtactttctctctggaggagcgaccaccttgatcttcatgctgctgggagccaaggcagngatctccttgctcatcctgtcagcgatgccagggaacatggtggtgccaccggagaggacgatgcc

SEQ ID NO: 10974 - DNA, 349 bp, Zea mays
  Clone ID: cC-zmpo14820022b07d1
cccatggttaattcatgaccgataccaagcacggggtaccaacctcggaaaatcgggaccggaaccagagggcgccccaatctatgccaaaagaggacacacgcgaaaaacgggaaaacccggaaaaaagcagaatccgggggaaaaggggacaccacgggaaaacccaggggagccaaaagagggagccaaaaaagaaaaaacccggggggcaaaaaggccgacacaaaccaaaaaaaacggagaggccaaacagggacaaataacaggccaaaaaccggggagagccggatcaacaaatagacccccaacagccggggaaaaggataaagcaaaaggggaaccaggg

SEQ ID NO: 10975 - DNA, 412 bp, Zea mays
  Clone ID: cC-zmpo14820022b08a1
gctcaagccttgttcacatatatattcaagggcaaaagggagatcgatacaacaccatcccggtttttacaactggcaggccggccagcgcgcacgcggttagtgcccgtgcttgtgcgcgtgctccgggtggttgaccacaacaaaaatgttgaaaacgttgtcaacgaggcggtaaacgttccgttgcatgggcaaaaagggggacctaatcgccgggaagtcggcgaaggcgttgtcccaatcgctggcgctcgggacggcggccgacagctttgtgttcatgtcgtcggcctgggcctgggtgccccccgccgcccgcgtggcgacaatcttccgcgcctccttgagcgtttgcacaacgttgccctaccccttgctgcaggcccccaggatggactccatcggccgg

SEQ ID NO: 10976 - DNA, 550 bp, Zea mays
  Clone ID: cC-zmpo14820022b08d1
agctctagttcatacattcacactagattggacagtataaatacatcagctgcaccaccctgatacactgcagccaagccttgctcaacccggccagaggacggattgcttacatcttactacaaggcatcggcccagatgcctgtgatcaaactggaacttttcaacaaattctaagggcctgtttggaaggcaggaaaaaatgtctgttcatgagcacagtggggaagccgcagtacactgggcatcagtaggatccttccgtagtgttgttctcttttcttttaatccagaacattgagcatcgtggaaggtctctagacaaagtagtcttgtcgcaccacagtgatgaaattgccagagagtaaatcatgctctttcagctttcctcctgtttcaccgttaccttggatatgccaatatattggggaaagaggagcatacagatctgaagtaagggttggatcatgttctcttgtagaatgcagtacaacagtaccagtaagcacagtaagaaacccacatatctcagaggcaatactggttatac

SEQ ID NO: 10977 - DNA, 282 bp, Zea mays
  Clone ID: cC-zmpo14820022b09a1
ttttagagaatcatgtagcggagctatatgccaaacgagccactctctgtacaatcaaagcatgcatttgaaacggatctcggtacacgtacgtacacgtcagcatgatctctccgtacaatcaaagcaacacaagtggccttaatttggcagtctttcaattcaccatgatctgaagaagagcacgtcttatataattaaccatgcacacgtttggtttcttaacgaacaagacagatcgatcggattgatggatcgtgcagtgagtcgtcggacgcgtgg

SEQ ID NO: 10978 - DNA, 416 bp, Zea mays
  Clone ID: cC-zmpo14820022b09d1
gaaacgtgaccacaaatcaacattaacattatggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgcacttgatgtcgacgttgacgagctgcacgccctggcatggcaggttgttggcgcatttgagcgcggactcatgg

SEQ ID NO: 10979 - DNA, 343 bp, Zea mays
  Clone ID: cC-zmpo14820022c01a1
tgagaggaattatataagaaccagttcattacttcattttataggaaaaatacagaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagca

SEQ ID NO: 10980 - DNA, 583 bp, Zea mays
  Clone ID: cC-zmpo14820022c01d1
tcccgggtcgacccacgcgtccggaacccgtgccctgtacctcctcgtcgcggctgtcgcggcgctcttagccacgcctgcggccgtggacgcggccacgctggcggagatctgcaggggaaccgcgttccccgacatctgcaccagcacggtggggagcgaagcgcagagcgccggggtgttggacgccatggcggtgttgcggatgcaggtggacgcgttcaacaagcgcaccgaggcggcgagggcgcacgtcaaggaggccgccgtgacggcgtcccccaaggcgcggacggtgctggacctgtgcaacaacctgtacctggacgtggaggacaacctgtgagcctggcgccgcgccatcggcttcaaggacgccgtcaccatccgcgccaccatgggcatggcggcgcaggacatgcagaactgcgacgagcagttcaggcagatcggcgagaagaaccccatggagcagttcgaccgcgtcgcttgtcgagatgtccgagaactgccgttcgctttcaacatgatctgatcgatctccttttcacggaccgacacagagagccgggcgttttgggcc

SEQ ID NO: 10981 - DNA, 480 bp, Zea mays
  Clone ID: cC-zmpo14820022c02a1
aaacaaccatatcattgattgcaaatcataagttgataatattttacaaataatcttttgtttggtgtattcgaagtgagctgatgaatatgaaccatgaactttttaaggacctcgatcacaaaatcgtggcaaggcaggcgaagaccagtagcaaacaaactttcgaagactaggacttcgtcatctggcatgagaacagtctccgatccaaacgactccatttcattcaccctccgccacaaaaagtcttcaactggccgcccaccggattggaggccccttcgctcatggacccctcgtcgacagtcgcccctatagaatcaaagacccctttgcagtgaccctaagtatggttagtataagacaaaaattatggccttcgctctgtgatcgaggctgtgttcagtctccgcccaacagtaccccttgaggaattggttcattctgatgggcattcctgaagttacttggttttta

SEQ ID NO: 10982 - DNA, 524 bp, Zea mays
  Clone ID: cC-zmpo14820022c02d1
acggacttcccgggtcgacccacgcgtccgaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaatttaggggttaaaaaaaaaaaacataac

SEQ ID NO: 10983 - DNA, 75 bp, Zea mays
  Clone ID: cC-zmpo14820022c03a1
tttttgataataatagctctattatatctggccatgggagggcactatacaggagtatttataggcactcaacta

SEQ ID NO: 10984 - DNA, 617 bp, Zea mays
  Clone ID: cC-zmpo14820022c03d1
ccacgcgtccggctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagccaccgcgggagcacttcgacctcagcatgcccgcgttccttcagatcgcgcaagaagaggccggcatcgtgcccatctcctaccgcagggtggcgtgcgcgaagcagggcgggatccggtacaccatcaccggggacaagtacttcaacatggtgacgatcaccaatgtgggcggcgccggc

SEQ ID NO: 10985 - DNA, 375 bp, Zea mays
  Clone ID: cC-zmpo14820022c04a1
cagcaagatcactcgcaccatctgttttcacacacgacaaacacccaactcatatacaaatgcacttacatgcacgctgttcaggaagaaatggcagcgataaacgcaaaagcagctcagctcgagaagctcattaagcatacagtgacaagagtactcattaagcatcagctatattataaatatgaagggagcaaaaccatagacacaaatggatagaatttagctgccgatatcaagtgctgacaaatgtcatgccgtgatcaggagaataaaatccaaatgcaagaattacacccccagaaaccagggatgcaaaatggattcggagttagcattcgacatcacttctgtatttctttggttttgatttac

SEQ ID NO: 10986 - DNA, 547 bp, Zea mays
  Clone ID: cC-zmpo14820022c04d1
caggcgatagttcaatttttgacattggggagatcatagaacccagatgtctctgttacaaaatatattatatacacatcccgttagtcccgggacgacatgcaaaatgcactagccaactcgcacgaacacgcaagtacattaatgacaggaaacttgggcagaaattatctgcttctgcactagacagccataaatccttgggtaacccatggaaataatcgatcggcggcggccacagccactcctagatagatgtaattatggttgtggtggttcatgctgtggtgtggccggggagtccggtgcgatggtgaaatgcactccccttccttggcctgactgcaggatgaatgccaccttcgctgcagctagagcagctgcctcctgtctctgtctgcggcgctgcaagatactgattgcccaagccatgatgtagaacggaagcaggaaaccagcagcacgcaacagaaaaagtgaaaacatcgctgaagtgtcgtcgtcatcttcatcagttagagtcagtgcgtgtctcaacaataagaga

SEQ ID NO: 10987 - DNA, 496 bp, Zea mays
  Clone ID: cC-zmpo14820022c05a1
tcctctagagcggccgcgctcatggcgggcctcgcgcccaaaaccaaggtgctcagggacggcaagtggaaggaagaggaggcgtccatcctcgtgcccggcgacatcatcagcatcaagctgggtgacatcattcccgccgacgccaggctgctggagggcgacccgcttaaggtcgaccaggcggcgctcacgggcgagtcgctgcccgtgaacaagcacccgggccagggggtcttctcgggctccacggtcaagcagggcgagatcgaggccgtcgtcatcgccaccggcgtgcacaccttcttcggcaaggcggcgcacctggtggacagcaccaacaacgtgggccacttccagctcgtgctcacggccatcggcaacttctgcatcatctccattgccgtcgggatggtcatcgagatcatcgtcatgtacccgattcagcaccgcgcgtaccgcgatggcatcgacaacctcctcgtcctgctcatcg

SEQ ID NO: 10988 - DNA, 547 bp, Zea mays
  Clone ID: cC-zmpo14820022c05d1
taaaaaatcatacacaaaggtcacctttttttatctttgaaacacaacacaatacttaaagacatacacgatcgagattcgtaagagtacagacgttgccgaacggaaagctcacttcgaccgagtttaagtggattctgaacacaaataagccaaagcaatagcacacatgttggctgacgcacatctctctcacagcaacaatggcacaatggtccgttaagcagccagcgtggccgtggccgtggcatcggccgggccttctgcctccggagccaccagctgggcgatgttctccacagcacatatcctgccgctggccagtccggccgtcaggtcctcgacttccattttcaccacatcacggcggttgccaatatcagctgcatacctgctcgcgcagtacaccccgacggccatcaccgccatcccatagatgttcgtggtaaccaagcggaatggggtcgagaccaccgcggcgagaggtccaccgatgatggagatagcctgcccgctctgcccgacaacgccctgctcagcgacaaga

SEQ ID NO: 10989 - DNA, 526 bp, Zea mays
  Clone ID: cC-zmpo14820022c06a1
tttggcatgaaatttagatcatgtatatattttgaatggaattatagatccacactagtagaatgaataagaaagttcgcagattgccagaggcctaaaaaaagactggcgagagtgagaaagagagaggtgacgaagagtgagtgatggatgcaagtaggttcagacgcaggcgagctccttcgccatgccaatggacttgccgatggcgttcttgcagacggacatggtcttgttgtcggacctgttgtacttgatgtcgacgttgatgagctgcacgccctggcagggcaggttgttggcgcagttgagcgtgatggcctccggcgtgttggaggtgccgtggatgttcttgaagacgacgtcgttgacggccaccttggaggcgccggacttgacgcagatgttgttggggcagtacttctggtctatgatgatggggtaggagacgttgtccatggtgacgtcctggtacaggaacttgggggccttgagcgacgacttggagtcctcgtacgacttgatg

SEQ ID NO: 10990 - DNA, 250 bp, Zea mays
  Clone ID: cC-zmpo14820022c06d1
caaacaaatggaaaaccaaatcatatatttcatcgcatgattacagaacgacttgacacaaatagataaattaaatcacgtctatgtaattaacacaacccgtcaccatgcatatatattcatatcagatcacatcaataataatatatggaaacagcggtgcaggtgacgtcttccaagtcgaccaccgcagcaacagtcaccaagaacgagcgaggcaactgcaatggcaacggtggacggatccatc

SEQ ID NO: 10991 - DNA, 241 bp, Zea mays
  Clone ID: cC-zmpo14820022c07a1
gaggaatgtttctagttgaattgattgatgaatggctatatatatagtaataaagaagcacaaattagcatgttatagaatcatatatataggctgccctacacgcgtgcctctcaacgagccgtttcatcccacggtctcaagacatgtgccacgccgcaagaggcaacaccgaaaagaaggacacgcgctaggtccgcatgaagtcggcatgcgtccagtctatcgaccggacgcgtgg

SEQ ID NO: 10992 - DNA, 446 bp, Zea mays
  Clone ID: cC-zmpo14820022c07d1
gaaccaaaaaaatgctatataccttttccacaattgttctttggaggatttctatttcaacatggctatgatatacacattgaacgggtctgacctaggggtgaaagccacctttccatatttacgggaaaaaatgcttttgcctcggtttatccaccccacttgggggggagcctttagcactagggctatttttttacgatatacacattgggtttgggtcctagttacatgcatcgggaatacatgggctttactgaagagaaactttatcaaaaatgcctattgctttctcttactcaaattttaggtccaaagccggggagacctttgcctttaacttcctgacatcgttaggtaaatgaactttaccggcgtagtttcataatgactcgggctcttgattcaaagctgttttggaattctctaaggaataaaacccattt

SEQ ID NO: 10993 - DNA, 409 bp, Zea mays
  Clone ID: cC-zmpo14820022c08a1
gaaaacaggggcatcaaacaaaagaataatttaggctcagcatgatgcaacatttcatgactcacataagttttgacaaaataaataattaacccctcgcctaattcacttacttttaatcaaaaggaaaagagagagagagagacaaggggtaccccctgaatttggttggtttttaaagaaaaaattttatcccctcaaattcagggggttacaccgccaaacataatatagctgccggatgtctgtcgttttactgttgggcgttaccaatggatagcatgtaatgggcaatgcaaggacgagagaaaaattttacctagagagatgggtcagccgacggagggtctagaagcatgcaagctccttgaggcaacctttggtgctgcccttggcgttcgcgccggac

SEQ ID NO: 10994 - DNA, 539 bp, Zea mays
  Clone ID: cC-zmpo14820022c08d1
agacaggaacagttcaatcacacacatatatatattgttctgggtttacaaaccatacgacaaccaaactttaatttgggggtggaattacaaaattatttgccaaaatgcatggtaccaacaaggaacaaaaatctctggtgatcggcgacgggcaggggagaaatggcagacgaaggatgagagatgattaacagagccacgcacaatccaagggcgtgtaggggactaaaatgcgtgcgtagctagaggaggctaccaattaaataatgctgatgttggtatcgttgctgctggatgctcgaaccatggacaagcgaacgagctaggttaaatgaatccattcacaggccttgctctacgaggtagtcgcctagcctttcgaccaccatgttgcactggccgggggtcatgggctcgtcgtagatgccgaccaccatcgcttgccctgtcttcttcacagttatgcctccagatcccttctttccgcggatgacagcgccgggctcgccttggatgaccatgtacttggtggggcc

SEQ ID NO: 10995 - DNA, 491 bp, Zea mays
  Clone ID: cC-zmpo14820022c09a1
atatacgcgatgattgattaaatcgaattgttgaatggattcaaacaaatggcaagcgatgatacaagtgttaatccctctctcagggggaagaacatcagcggcatgcatcaattcgttaaattaaggagaaagagggaacaaagaaaaagaggacaaaaggtgtgtcgaatcaaaaacatgcccacgcatcggaatgcgcgcagccatgtcactctctctcccgcttcgtctcttcctcggcctccgggcgaccggccgcggccggctcactgaatgtagtaggcgaagaaggaggcgacggcggccccgagggcggcgccgacggcgggcgcgacggcggaagagccgctggtggggcccggagccggagcctccgcggcgagcgccacggtggccgccgaggcggcgacgaggacggcgcaggcgatcttcttcatctccatccctgaatgcggcggcggcggcgggcgggacggaacggaacggac

SEQ ID NO: 10996 - DNA, 579 bp, Zea mays
  Clone ID: cC-zmpo14820022c09d1
tcctctagagcggccgcgacgccgctgagcaggcggaggcctgccaggaacccgagcagggacagcacgagctgctggcacagggaggcgaggaacagtctcatgtcacaggcgcatggcctggacaggaggagcaggaagacgacagcgaaggcggcgagcaggggggcaagcatcagcacgcgctggcgggaggagcgcgctgccactgcctctgccggagcgcccgctgctccgtccgtatatggataaacaacagcaggcgatgccgggagcagtggagctgctgttgctacgaccaagaccgcatcaagagctcgcctttattgcgctttctttctccgcccgatcggaggagccgtgcgggtgacgcgatggaatggaacccactttgcgacagggaggagaaaggaaaagtgcagcgagagaaggttaaacacacacacacgcacacaataaaattaggtcggattcgatcgaatcgaagcccggtgatcgggggaaccaaggacacttgttgccgagcggattgattcgagctgagccggtaattggacctaaaattgtgcttgaatctgc

SEQ ID NO: 10997 - DNA, 391 bp, Zea mays
  Clone ID: cC-zmpo14820022d01a1
taagaaaatatttctatattataaaacatccaaatatgcttgcttacatatatatatacacatagagaaagagagagtaatataagtaatccatcgacaatgcttaataatccaaaaaggatgggatcggggtacgcacacgtacgcgtgtaaaagaagaataaatgatggcagaaaatataaatgggtgatgagaattgcaattgcaataattgggcggttaatctccaccttgagtagaagcctcctgttcttctgctttggttacacgccccgcggtagctggtgcttcctcctcctgcagctgcaggttggagcggagaccatacgcgcgtgcatccacgttggcgtggaagcgcgcagcactggagatgaggtcattgatctgcgc

SEQ ID NO: 10998 - DNA, 524 bp, Zea mays
  Clone ID: cC-zmpo14820022d01d1
ccacgcgtccgcgcccctccctcccaccgctcgtccgcccctcgcccgcaccaccggcgccggcaccggcgccggagcgcgacccggaggagcgtccgcacccgcgccgcgccagatctggccccgcccgcagctcccatgcccctccctccccagacccgcctgacctagccacgaccggccggccggacccgccccaccccccgccatggatgacgtgtccaagtatgcgcacagcccggcgcacctcgccgtcctgcggcgcgaccacgcggcgctgcgtcgactggtggcggccctcccgcgcctgccgcgcgccggggaggtggccaccgaggaggagtccgtcgcgggggaggccgtggcggacgcggtctcggccgttatcgaccgccgcgacgtgccgcggagggagaccccgctccacctcgccgtgcgcctccgggaccccgtcgtctgcgacattctcatgtcggccggcgccgactggtcgctgcagaacgccgactgctggtccgcgctcc

SEQ ID NO: 10999 - DNA, 395 bp, Zea mays
  Clone ID: cC-zmpo14820022d02a1
ttttcttttcaacgtcttttgtcaaattaacacaaatcaatggacgacatatatgacagatcaccgtggtcaaacaaattttgtcgagaatttaaatacgggtatatatatagagagaagctacgcacaacgacagcaatggcaggagtttttttcttttctttttggggtgtgtatgtgtaattgtgtatatatatactggcgtagcgccaccgcctcctccaccgtccaacggcacgtacggccgcgacgacgacgtcaatgtatggtgtgcgatcggtggagccaggctgcgtgacctggcaggcaggcagaccagaccagaccagaccgaccggctcggcgacgacggcgcgccccggcagcagctagcgctgggctcagcggacgcgtgg

SEQ ID NO: 11000 - DNA, 482 bp, Zea mays
  Clone ID: cC-zmpo14820022d02d1
tcgacccacgcgtccggtcagtatcgcttcctctagagcggacgcccttatttatctctcccttttacctttctcacactctacatattcaactgttgctctgggcaaatactcaaggatcctttgctcattaccagacgtctattagtctatccaacaatcctcctcttagataaactcatactatttactggctggatctgtattaccacaagtcccagacaatctggatatccattccattcttcaacagagcgctgataacagagaagaatactagtgtgccgtgccaaacgacccaaacactgcacccaacaggaaactgaaggcacatatataccacactcactactgctcgatttagcacaatccaaccgtaaaaaaataaaacggttccactactaccgcgcgcattttcacaagcttatcatcattttaacaaggttcaaggtccctcttaaacactcaaacagtcgtatgaa

SEQ ID NO: 11001 - DNA, 421 bp, Zea mays
  Clone ID: cC-zmpo14820022d03a1
tttttttttttttttttttttttttttttttttttttttttttttttttttttttttttttttttttttttttttttttttttttttttttttttttttttggggggggcaaaaattaaaaagttaaaaaaaaacccctttcccccccccccaagggggcctaaaaaccccataccaccccaaaaaatcaccccccaaaaggggaaccccaaaaaatttttaaggggaaaatttcccccaaacccccattttggaaaaaaaaaaaaaaaccccccccccttttttttaaaaaaaaaaaaggttaaaaaaggaaaattgccaaaccccccaaatttggggaaaaacaacctttcttttccctaagggggaaattaaaaaggggcccccaaaaaaaatggggccccaaaaaaaagggtataac

SEQ ID NO: 11002 - DNA, 645 bp, Zea mays
  Clone ID: cC-zmpo14820022d03d1
ccacgcgtccgctcgagaagttgcagctccccacaatggaaggtctggctaaaaaactaaactctgggagcaagatcgagtctgctattgttgcatgtcatccatcagaagcacctactatgactgccagctggtttaactccaagtcaggaaagaagattcctttgaaatcagtcacttcaatcgtcgatgggctaaagaaatcgtacattgagaagttgaggcccttggaaaaaacctatcagttccatgacttcgtgtctcccttgctgactagcagcgatttcgatgcgaagccaatggtcatgctgttgggtcaatactccacggggaaaacaacatttataaagcatttactaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgaccttcgtggacactccaggagttttatcaggggagaagcagctgacgcagcgcagctacgatttcaccggagtca

SEQ ID NO: 11003 - DNA, 231 bp, Zea mays
  Clone ID: cC-zmpo14820022d04a1
aaaagtgaaatatcatatatattccatcacaagattacagaacgacttgacgcgaacacatgaattttaaatagtaatgtctacgttataataataattaaataacacaacccgttaccatgcatgcatagatattcatagcagaccagttttactatttgggaacagcgttggaggtgactttttccatgcttcctttaaggttaaagattatgtttgtgaatgtctttt

SEQ ID NO: 11004 - DNA, 540 bp, Zea mays
  Clone ID: cC-zmpo14820022d04d1
gtagaagtttgtatcttcgttaaaaattatagcagtacaaatcatagcacattctgtaggtgtaggatacagtaacacagcagcagaacatcaaacccatctcctgccaggctctgagcaaacgccaaagcctccaacgtggcacctacgtaccgtaccccactcctggtacccagtcacccaccccacaccctacctcgctcgcagtcgcagcttccgctgtacgcacactactgcgcggtgcacgcaccgacgacacggcggcctcgtgcacgaggggctgggtggcgtgcgcgacgccctcggcctcccgctccacctgctcccggcacgcctcccgcgcgcccggctccgtcatgcgcttgacgaacgcggcgaagcggcgccagttgtcgggctggaacaggtcgggccccatgcgcaggtacgtgaaggccaccatgcggtcctcggcggccctgtcggcggcagtggccaccacctggtcgtgcgccgtgtcgtcgtagcgcggcagcgcgttctcgcccgccaggcccacgc

SEQ ID NO: 11005 - DNA, 179 bp, Zea mays
  Clone ID: cC-zmpo14820022d05a1
ctgggagacagactatgcatttccaaggatgtagcaaatttgtaggaaagtaaatgatatgtatatttaggggtccatatatcgaaacatgccctcatgaaaaaaatgcctccaaaaatggcatgtatatttaaccttttgcttgttttccactctttggaattcgatcggacgcgtgg

SEQ ID NO: 11006 - DNA, 487 bp, Zea mays
  Clone ID: cC-zmpo14820022d05d1
tttttcaatcacacacatatatatattgttctgggtttacaaaccatacgacaaccaaactttaatttgggagtggaatcacaaaattatttgccaaaatgcatggtaccaacaaggaacaaaaatctcaggggagaaatggcagacgaaggatgagagatgattaacagagccacgcacaatccaagggcgtgtaggagactaaaaatgcgtgcgtagctagaggaggctaccaattaaataatgcgggtgttggtatcgttgctgcgaaccatggacaagcgagcgaggttaaatgaatccattcacaggccttgctctacgaggtagtcgccgagcctctcgaccaccatgttgcactggccgggggtcatgggctcgtcgtagatgccgaccaccatcgcttgccctgtcttcttcacagttatgcctccagatcccttcttcccgcggatgacagcgccgggctcgccttggatgaccatgt

SEQ ID NO: 11007 - DNA, 498 bp, Zea mays
  unsure at all n locations
  Clone ID: cC-zmpo14820022d06a1
gtagaagtttgtatcttcgttaaaaattatagcagtacaaatcatagcacattctgtaggtgtaggatacagtaacacagcagcagaacatcaaacccatctggtgccaggctctgagcaaacgccaaagcctccaacgtggcacctacgtaccgtaccccactcctggtacccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcgtcgcagcgtgccaccccgtctagcgatcgaacacagtcgacggggaacgccggccggtccggtcagttggtgagcgcgacggcggcctcttgcacgaggggctgggtggcgtgcgcgacgccctctgccttccgctacaactgctcccggnacgccttccgcgcgcccggttacgttatgcgcttg

SEQ ID NO: 11008 - DNA, 539 bp, Zea mays
  Clone ID: cC-zmpo14820022d06d1
ttatcccatccgatatatttttcatctgtcgtaacaactaccactatacagagaccattgctctagggttgctttatcgtaagctcggctctcagatgcagcatcccatccacgaagaagaggctgtcatcggccaagaacttctgccatgggattgcaaagagattcctgtacccaaccgcctttccaccggtgaatgtgtagttacccttgtacttgctcacaaactcgccggatggtctcgtccttgcagcgaactcgtagtccactgtcacactcgtggagcccttctcttgcatccccaggaagagcccgaagcagtagaacgcgctttgctgctccatgttacagtgagctgagaggaagaaaccctgccctgcaaggtggaaggcttgcgagtatatccgccctgcaggaaagagtcgagagcactcgtcgcgcttgagatccaagtatgctatgcactgtgggtagggccgatcaaactcaacaactttgagtggtctgtacttgtaagcccgctcggcgaattttccgca

SEQ ID NO: 11009 - DNA, 523 bp, Zea mays
  Clone ID: cC-zmpo14820022d07a1
agggttgaatgggatgcccttagctgattaattggaggtagaccatatcaacatatttctcctaaaatcttaaataaataatttatttagtttatgtaataatatcaacccaacacaacaaggcatcagaagggacatgtagcatcacatatttcttgggtggtttggtgccacaaaataaccatagaaaaaatattgtcttgctaacatgagcaccaggtgagctcttttgaaatataattcatcatcagaggctgattagatgctgagtgtggtcttataggtggtgccggccttgaaatcagcggggatgacgtcgtcagcgatgcggtagccaccggacttgacagcaaagcggatgcaaagggggtacttgagcggggccttggtgtcaagcgtccaggtgccggtcgggccctccttgagcgtaaaggagaagtcatcgcccccgtgctctttgatctccacgtcggatatggttgcaacattgggggtgaggatcaggtggccaggcttggatccc

SEQ ID NO: 11010 - DNA, 502 bp, Zea mays
  Clone ID: cC-zmpo14820022d07d1
agctcaacttcatgctgcattgctgctaaaaatcagcatcggtcaataactccttgaatgatgttacatcctgcctacgtggtgtaccttttacgaaaggaagattgaagagagcagacagacagctctgcaaatcctccctttgccatgtttcccgttaattagctccccctctacggtcatctatgcttcatgtcgtcgtctgccctgaccatttcggccctaggaggactgctatcattgcctgccccgctatgcgtgctcttgtgttcagcttccgtgcctccgggagggtagtattgcggttcggcgaggaaggagagcgccgcgacgacgtcgctgatccctggccggctggcagcgtactgctgcaggcacatggacgcgactgcgagcgcctggtacagcgccttcactgggtacctgttgcccagctacgggtcggccaggttcacgaacctactattggctctcagcagaggcgacgcccagttaagtagga

SEQ ID NO: 11011 - DNA, 364 bp, Zea mays
  Clone ID: cC-zmpo14820022d08a1
aatccatcgagatcggtgtgttgtcgaactttgtgggcaggcacgcacagtgtgcatacgcaatgcaatgcatgcatggataggcagatgatataggagcattaactagttcatgggatgtcaagtttgttatccttgtaagggtccctaggcccctgcttagcagcgatctccttgcacctcttcatgcagtcctccatgctcatgtggagtgggcccgtgacctcgtcacacccggccttgcagtccatggcggtcgccggaggggcggcctccagcacgagcgtgatgagaagcatcgccgcgacgatgaggaccgtcttattcgacgccatcgtcggcggacgcgtgggcggacgcgtgg

SEQ ID NO: 11012 - DNA, 335 bp, Zea mays
  Clone ID: cC-zmpo14820022d08d1
tcctctagagcggccgctctttggttcaagcaccttctaagggagccttctagataacaacttaatacgtcgcatcacggcacataacgccatggtaatctaagagtagaacaatgaaagaatcaaactgaatgataaaggcaatgaaaggcgctctacctcgtttcatgacatactattgaataaatagtgcaggtcaggaacaaatacatagagctactcaatatatataactcataatttcaatgaattcttaattaaatgaaaaatgaatgcaagcattccctgcatgcgatggcacctcacgctggggttgcatgcgtgcggacgcgtgg

SEQ ID NO: 11013 - DNA, 385 bp, Zea mays
  Clone ID: cC-zmpo14820022d09a1
ggggcctggaaagaacgagtttgtttggttccgtttggttggcacgggatgcaagcacacccgttgattctcactgaacaagtttgcccaccggtgattacagcccacttaaaccccaacggcttacctacgggaggtgaacgtgcatgccgccacgttacgcaagctacacagccatgcaccacaagccaggctggcgcgcggggggggcgtgctattttgctcgggtggccgccgccgccgtaaacccccgccgccggcggtacttctttcgggttgacgacgggttcgtcacgttgggcgggaagcgcacctttttgtttttttttgtgcggcgccggccctgggccgcggcttccgtgcctttgccgagtattatgaccct

SEQ ID NO: 11014 - DNA, 540 bp, Zea mays
  Clone ID: cC-zmpo14820022d09d1
caacgtcttttgtcaaattaacacaaatcaatggacgacatatatgacagatcaccgtggtcaaacaaattttgtcgagaatttaaatacgggtatatatatagagagaagctacgcacaacgacagcaatggcagtagtttttttcttttctttttggggtgtgtatgtgtaattgtgtatatatatactgtcgtagcgccaccgcctcctccaccgtccaacggcacgtacggccgcgacgacgacgtcaatgtatggtgtgcgatcggtggagccaggctgcgtgacctggcaggcaggcagaccagaccagaccagaccgaccggctcggcgacgacggcgcgccccggcagcagctagcgctgggctcagttcatgttgcgggcgcagcgcgtgatggcggagcagccgcggcggtaggggttggcggccttctgcgcctcgcagttgctgtagtaggaccggccgcgcttgttgcacgggacctggtccgcgcgcagcgccgcgtagctgatgtaccggttggtcggcttccgc

SEQ ID NO: 11015 - DNA, 177 bp, Zea mays
  unsure at all n locations
  Clone ID: cC-zmpo14820022e01a1
tttttgaccaaaaaaaatttatattattcattcataggacatcgataaccaatgacaatccgaagttgtcttttntggctttttacttgtgatttttggacacaatatgttatggtccatttttttgtattgtgactcctgggggggctactttggtttgtttttgtttttttattt

SEQ ID NO: 11016 - DNA, 112 bp, Zea mays
  Clone ID: cC-zmpo14820022e01d1
ccacgcgtccgcccacgcgtccgtgttaatagaatttgtattggattttgtgcaaaaaaaaaaaataaaaaaaaaaaaaaaaaaaaaaaaaagggcgggcgatctagaagga

SEQ ID NO: 11017 - DNA, 499 bp, Zea mays
  Clone ID: cC-zmpo14820022e02a1
atataagaaccagttcattacttcattttataggaaaaatacagaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaagcgtcatcggctcgtcgtagatgccaaccacgagtgcctgccctgtcttctttacggtgatgcctcctgatcccttcttgccacggatgacggcaccaggcttgccttggatgaccatgtacttg

SEQ ID NO: 11018 - DNA, 524 bp, Zea mays
  unsure at all n locations
  Clone ID: cC-zmpo14820022e02d1
ccacgcgtccgaaagccacaacacatacaggaaagcaagcaagaatcatcggaataatggcccgtgcatgcgtgttcctcgtcgtgctcctcctggccgccatcgcggtggcaccgttcgcgggcgccgcacgcgtggacgctgtggagggtaggtccatggcatccgccgatgcaccggaggcggcggccgatgctcccgctcctagccccgactccgcctcatcctcagactcgtcatcggaggcgccctctagcagcagttccttcgactagacgcagaaacctattcattctctggaataactaacagtatatacgttgcaccctgatgatatagaaacatgtacgtgcatcagtgtatggaatgcgagtggcaaacacatggaatgtgcttgcctaattattgcctatttctttatttattatatgtctctctcgctggctctttatttttcttaatgcaagtaatataatttgttatacccaatatatatagacaatgtgtgctatgcgctntaattc

SEQ ID NO: 11019 - DNA, 453 bp, Zea mays
  Clone ID: cC-zmpo14820022e03a1
cgccagcgaataatggaacctttataaatcattgccaccgttgttcattacatgcatgtgacaaaaaatggaactccaaaaaacatacaataatggatttcttcaataaacttatccatctatggaacatttttaaaaaaaaaatcgaagaaatagctattgtgtagagctgcaaaaaaagaggccgccggggtgttcaagcagcttcttgctcagtagcactagccgcgttcaaatcgactgagagatcaagctcctttcccgtgatcttgttgtacaaggcgagcacatccttgaccgtcgtctcaaaatgggtgggggagtcatagctatttgtgaggaaacagcagtcgtcgtcagggttgttgacgggttcatatctgtcgtagatgtcaaaaaaggtcttctctacagggccaagcaggtcgatccccggcttgagcttgatctcag

SEQ ID NO: 11020 - DNA, 661 bp, Zea mays
  unsure at all n locations
  Clone ID: cC-zmpo14820022e03d1
tcccgggtcgacccacgcgtccggtttgaggagatgacgaagctcgtggagatagccagccactgcgcgtcggcgtatgaaaagcggtcggaatacggtgagcgcgaagctgcgaggagcgacctgaacatggcgacgcttcttgatcctaccaggacttatccttacagatacagagcagctgtactgatggacgagggcaaggaggaggaggcgatcgcggagctgtcaggagccatagctttcaagccggacctccagctgctccacctccgcgcggcgttcttcgactccatgggcgagcgcgagagcgccctgcgggactgcgaggccgcgctctgcctggacccgacccacggcgacacattggagctgtacagcaaagccttcaccaccaaggccgaaccccagagctaggcagccagccagccggccggccggcaggccgccgctctcctcgtcgtcgattcagctgcggtttttgcgaggcaggatgatgagacgatctcttctctactctcatggggtggaagctgcagatcagtgaggcaggagcaccggaacatgcacatatctcttctagagtatatacaagagccttagttctgttactgttagaagtggacatggngaggcagcaccgcaggagattgagtgcgtg

SEQ ID NO: 11021 - DNA, 227 bp, Zea mays
  Clone ID: cC-zmpo14820022e04a1
agattcctcataataatgaattatattatatatttcatatttatatactaataattcattatataatgcaattaaataatatcagggtgtggctcgcgagccgagccgagccaagcctggttcctcagcccgtgaaatgatcgagccgagccgagccgaactcggtcagccaccgagctgcaccgagccgagccgagcttgacttgattcgtttccacccctccccc

SEQ ID NO: 11022 - DNA, 486 bp, Zea mays
  unsure at all n locations
  Clone ID: cC-zmpo14820022e04d1
aggcatatgtatacatttcttttatatatacacatcgggcacggtacaacatttattaattcaattatctttgtcaacttaaaatcctgatataaggataaccgcctaatcatgctgacaacattcagagaaccgcggcacaccaaacccaacagtccaacatccgtttggttccacatcaaaacacggagtcaagatacgagtagttgtacaggcggccaaactgaagcaggctgccatacatcctatcccacacgccaacgaaaagcgcgtcagtgtctgggctgaacgatgtgccggatatctcgccaaagaagtccagctcctgccttttgctgtagtcactcttcacgtcgtagacgtgcacaaagtcagcaggttcagccatggacatgaactggccatccgaggtgaagcggatggaccggatggctccaaggttacccctcaacacatggacggatnttgagaagatcctcgcgtccc

SEQ ID NO: 11023 - DNA, 166 bp, Zea mays
  Clone ID: cC-zmpo14820022e05a1
ggagggggggaaaaaaaaaaattttttcccccaaaaccaggggggtcccacccgggggttcccccgggaaattcgggccgggccccgggggggacccagtttttccttgggggggggggtttaaaggttggggtaaataggggaataggtttttcctggggaaaat

SEQ ID NO: 11024 - DNA, 82 bp, Zea mays
  Clone ID: cC-zmpo14820022e05d1
gaacttgcaagttgcacctttcggagattgcacatgacatgatgcgtacactttttggctttcacacacggaccccccaaaa

SEQ ID NO: 11025 - DNA, 434 bp, Zea mays
  Clone ID: cC-zmpo14820022e06a1
gggctgcgacaaatctgttttcatggggcttaccgcatatggacatagccccagaaggaacatgtatgggaagcaatcactcccccatcatacatttgtagctacagatcaatacttacaacacccatttgtgcgacccaagattgtcgcaagaaagaactcgaaaggggaaaacagaaacaaaccatgcacaggaggcctcctttgtcttcgatctccccgctttggtctcctccattgggaccccacttatatctcctctattgggcacacttcatagttaaattagtttaggtcacggtccgtgtgatttgcttccaatagaggatgctagtaaccattctgatcttctgccagatagtttgctgccaaagtcaccatcttgaacatttgacaaaaaatagaatgaagatggaacccgtgttttcttgggc

SEQ ID NO: 11026 - DNA, 505 bp, Zea mays
  Clone ID: cC-zmpo14820022e06d1
tcctctagagcggccgcgtcgtcgctgtccttcttggtgtcgttgacagtctcgaaggcgccgacgagcgcctggaccttgctccgacgcttctacagcagcttcgtgcgcgcctactcgatcacgttgttgctccgagccacctctcggagacgcggctgctccgactacgctcgcgcctgcaacgccgtgctgacacggctgccctggaacctccgcattgactactgcttctcgtgcttcttcgacttctgcttcttgatcgcctacttgacaaccggcacgaacttgtgcgccaccacgtcttccactgctgctactgcaacgatggcctccggcgccggcgccggcgacagagccgcttcttgcttgggcgattccaccacggagactgagtggtgcgccgtgtcggagctgcacggtgacggcagcgcgggtagctcgctggcgctccgcggcagggacgacgacggcgccatgaccggctccagcttgatcttggtgt

SEQ ID NO: 11027 - DNA, 66 bp, Zea mays
  Clone ID: cC-zmpo14820022e07a1
gctatcacgttttatgcacgcatgcactcgctcgtatccttgataactgtcaccctttttctcttt

SEQ ID NO: 11028 - DNA, 560 bp, Zea mays
  Clone ID: cC-zmpo14820022e07d1
tgaatgaattgttgaatggattcaaacaaatggcaagcgatgaaatgatacaagtgttaatccctctctcaggggaagaacatcagcggcatgcatcaattcgttaaattaaggagaaagagggaacaaagaaaaagaggacaaaaggtgtgtcgaatcaaaaaacatgcccacgcatcggaatgcgcgcagccatgtcactctctctccccttcgtctcttcctcggcctccgggcgccccggccggctcactgaatgtagtaggcgaagaaggaggcgacggcggccccgagggcggcgccgacggcgggcgcgacggcggaggagccgctggtgggggccggagccggagcctccgcggcgagcgccacggtggccgccgaggcggcgacgaggacggcgcaggcgatcttcttcatctccatccctgaatgcggcggcggcggtggaaggcgggacggaatggaacggatgccaggaagaaggacgggcgctgcgagcaagctggctgctggctggctggctagctagctctgtgctcccggacgcgtgggtcgac

SEQ ID NO: 11029 - DNA, 532 bp, Zea mays
  unsure at all n locations
  Clone ID: cC-zmpo14820022e08a1
ctatagaacgaagctatgaancgtcgcaatggcacgacgtacgtataagcttggataccatctagaaggcggcacgcaccttttttatttatttttatttattttattttgtttttatttattttttattttgggtgtttttggttattttttttattttctattttcttttgttttatttattatattttttcttatttttttattattatttataattaaatttaaaacaaaaaaaaagaccccccgttttaggggcccaaaaaatccccggaaaggggccaaaataaaaaaataaaccaacacccggggggggggggggggacacccgaaaaatcgggacgggccccggggggggaaccaatttttctaaaaggggggaaaaaaaaagcggggggaaaaaaaggaaaaaaggttttccggggaaaaaaatgtttttcccccaaaattccaaaaaaaaaaagccccgaaaaaaaaaagggaaaagcggggggggcgcaagggggagccacacacacaaaaaagggggggg

SEQ ID NO: 11030 - DNA, 516 bp, Zea mays
  unsure at all n locations
  Clone ID: cC-zmpo14820022e08d1
gagattgttcgttctttttttttttaccccgccgctcggttcgagccagctggtaaaatcaagcaaaccgtgtaggtgcatacgcgccatgcatgcctaatgtatgtatgtctacacatacatgaaaacaagtctgatcgatcgatcatgaaggtacatgtacgttcatgctagtagccagaagtttttgtgggtcttggtgttgagcaggtatccggcattctggcccttcttctggacgcttacgcacaggcacttgctatgctcgatcaagaactccgccgtgctgtcgtgcccgcggctcgacgacccgctcgggcttcttaacccaaagaaagaggacgcgcggcgcaggcctatgacgaggagctcgacgccgcgtcgctgggactcggcgaggatggtctgcgccttggcttcccggccctcggtagcgggctcgacgcgctccgcgttcacccgcgcgcggnggtaccgagccttgcacgcggcgccggacgcgtgggtcgacccggg

SEQ ID NO: 11031 - DNA, 399 bp, Zea mays
  Clone ID: cC-zmpo14820022e09a1
ggacgaccctcaaaaggatgaggcagcaggcagcagcactgcaagacgcgttagtatttctcatagacagaactgtacatacaccaagatttttggattttttaactcccccgtataaaaaaaaaagctcgctctttaactgacttatccgggccaccggccacaccgatcaccggaccgcccgttagctgtccgccgtttcccatgaaccacccaccgttgtcgagtccccgctgatctgggcaccactttttccacttccaccgttggccctggcggcgctcatgcgtgcctcgtacgcgtggccgaggttccttaaccggttgagctccggcagtatgactgtggcgaggtccggccggtccctccgccgcattttcgtgcacttgagcgcgagct

SEQ ID NO: 11032 - DNA, 503 bp, Zea mays
  Clone ID: cC-zmpo14820022e09d1
gaaacgtgaccacaaatcaacattaacattatggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcagttgaacgtgatggcctccggcgtgttggaggtgccgtggatgttcttgaagacgacgtcgttgacggccaccttggaagcgccggacttgacgcaaatgttgttg

SEQ ID NO: 11033 - DNA, 520 bp, Zea mays
  Clone ID: cC-zmpo14820022f01a1
tttttcacaataagggattcaattttttaattcgaatgcaaacatgttacacttagatttggggcttgtttgagatcttgctggagacgaaaaaatcactacgcgggacaatctttgcacattgcagggatttgttttatacgacgtacagatatgggagaagttagttttgagtacaacatgaatttactttaccttgccttgcagggattaatcctagatcaaactcatcttctggtacagaggatacaaacaaggaactgctttgctagcttcttccaaacaattctgcatgctatgccaatcgttctgtctctgtctctctctctaataacaatgacaagaatctcaagtagcagttcaatcaatctgtgcatgctatggagtatgaacaagaatcaattttgatggaaagttagtcggcggtgagagtgagacattcgagcaccctggcccctgtcaggctggcaatttgccaggtcagctacgttgttaggatatagtatacgtgtgcatgcat

SEQ ID NO: 11034 - DNA, 581 bp, Zea mays
  Clone ID: cC-zmpo14820022f01d1
ccacgcgtccgcggacgcgtggggctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtagagcaaggcctgtgattgaatgcatccaaacaacgacaccaacgccaacattaattaattagtagtctccatgccctgggattgtgcgtggccgctccgttaacaccaccca

SEQ ID NO: 11035 - DNA, 504 bp, Zea mays
  Clone ID: cC-zmpo14820022f02a1
ccaaaagttaaatagccgacacgttgtgtgttcgtgtaaaacttttcctttacaacccagcgaaacagattgttcgtcatgatccggcctagaaataaacccaccggtttaggcctcggaagcggccttgagaacaaacacctggccgtccaactcccaaaggtaaaagaatcgtgaaccacagtggaccatgcatcctagagttgtgatcatcaatggcctcctcccatggagacggaccggaagctggtcttgggctgctttggcagcatgatgatccctgcgacggcagcggtgaaggcgaatacggcggcaaggccgaacgccgggatgttgcccttgccgaacagctcgtcccacggcccagagccaatggcgatgaccatctgtggcaccacgatggagatgttgaggacccccgtgcacagtccctgcccgccgcccttggccgccgacagctgtgccgtcacggcgaacggaacgctgcatatgaccgcgaatggg

SEQ ID NO: 11036 - DNA, 670 bp, Zea mays
  Clone ID: cC-zmpo14820022f02d1
ccttcccgggtcgacccacgcgtccgtgcgtcgccgagccatgacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccataggttgggctgaacgggaaggcgatcgatgagatcgtgaacgagcacaacgtgttccgcgccaaggagcacgtgcctccgctggtgtggaacgcgacgctggccaggttctcgcagcagtacgcggagacgctcaaaggcaactgccaacagatccactcgtcgtcgccgtacggagagaacctgatggagggccccccggtgctgacctggaagatcaccgtggactgcttgagccaggagaagaagacttccactacaacttagacacct

SEQ ID NO: 11037 - DNA, 500 bp, Zea mays
  unsure at all n locations
  Clone ID: cC-zmpo14820022f03a1
ggaatgggattacagatatacactagcataatgaataagttccaagattgtgaggcgtcggtctaataataattacatcggttggttttgtgatgatccaaanaagaaagaaaatacaaaccagcggattatatattcgggggagacttgagagtacgtgaaaaagagagaggttaccaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcaattgagcgtgatggcctccggcgtgttggaggtgccgtggatgttcttgaagacgacgtcgttgacggtcaccttggaggcgccggacttgacgcagatgtttgtggggcaatacttttggtcgatgatgatggg

SEQ ID NO: 11038 - DNA, 680 bp, Zea mays
  Clone ID: cC-zmpo14820022f03d1
cggacttcccgggtcgacccacgcgtccggcgtggtctccggcaccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacatacttggtttcaagttctaaaggccgcatggcatggcatacatcacatcatatatagtgaggtggcacacacgctcgcgcgcgcgcgcacacatgtttgtgtgtatgtacaatgactgagacttgcaaacagaggtgtcggagaacaggagggctg

SEQ ID NO: 11039 - DNA, 263 bp, Zea mays
  Clone ID: cC-zmpo14820022f04a1
agcagggggagtaaaaccatccattatgcccaggggggacggaaacatgtccaaaaaacaaatacccactgtatccgtttacctttaaatttccaccaccaaaacagggtgggcatgggtgggtccaaaaacaatgtttctttcccttctgtaccgtatgggggtactatggaataataaattttttaagatgaaaaggaagaggaaggtacaattaattgaactgggggaatcttgtttttcaaatgtaattatttccaatt

SEQ ID NO: 11040 - DNA, 509 bp, Zea mays
  Clone ID: cC-zmpo14820022f04d1
gacggattaatacagggattgccaggaacccaggacaagcatggaaacgccaaacgtggttgttgtgacaaagttcacgcttagccaaggttatgcggcgacgcaatggcggaagcacggtggttggcggcgggcccagccggccagcccagtgcagataggtgagatcttgggtgggggactgggggcccaagttccaccaacgcacctacacgctcagaaaagctccagcttttacagggaactgcgcgcgagtttacgctgcagcactgagagtaatccagaagagagatgatggagtcgtgaaaaaggcgccgcatctttctcttccctgaccagatgaaccgctgctgcaccggcacgtcctcctcgtccgtcgctgaagctctgccaccccttcctaaggaggaggaagaggcaagagagtgggtttccggcttcagtcgtaggggttcctgaacttcttcaggaggtccgggatgtcgtaggccagcatgtcgtccacgccc

SEQ ID NO: 11041 - DNA, 387 bp, Zea mays
  Clone ID: cC-zmpo14820022f05a1
gaaacaaagacgcaagtccccatcttcttagaccggtcaagatcacgaattggcaccgagaatccgatccattaacaggttacaggcccaggcccaccccctgcattcttcttcatgcacgcatggtccacgggtcggcgcgcgcgcgcgcgcggtagttttcagtggccgacgacgacgagctggtcgttgttgggcacgtcggggtcgttgtagtcgctgccgtcgtcgtggccgacgtcttcgggcgcggcggcgggcgcgtcgatggtgacgctggagccctcctcctcctggctgtccgggtcgtgcacggcgccgacgcggcacgcgtggtcgttcctggcgccggccacgcacttgggcttggcggcgcccgacgacacc

SEQ ID NO: 11042 - DNA, 550 bp, Zea mays
  Clone ID: cC-zmpo14820022f05d1
taatcacatacacacacacacagattcgactgctgctttacacaaagacgcaaggttcctttgctcagtccggcggtttttagcagcccaacaaccccactagagaaattcatactagttactggctggatctgcatcaccacaagtcccagacaatctggatatccattccatccttcaacagagcgctgataacagagaagaatactagtgtgccgtgccaaacgacaagaacactccacccaacaggaaactgaaggcacaaatataccacactcactactgctcgcagtttgcacaatccaaccgcaaaaaaaaaaaaaggttccacttctaccgtgcgcatcgtcacaagctcaacatcatcttaacatggtacaaggttctctcttaaaacactccaaaacagtcgcatgaaggcttgagatggagctcaagactggattggcttgatcttgaagtggaggttgatgagtgaaaacacgaagcacttcagatcctggacgaggtagtagaagatccggaagtcctccgggtcccttgctgactg

SEQ ID NO: 11043 - DNA, 238 bp, Zea mays
  Clone ID: cC-zmpo14820022f06a1
aaacccgcatcaaacataaataaatttgggcgcttccatggcctcccaggggcaaggaaaccaaaaaaagtgggggtcaaagttcaaacttgacaaattttaaattcagcgttgattaaaacataacattgaacagatgcaagctcccagtttttatatttcaccattttaatatgggctattgactgaagtactggactgggaggggaacttgcaataaaattacccggccccgtgg

SEQ ID NO: 11044 - DNA, 275 bp, Zea mays
  Clone ID: cC-zmpo14820022f06d1
atgtttgaccaagacactctgggggcattcacagggaggaagatgtgcagggtacggcgtcactgcctgaattatggaaaaagcgacaggagcaacctcctaggagggaggaggacacatgcaaatcttctcggcaaaaatgataattcgaactgatctgtacggatatatgtatgatgtgcggatggtatcaacacgggcacctctgcaagccaacaactgaggcaggtttagacggggtccctccgctgtatggggccattgtagacgtcctt

SEQ ID NO: 11045 - DNA, 220 bp, Zea mays
  unsure at all n locations
  Clone ID: cC-zmpo14820022f07a1
tttttgaccaaaaaaaatttatattattgattcatgggacatcaataaccaatgacaatccgaagttgnctggtgnggtttctcatttgtggttttaggactcaatgcgctcaggtgcctggaatgttcctgggactcctgatgggggggcggtgagttggcaattggtatagtattcgttatacataacgtgggcgggggtgctcttagccgtgcgggg

SEQ ID NO: 11046 - DNA, 498 bp, Zea mays
  Clone ID: cC-zmpo14820022f07d1
ttttgagagttagagaccagattaatcaaatccattagttacataacggttgaccccataatgttacaagagcaaacgaagtgagcaaagcaaagaaacacttggtcccttccttcccaccagacgagagcgattacagcacagccaattacgtgtccaccctaatgtctcaccgcgacacgaccatcgtcggtgagtttagtagaagaagatcatggtagcaacagcagcggcaacgccggcgatggcagctccacttccaagggcagcagcaccggcggagtcatcagcagccggtccctcagccgcaggggacgccgcggcggtggatgctggcggggaagggctcaactcctcgtccgtggaagaagggggtgtagaggctgtggctggcgcggtagctggaccagactttctagacgacgatgatggggcaacggcggcgacgggggtggaccctggttcgggtgcttaacgggggcagtagttcttttggca

SEQ ID NO: 11047 - DNA, 394 bp, Zea mays
  Clone ID: cC-zmpo14820022f08a1
aatatgcccccaaggggcccccccggtaaaaaaaatggggggggggaaaaaatggggggaaaagggggggggaaaaaaaaaaaaaaggggggccccctataaaaaaaaaaaaagggggggaaaataccggggggtttgggaaacccaccccaaaaaaaaaaaacgtgggggggggggaaccccggggccaccccggaaaaaacgggacgggcactgggggggaacaaaatttcccaaaaaggggggataaaaaaagggggggaaaaaaaaggaaaaaacgttcccgggggaaaaaagttatcccttcaaaaattcaaaaaaaaaacggggcggaaaaaaaaaaaggaaaaagagggggggccaaaagggggggaaacaaaaaaaaagggggggg

SEQ ID NO: 11048 - DNA, 362 bp, Zea mays
  Clone ID: cC-zmpo14820022f08d1
gacaatagcaagaatccagcactcagaatttggtacagccacgcagttacatttttgttttcctttcctttctcagttacatatttgtaatccaggtgaagaggatttgtggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcagatgggcagcggcacgtccttgaggtagccgagcgggttggcggggcgcaggttgtcgctgatgccgacgttcctggtgagcaggacgccggcgcggtccctgtccggacgcgtgg

SEQ ID NO: 11049 - DNA, 488 bp, Zea mays
  unsure at all n locations
  Clone ID: cC-zmpo14820022f09a1
tcctctagagcggccgccaccgccggcggcggcgagacgtcggtgctcgacctgccggagctggccatggattgcattctggagaagctgcggccggcggagctgcggagcatggccgccgtctgccgctccatgcgcgagcgctgccgcggcgaccacctctgggagcggcacatgacaaacaggtggggccgtgtcctgggccgcgccgccagggacgaatggaggacgcacctggcgtccgccagcgagtcccgcgccgcgggcggcggcggcggcggcaagcgccggaagtggctcgccgcgctgtcctgcgtttgcccggtggtgtcctggatgcggcccatggccgacggtggcaagtcgtccgcccccgtgctggacgatttcatcatgtcgtggtacctgtcccgaggagaagcggcaagttcttgtttcccgggtcaggtctacaaccgcgagcatgggcatgttgggntcatgatgtc

SEQ ID NO: 11050 - DNA, 256 bp, Zea mays
  Clone ID: cC-zmpo14820022f09d1
tcctctagagcggccgcggcgtcggaggcgggggccggggcgggggcctcggcggctgcggcggacgccacgagcgcggcggccatggcggcgacggcgacgaacttcatcctgaggccggccatctgcgagtgtgtagtgcagctagcgagtcgggtttttattgggccgcggggatctctctacgagagtatgaagcagtagaagtgtagagagatgcgcgcaggcgacgggctggctcgagccggacgcgtgg

SEQ ID NO: 11051 - DNA, 493 bp, Zea mays
  Clone ID: cC-zmpo14820022g01a1
tttaaaaataaaaataaaatggctttaataccgagatctatagttacaaatcgggagtagtagctttatatgctactatcgatatacaaaccgagagcacagtacatatggtcacactactacaggtgcacgcatgtattgccgcttataaatgtgggaaaaaaaagataacccgtttctctagcaatggaaagaagaaatgacaaaaacacggcacacacacagagaaggatggttttttttcactgatggtcgtctgatggaaacacttgttccgtagtgtatacgtgtggacgtgtggttaatttcatgcaggagctctcccttaaaccttaatcactgcagcagcagcagcagccgccgagaaggtcttctccatgactttgagcttctcgggaggcggagccggagcgaccgcgtcggccgactggccgtatgcagcaaggatttttgcgatcttgtccttgtccccctccgcgtaagccttgttgat

SEQ ID NO: 11052 - DNA, 288 bp, Zea mays
  Clone ID: cC-zmpo14820022g01d1
ccgacttcccggtcgtcccacgcgtccgaaaaaataaaaaaaaataaaaaaaaaaaaaaaaaaaaaaaaaaaaaaaattaaaattaaaaaaaaaaaaaataaaataaaagggaatgggacatcgggcaaccgtctttttggttcctattttttctccccctggtctgtcctctctttccttttttttggggctccccttttcggttttcctggtcgtttctttcctgtggttgtctggcttctcccgggggtttcccacttttgtctcctcggggccttttctctttt

SEQ ID NO: 11053 - DNA, 449 bp, Zea mays
  Clone ID: cC-zmpo14820022g02a1
acataataaatgaataaggcttttattgattgtgtttcttctcttcatgcatgtaacaaggccggaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcagatcgatgcaagaaggtcgagaagcgatcgatcatagtagatagcatgcatatatatatatataataattaatcgattcatgcggcggcggcggcgacggcggcgtggtgtgtgaatcccaaggcgatgtgcgccatccgaccgtactccctgtcgtgcgcggcgacggggacatactcctactcgcccttccacgcgttctcgcagctctcggaggcgcccatt

SEQ ID NO: 11054 - DNA, 595 bp, Zea mays
  Clone ID: cC-zmpo14820022g02d1
ccacgcgtccgggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatacgaggtcgcggcggggcgccgcgacagcatgcgctcgaacatggacgacctcccgggcaacttccccgtgccgggccaccacgtgccgcgcactccatcggcggcgcgcactgcttcatgttctccaaccggatctacaacttctcccaggaggccgacgtggacccgacgctgctcccggagtacgccaagtggctgcgccagatgtgcccgccgcggcagcccggcgacgaccccgagcaagcgcccaaggtgaagttcgacgctcagactgaggagcggctcgacgtctcctgctactccgagctgctcgcccgccgcggcctgctcacctcggacaacgcccttatcgaggacccgcagacgatggctatggaggagaacttcgcccggaacgagccactgttgcaacagaagttttccccagc

SEQ ID NO: 11055 - DNA, 353 bp, Zea mays
  Clone ID: cC-zmpo14820022g03a1
gggggaaaaaaatgggttctttttgggaaagccccattccccaacccggggaaaagaaaaacgcccaaacccccttggggaacccccgttttgggtttgcttcccccaccaacgcctcatttggtagataaaaccctttgggggggccttgggcccccgggcccgccctaagggccttggcgcccaaaaaaacccccccccccttgttgcccccccccccaatggggaccttggcccggggtgtttttctttgccccccccggtttgttgcaacccccttgaccccttccgggggggggggggggtttttttttaccagttttccgggcccgtgggtctccccgggaatttcg

SEQ ID NO: 11056 - DNA, 286 bp, Zea mays
  Clone ID: cC-zmpo14820022g04a1
ggaaacaagcactctggaacatttttttatttccttttcttccttttctttcaggggaaactgctatccatgccatgcgcgcgttcgctctgtataatcattatagttttgggcaacctgtccgcgacccccccggggtacaatttactggtcgtcgtcttcgtccgagtccaactgtttgagcagggcggcgcaaacgggctggccaccaacaccacctgggaaatgtcctcctcgggggtgtccttgaactcgatcgtgtaggggccggtcgccggacgcgtgg

SEQ ID NO: 11057 - DNA, 202 bp, Zea mays
  Clone ID: cC-zmpo14820022g04d1
tttttgacatcacatggttcacatcagcggtgtttctttctcctccaccagagtccagagaacgcttgagaatccttccgcagtaggcacagaaacccgagttccaccgcttctagactctaaaaagcacctagaagcccggtcaccggagaaactcggcgcgggacgccgtcgacagctccctgcgcagccggacgcgtgg

SEQ ID NO: 11058 - DNA, 539 bp, Zea mays
  unsure at all n locations
  Clone ID: cC-zmpo14820022g05a1
aaaaatgataaaacaaactttattaatccaggcatagaaacaacaaaaacaaagaatttcataagtattaaaacattggaaaatcaaatgtacaaccatctcgataatgaaggtggatcagatcaacatatttctcctaaaatcttaaataaataatgtatttagtttatgtaataatatcaacccaacacaacaaggcgtcagaagagacatgtagcataacttatttcttgggtggtctggtgccaaaaaaagccattgaaaaaataatattgtcttgtaacacatgcgctaggtgagctcttttgaaatataattcatcatgagaggttgattagatgctgagtgtggtcttataggtggtgccagccttgaaatcggcggggatgacgtcgtcggcgatgcggtagccgccagacttgacagcaaagcggatgcaaagggggtacttgagtggggccttggtgtcnagcgtacacgtgccagtcgggccctcctgagcgtaaggagaagtcatcaccaccgtgctctttgatctc

SEQ ID NO: 11059 - DNA, 486 bp, Zea mays
  Clone ID: cC-zmpo14820022g05d1
ggagcttggcatgcatattatcatcacaagcgagcacaaaaagatcttattcaacaccaacaacaacaacattggtgtctagttcaggtagaggcgtaaagcaaattctggttgcatgaaacctgaaaaccactacagcagcttccatctgagctcttccctgatggcatgaggccgactcgtttgtctgtccccggccctgaaaaaacacctgctcatcaggagagctagctcacgggccaactcctttgatatgtttccagcatcttctcttgctctggggtaagtacgtgcaaatctgatgggcgtttagatgtgtccatgccgtgtctctgccatcaaggctcctcctcctcggggcctttcatgaaccatggccggcgaccagcttgccggatctgctgctcgtggatgtgcaagagcttgtcgatgcgccggggctgcgacagcaacggccctgagaagtccaccctgttcacctttccc

SEQ ID NO: 11060 - DNA, 495 bp, Zea mays
  Clone ID: cC-zmpo14820022g06a1
accatagaactgatttcaatttgggtacagaaagcacatacgttagcaatcgtgaatgattggctttacagaaagatcgcacaagtttgaatgacaactaacactgaagatggtttggtcatggattgaaacgtgatggctgaaagaacaaatcatccggggccagctataggcaaacatcaagatactgcagagagaacccttgcaattgtatgacttggtgccaccgctcaactgcagcagccaccagcctgtgaggacgagccagcaccacctccagatgagttgggaacaggatagccaactttgatcccgttggactcatttgatacatcaaatatgccatcttggattttcttgtatatatgaccagcggtcttaatgaatgccttctcgacgttttgtgcagttttagcagatgccttcataaaaaccagaccatgctccttggcaaactgttcgccttcctcatagctgacagcacgcctatgagaa

SEQ ID NO: 11061 - DNA, 367 bp, Zea mays
  Clone ID: cC-zmpo14820022g06d1
acagcaaaagggttcagttcaacggagcatccatccaaaatttgggcgttgcaaaacgaccatttccctggccattttagcgggctaaatgctgactgcaactgcaagcaaaaaaggtccctcaaaggagcccgggaacaggatttgcgcccccttgtcgcccccgccccggggccccgacaagggccacttgaggaaactgggcgtgccgggcctggacaaccccggggccgccttcctggggctgccaagcaacaacctttgccaccaaagcttccgccattgccggcattttgcccacaagggaacgggctttttccgattgcttgaacaccaagggcctccctttgccggggttgtatctggt

SEQ ID NO: 11062 - DNA, 305 bp, Zea mays; identical to SEQ ID NO: 10955
  Clone ID: cC-zmpo14820022g07a1

SEQ ID NO: 11063 - DNA, 497 bp, Zea mays
  Clone ID: cC-zmpo14820022g07d1
tcctctagagcggtcgaccttttggttattaaacttaactctgggagcaagatcgagtatgatccatgagccattgtacaccattttctagaatagaatacggtgatgacagggcacacaaaccaagaggcgcatagtttacaaaacaatttacaatacacagctgcatggcaaagctcttctctgcgccaaggcgttggcagtcacgacacagcaacaccaacgctccacaagacggtcctttttcgtgaacccaaagttgtcgcagcgatgggaaatcacagtccggatcgctctgctgctgcggcagcgtgggaggccgacgaggcagtagggcggttgccagaccggctgtgcagcaaggggttcagagccttgacgacgatgctcatgttgggacggaattcaccctcgtattgcacgcagagggcggccacagcagccatcttggctacagcctttggagggtattcgtctccgagccttggatcgacgca

SEQ ID NO: 11064 - DNA, 247 bp, Zea mays
  Clone ID: cC-zmpo14820022g08a1
tttgaattcacaacacagcatagatagtgtgtttttcgtttgttccggccgggtacaaaagatgacggtggtagcatttatacaactactcagaaaacatgaatggtagctactaaaataatgcgagatggaaattatttaaatttttttaggaaagatgtctgctagcatgcatgcgcgcataaacaaaccgaaacaaaggtgctatatgtatatgggatttttttaaaaaaaaaacgcgcgagag

SEQ ID NO: 11065 - DNA, 559 bp, Zea mays
  Clone ID: cC-zmpo14820022g08d1
ttaagaaccagttcattacttcattttataggaaaattacagaaacgggaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaggcgtcatcggctcgtcgtagatgccaaccacgagtgcctgccctgtcttcttcacggtgatgcctcctgatcccttcttgccacggatgacggcaccaggctcgccttggatgaccatgtacttggtaggtccgaggaacaagcctgtcggcgcgaggtgccctggctcgtcgaagtccttcatgatgt

SEQ ID NO: 11066 - DNA, 216 bp, Zea mays
  Clone ID: cC-zmpo14820022g09a1
ggaacaacaacatatctccattccagcaaacaacatgtgagcctaaaactcggaaaaagatcaatacaatgtgcagggaaaacaacggcatgcagctaattcccagcagaatcctcgggggcggggcgcctccttagcttggcgcgcgtcacacggatcgtttcctccatcagggtttcctagggcgcagggaaaagcttttccgccccctgtgga

SEQ ID NO: 11067 - DNA, 282 bp, Zea mays
  Clone ID: cC-zmpo14820022h01a1
tcctctaaagcgtacacccttcgtcctttttttttttttttgatgtttggtaatatatgaaatgattgttgaatgggtgtatttatagatccacactagcacaaataaaaatgatatacaatcataaccataggctgtcctacacacttgcctctcaacgaaccgttttatcccacagtcttaatacatgtgccacgccgcaagaggcaacaccgaaaagaaagacacgcgctaggtccccatgaaattgggatgcttccaacccatttaccggacgcgtgg

SEQ ID NO: 11068 - DNA, 294 bp, Zea mays
  Clone ID: cC-zmpo14820022h01d1
ccacgcgtccgcttgctcgggtccttgaggtactccttgatcttgtcgctgctgcggactctagtgctgctgctgcccccaaggaggaagagaaggctccagagcctgccgaggagtcggacgaggaaatgggcttcagcctgttcgacgactaagccgctcttatcgtccatccgccgcaagttttgcttctgcttattattttagtgcattatgttttagtagacaaaccatgttggtgtaattgacaatgttatctccttaaatgttgaaagtgcccgtgttgtgtcaaaa

SEQ ID NO: 11069 - DNA, 470 bp, Zea mays
  Clone ID: cC-zmpo14820022h02a1
ttatataacgtgtcaatccatttcttaactcttctcttttaaacaacagcgaagtctcactctagctatatatggagatgaagaagatggagaaggaggatgacaccatcattgttggcgccagcatcactgtcgtaatagggtagtgggagcaaatagatatcacggtccaatgcatgcatgtgtaatgcattgcttgggatccaacccaatctagtatagctagcataggtcggcttaaaggattgtcagcactaaagttaattatttggcggtgtaagcggtgttggccttccagttggcagggatgacatcgaccgacacggacttggtgcctccctctgaagtgaggcggacggagaggggtcccttaagcggattgtcgctgtccttcctccagatggcgccccaggagtgcttcatgggctcgtatgtggctgagcccttcttctgacgttcactgccacaat

SEQ ID NO: 11070 - DNA, 253 bp, Zea mays
  Clone ID: cC-zmpo14820022h02d1
cggccttcccgggtcgacccacgcgtccgcggacgcgtgggctttgaagtattatggtacatattatagtattaactacttactaactttattaacttagagcgtgaatgtacaatttgtggagtatgctatacattgtttgattttttttcttcttcttctttttttattatctagatcttccactgttattgtaagactgaaatatactgctgctaaacactaattaaaagtaacaatatgaaagacaaat

SEQ ID NO: 11071 - DNA, 480 bp, Zea mays
  Clone ID: cC-zmpo14820022h03a1
gggcaaatatatacgcgatgattgattaaatcgaattgttgaatggattcaaacaaatggcaagcgatgatacaagtgttaatccctctctcagggggaagaacatcagcggcatgcatcaattcgttaaattaaggagaaagagggaacaaagaaaaagaggacaaaaggtgtgtcgaatcaaaaacatgcccacgcatcggaatgcgcgcagccatgtcactctctctcccgcttcgtctcttcctcggcctccgggcgaccggccgcggccggctcactgaatgtagtaggcgaagaaggaggcgacggcggccccgagggcggcgccgacggcgggcgcgacggcggaggagccgctggtggggcccggagccggagcctccgcggtgagcgccacggtggccgtcgaggcggcgactaggacggcgcaggcgatcttcttcatctccatccctgaatgccgcggcggcggcgggc

SEQ ID NO: 11072 - DNA, 665 bp, Zea mays
  unsure at all n locations
  Clone ID: cC-zmpo14820022h03d1
ccacgcgtccgctatcttcagctacggcaaagtaaatggtctgttgacgaagcaggatctaaaacgtgccgcatcacatgtttgtggagtggacttgactgataaagtagtagacataattttccatgtgtttgatgctaactgtgatggtaacctgagttcagaggagttcctgaggtcattacaaagaagagaaagtgatattcgccagccagcaacgtcaggtttcctaggggtgatcgcctgttggctgaactgtacaaagtgttctcttcaacagatgctgtcccagtagattcttttttgacgctcatgacagtcttcagttgcccttggttgctctgtgcttattgagctggagaacgtcatcggggagttctgaagtgtgaagaggatttttgttgtaaatattaccctgcggcccctgcttagtagctcctacgttaccacgtagcagctgtaacctgtaaggaattccttccgttctcgttcaagggcttcgatgacatacatcttctcccctgacattaaatctccgtcgacttagctggagccttgctacctatcttgctnttagctcatccctgatgctaatattctgtggattgtggttgaacaatcacacttgtaagactagcttgggaatacctattttctaagagatt

SEQ ID NO: 11073 - DNA, 423 bp, Zea mays
  Clone ID: cC-zmpo14820022h04a1
aggcaaagcaggattgttcatgttgattaagctcatggatacaccggtttacgtccattgatatgtaccgtaccattgcatattttggaggtctacgtcccgagcatagtgctcgccttcagtgaaaaccacggaaaaatccgttaaccaggtcggccaccggatgtttccggaacggtcgacgcggccgtggatggggccggagccatggaaaaagaacgggcgggcgctgcctctgcaggaaccatggaagctgtggctgatgcggctgttgctgctcctcctcctccagctccggaggctgctggtcctcctgctcctccggtggctgctgctgcttatgctccttctcctgcccgaacaccaggcgggactgttttcttacctggcccttgccctcgccgattagcacagtaagcatcc

SEQ ID NO: 11074 - DNA, 572 bp, Zea mays
  Clone ID: cC-zmpo14820022h04d1
ttttgtagaagtttgtatcttcgttaaaaattatagcagtacaaatcatagcacattctgtaggtgtaggatacagtaacacagcagcagaacatcaaacccatctcctgccaggctctgagcaaacgccaaagccttcaacgtggcacctacgtaccgtaccccactcctggtacccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcgtcgcagcgtgccaccccgtctagcgatcgaacacagtcgacggggaacgccggccggtccggtcagttggtgagcgcgacggcggcctcgtgcacgaggggctgggtggcgtgcgcgacgccctcggcctcccgctccacctgctcccggcacgcctaccgcgcgcccggctccgtcatgcgcttgacgaacgcggcgaagcggcgccagttgtcgggctggaacaggtcgggccccatgcgcaggtacgtgaagg

SEQ ID NO: 11075 - DNA, 230 bp, Zea mays
  Clone ID: cC-zmpo14820022h05a1
tcaatttccaatttaaatttatattattcattcatgggacatcggtcctttacaacccacctaaacagattgttcgtcatgatccgttctaaatatattcccccttatcttcccctttctaagctttcttataaattattctctggccgtctattcttctaaggttaataaatttttttccacacaggaccatgccttcttaagtttttatcatcaatggcctcctccca

SEQ ID NO: 11076 - DNA, 487 bp, Zea mays
  Clone ID: cC-zmpo14820022h05d1
agtaacctagataacattcattcaataagccccaggatgttgtattatcagaaccccatggagggaaaacgggagacatcaaaggtttgttttgtttacaaggtgaccgagtctctctcccgacttaaacatgtatgccaattagtggtcgatctctttcttgcacattgatcatcaggcatcagccaattgacatgcagtcaattagcttagcgatggcttctccttctccatctatatctcctcctcggtgtctttcttcaattctgtcgtgggctcggctgccaccttgttggtggcaatattttcctctgcatggactgctgatggcttctccttctcgatgacggtcttctccacaacttcctcctcctctttgttctcaggctcgacaacgacgaccgccacttccgaagtggtcacctcactagcaatctgctgaggctcaatggtggctgctggctcttggttcgccgccactgttagt

SEQ ID NO: 11077 - DNA, 324 bp, Zea mays
  Clone ID: cC-zmpo14820022h06a1
caattttaattttatttttttttatttatgggacatggtttaccaatgacaatccgtagctttttttttttttttttttattttttttttacacgcaccccaggggttccaccaataggtttagtcaacctcctagggggggccaactattttaggggagtgaccaattgttagatattttatggcgtggaggaaaagagcccaagcagaaacaccgggaggaaggcctttgctttgcagatactattatcggaagacgaaaatcgaaaacatcgggggtgccatgcaattcagctgggaccaaataatttcaatccctgttca

SEQ ID NO: 11078 - DNA, 407 bp, Zea mays
  Clone ID: cC-zmpo14820022h06d1
caccattgttgttgtttttctttctttacttggaggagggcccacctaactggactacgtacgccttgctgggtaccaatggccatgtggttacttttggttgagcctgatcccctaaccaaaaaactgcacctgcttttatggcgtccaaacgaactgggaaatactgttcttcagattctaccacttgcttgcccgttggcacctcgatcacgcatttgccttaccaaagccaaggaattccatccgggccataggtttggactttgcacaacctgaccttgactatcacctcaccctaaatggacattggcattaggcggctgtgggtgcccatcctttgctacttgagcaaactgccgcagattctcgacaacagaacctatggcgaagctaccatcaccggg

SEQ ID NO: 11079 - DNA, 327 bp, Zea mays
  Clone ID: cC-zmpo14820022h07a1
tcctctagagcggccgccgtacccctcgccgtggcctccctcgccgccgccgccttcggctacctcttctgctagatccgcgctggatacgtggttcctgctccaaaatatgattcgtctggtctggcgtgcgtgagtccagctcgtgtcgtgtgtgtctctgtgtgacgtgtcaacgggcgtgtgtatgtatggagtcggccgcggtggcggaagacgtgtgcgcgtggtggtggtggtacttgcttcaacgcgccactgtttgtcgcggagatcatgtactaccctgctgcgttttctggttatcaatgagatgatttatttgat

SEQ ID NO: 11080 - DNA, 508 bp, Zea mays
  Clone ID: cC-zmpo14820022h07d1
gcttggcatttagagaagaaattttataccctcaaattcagggtgttacaccgtcgaacataatatagctgttggatgtctatcattttactgttgtgcgttacaaatggatagcaactaatggacaattcaaggacgagagaaaaattataactagagagatgggtcagtcgactgagggtctagaagcatgcaagctccttgaggcaacccttggtgctgcccttggcgttcgtgcatatagccatggtcttgttgttggtgccactatactcgacgttgacgtcatccatggtgacgccggtgcatgggaccttggcagtgcagagcaggctaatggcctccggggtggaggaggtgccagtgatgttcttgaaggtgatgtccttgacggtgaccttggaggcgccgttggcagtacacaacttgttggggcagtacttcatgtcgatgaagatggggttggctgagtcctccatcttgatattctcgtagtggatcttggaga

SEQ ID NO: 11081 - DNA, 284 bp, Zea mays
  Clone ID: cC-zmpo14820022h08a1
taccgcaaatgcttatttgcgtgacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatgatgtatcagtgattcagtgtcacgcaagcaggcagaagacgacgaccggcgggcgtgctctgcgttcaggaaggaggaggggtgcaggacctcctgcagttttcgttgaacaaaggttgtttttct

SEQ ID NO: 11082 - DNA, 465 bp, Zea mays
  Clone ID: cC-zmpo14820022h08d1
ggttacagagcatgctctctatatagtcgatcagtcgtatacaatttacattggtgactcaagctctcaggctcaatcttacagcattttcttttgcgttgcttactagagtagtagcgacgaaatgtggtagtacgtcatcaattgggacgaaatatatagtcgttgtcgtggtggtggtggtagaggggcttggtgatggccggcttgagcatggtggacacgggcggcctcgccgcgaaggagaaggccacctggaaggcgtcgcgggaggccgaccgtagcacctgcagcaccacccgcctcgtcgtcatggccgccgacgacggcatttcccgcgctacgcgtgtggtggctagctggtaccgtacggtagaccttgacaccactcatgagcttttcgtttgggccttcgaatatgcaggatttcgtcgtgagccagcccacgcgttcgcggacgcgtgg

SEQ ID NO: 11083 - DNA, 436 bp, Zea mays
  Clone ID: cC-zmpo14820022h09a1
gtgggggttgggggtttttttttttttttgtcccatggggatggggagggaaatacaatacctacacttttcatcctcgtcaacccaccccgagggaaggggggcccacaacaccaaaaaacggggggggggggggaacccgaacccgggcgggcgggggagagaaccccccaagggggggggggcccccaaaaaaaaaaaaccgcgggggggggggggggggcccccagaaaaagagcaccccccccccgcgggtttttttccggggggggcccgcgcccccccaaggaaaaaagggggccccccaaacgggcctttataataaaaacgccccgcgcccccccaggggggagaagggggggggcacccccccccgcggggggaacaccccgagggtgcccccggggcgggggggggcgtccccccccccccccaa

SEQ ID NO: 11084 - DNA, 625 bp, Zea mays
  Clone ID: cC-zmpo14820023a01d1
ccacgcgtgcaaaaaaagtctcaagggtcttgattcttgtatgaactcaagatgtatggtggatcttggagctgtgggatgctaagcctggtctagctactagattatgaactctctgctgatctaatagcatttctacaagaattcttttgctggaaggtccattagtcatttgcaacaatgaaggaacatctaatgcttaatattgatgacctaagcattcttgagcctaacgaggtcattgggacagtcaagaataaatcatctggggaaaccattgcacatccaccctccatggctcatgccattttagcagtgggagaaagcatggcttctgaagcggaacctcttctgcaagtggtggagtgtcgcatttgtcaggaggaagatagcatcaaaaatttagagagtccatgtgcttgcactggcagtctaaagtatgctcataggacttgtgtacaacgatggtgcaatgagaaaggagatgtaacatgtgaaatatgtcatgagccttatgaacatgggtacactgcacctcccaaggccatcctgatgaaactaccattgatataagtggtgggtggacaatttaccggaccgcattgacttgcgtgatcctaggata

SEQ ID NO: 11085 - DNA, 347 bp, Zea mays
  Clone ID: cC-zmpo14820023a02d1
ccacgcgtccggtcctctactctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaatcgaagcaacacgccttgcccggtgtgcaccgacgaaacccgcgacagc

SEQ ID NO: 11086 - DNA, 312 bp, Zea mays
  Clone ID: cC-zmpo14820023a03d1
ttcccgggtcgacccatcgcgtccgcggacgcatgggccatcaatgcctgccgtctccctgatgcccttgcacttcgtcgccgacgttccaccaccaccggtggagcgagatggagatgaagaggatcctcttcgccgtcctcgtcgtcatcgccgactcggtcaccgcagtgctggccttcaccgatgccgccgtcgtgggcgccccaactgcctccgagtcgcccgccgaggctcccgctggcgctggcgctggcgctgccgctggcgccgacgccgcggggccctccgccagcagcggcgcgcccgccc

SEQ ID NO: 11087 - DNA, 348 bp, Zea mays
  Clone ID: cC-zmpo14820023a08a1
gggggtaaaaatatttatattgggggggggcccacctaaattgccccgatcaggggctgacaatttggggacccatagacgggggaaagggccacttttgggccccccgggaaccaaaaaaaagaacgaaagaacccccttatgggggaaccccaaaacagcagctgggggggccacccaaacccccagttgttttcatcaaccccaaaaacttttttctcggggggggaaaaaaaacccggggggtgggttttacccaccaaaaaaacccctggttttccggcaccccgggttgcccccgggaaccctgaacaggccccgggagggtccccacttttccctaagggg

SEQ ID NO: 11088 - DNA, 575 bp, Zea mays
  unsure at all n locations
  Clone ID: cC-zmpo14820023a10a1
gaaacgtgaccacaaatcaacattaacattatggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcagttgagcgtgatggcctccggcgtgttggaagtgccgtggatgttcttgaaaacgacgtcgttgacggccaccttggaggcgccggacttgacgcagattgttgtggtgcagtacttctggtcgatgatgatggggtaggagacattgttcatggtgatgccctngtacaggaacttg

SEQ ID NO: 11089 - DNA, 469 bp, Zea mays
  Clone ID: cC-zmpo14820023a11a1
ttttgtttcagttcttagtatcacattcagttgcagaaggtgcgacttttaccgcggcattatcctgcagcttctcatgcctaatcccactaaattgaaccatcatacatggttcgacacagggaacattggatatacactttttctattactataatctaggttctgatagatcatgcacaggtaatctaacatatcttaggaacctatgataatcgaaaccttttatagcaaccccaggtcttatattaacatcctatgatgttgtacaactgacgggggcacgaccatattcaacacaccttcccctttctgacgttcaaacgtaaccatgctatggatctgctgctccatataactctctctatggggtacggatatatcagccttactatacatggtccgggctcatgcttgcacttttcttcaccctggctgtggcagcggatcccttttcatctgaagcacc

SEQ ID NO: 11090 - DNA, 306 bp, Zea mays
  Clone ID: cC-zmpo14820023a12a1
gataaaattcagtttatataatctcattatattgactagggaacggctctgactaccgtaagactggacacatactcaccgagcaacttactgaccgacactgtcatagtaccttcatggagtaagagaacaccggcaccggcggtgcaaaaatcaggacacggacacctgcataggtactatgatattgaaacttgataaactacttggtctgcactgatagcccctgagcatgcataactaacgggggatcgaacgcatccatcactctttagagagctcgagctctaaatatgtccatgctat

SEQ ID NO: 11091 - DNA, 296 bp, Zea mays
  Clone ID: cC-zmpo14820023b01d1
tcccacgcgtccgcggacgcgtgggcgctgatgctcctggagcacggcgagcgcatcctgtcggcggcgacgggcgtgttcacggggtcccccggcgtgaagatctcggtgaaggtggccgggatccactggcactacggcacccggtcccacgcggcggatctgacggcggggtactacatcacccggtcgcacgacgggtacgcgcccatcgcgcgcatgctggcgcgccacggcgccgtgctcaactttacgtgcgtggagatgcgcgaccacgagcagtcgcaagacgcgca

SEQ ID NO: 11092 - DNA, 554 bp, Zea mays
  Clone ID: cC-zmpo14820023b02d1
ccacgcgtccgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggcggtcgagaggctcggcgactacctcgtagagcaaggcctgtgaatggattcatttaacctcgctcgcttgtccatggttcgcagcaacgataccaacacccgcattatttaattggtagcctcctctagctacgcacgcatttttagtctcctacacgcccttggattgtgcgtggctctggtaatcatctctcatccttcgtctgccatttctcccctgagatttttgttcccttgtggtaccatgcattttggcaaat

SEQ ID NO: 11093 - DNA, 591 bp, Zea mays
  unsure at all n locations
  Clone ID: cC-zmpo14820023b03d1
tcccgggtcgacccacgcgtccgctctcatttcgccctccctccgccggctagggttactgccaccgccttccacccctccccgactgcccgtgggtggaggaggctggttggcgtgcaggcgacctcggcggcggagatggagccggacttctcgaccgtgggcgggcccagctttgagttcgctttcaacgaggccaacttcttcgaccgggaattgcggatcgaggtcgtcgcgggggattacgacgcgccggggtccactggcggcggtgccggaggaggtggtctcgccgactgggcgcgccatcgcaagcgccgacgcgaggagctctccaaggagaaagaatgttctacctacatgccagaccaaacaaattttaatgaagtcgaagcagatgagtgcgatgcgtatgaagaaaatcaagaggaacctgtagcaatgatggaaggatctccacctgatgctggtcaagatggtgatgatgagcaaggtattgatccattttgggctgctgtagttacgccggttttacgagtcaagacaatntatatcagttcggcgattcttgctgcgaagagtcccttcttt

SEQ ID NO: 11094 - DNA, 438 bp, Zea mays
  Clone ID: cC-zmpo14820023b07a1
catccaaagggcacactttttcgctatggttaaattgaattgttgaactggtccaaacaaatggcaagcattggtccaggtgtcgatccctctctcgagggaaagaacaatttacggggcaccaaattaaactggtacatcagcgatcccaattagttaaatgaaaatcagaaagaggaaaggaaaaaaacaaacaaaaggaagacgaaggtgtgccactgccgtgcccaatcagagcacacccacccacgctttgggaatgcccgggagcagcaaagcagcgcagcgcagccaagtttttcccccccttggtcttttccctccggcagtccggctcctcgtccggcggctcaatgaatgtagttcggactgaggaaggaggccacggcggccccgacgatggcgggtgcaaccgcggaggatccgctggtgggggac

SEQ ID NO: 11095 - DNA, 544 bp, Zea mays
  unsure at all n locations
  Clone ID: cC-zmpo14820023b08a1
aatgaaaaccctgagctttcattagctcgtctatatatatatataagcaaaacatctcatcagtaaagagattagagattcgtgtctctcgcttttgcttcgtactcaaatagatatatcgcgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctnctcccccatcttcgtgtacgagtagacgacccgggaggagtccccccaggcgcggcccaggtagatctggccgcccttgacgccgtcgatgctgcagttcttgaacgagaagccggtgtcgatggcgccctcgatggacttggaacgctgctgcgccgtcagcaccgtcaccttcttgaccaccgactcgatg

SEQ ID NO: 11096 - DNA, 365 bp, Zea mays
  Clone ID: cC-zmpo14820023b09a1
aaaaaaataaaacagactcttggggcgccccgggaaacccggaaaattccctcccgggaccccaagcttccccattttgcgcctaacgagggcctttagaaaccgggggtatcacggggactgggggtaaacgggggaaaatttaaaatggcacacaatacaccctacggaagcacccagggcaaaaacggggaagcccggggggggacctaaaggaaattaattgcattaagcggactgccccgattgcccacggtaaaaccggggaacccagggggccaatggaattttcaaatcggggaaaaaggggggcaagggtttttgcgccatgggggccctgggggtgaccctctgtaccgggaaaa

SEQ ID NO: 11097 - DNA, 256 bp, Zea mays
  Clone ID: cC-zmpo14820023b10a1
caaacttatggttaaccaaatcatatatttcatcgcatgattacagaacgacttgacacaaatagataaattaaatcacgtctatgtaattaacacaacccgtcaccatgcatatatattcatatcagatcacatcaataataatatatggaaacagcggtgcaggtgacgtcttccaagtcgaccaccgcagcaacagtcaccaagaacgagcgaggcatctgcaatggcaacggtggacggatccatcgtcgtc

SEQ ID NO: 11098 - DNA, 493 bp, Zea mays
  Clone ID: cC-zmpo14820023b12a1
tcctctagagcggtcgtcctttttttttttttttttttttttcttttttttttttttttttttttgggtttttttttttttctggccacctgaggaccccttcccattgtttaaaagaaaacaaacttgccttgtcctacatataaaacatgtctatcaaaaccttacaccccttcttggcactttacagaacgtcagttaatgagtaacttaaggaacactacttgcttttggatcccctctgggtctctttgttgcacactggacttgatggggcatgccctgacaatggatcatcttttaccaccaccaccttttttttcctcaggctaaccctcttaggctttggaacaattgggggcagggcctttgactgatatactgggtcattacatggccccatttggggaccaaactgaccacatcttttgaaattgggcctgtttttccccgaccctgattttactccaatgaaccgttttgcccttggttt

SEQ ID NO: 11099 - DNA, 598 bp, Zea mays
  Clone ID: cC-zmpo14820023c01d1
ccacgcgtccgcgtcgctgccgctctactcgggtgcccaggtcttgttcgggcccttcgccggcgatccaggggactctttctttggtatgagaggatcaatgtccaattattatgatgattactacgacattgatgagattgaggatgactatgatatggatgatcctgctgatgacatggtagacgagcagcgaggggttagggattctgatgcggaggataatgattatggacaaccaaatgacaagatcccagatacttcatcagcagatgcaagaaatggaagggacattcaaggaataccctgggagcagctaaacataacccgtaaaaaatatagacagtccagattagaacagtacaaaaattatgagaatgtacctaactctggagaagaagctatgaaggattgcaagccaacagagaaaggtggaatgtactatgagttcagacgaaatactcgatcgattaagtcaactattctacattttcagcttcgaaattcggtatgggctacgttcaagcatgacatctacctagtatcacattactcaattcgtcattggtcagcatttgagtggtgtcgatactgaact

SEQ ID NO: 11100 - DNA, 127 bp, Zea mays
  Clone ID: cC-zmpo14820023c02d1
ttttggtgtgtccgtgtgtgaaagcgagaaagtgtacgcatcatgtcatgtgcaatctccgagaggtgcaacttgcaagttcaaaaaaaaaaaaaaaaaaaaaaaaaaaaaaaaaataaaaaataat

SEQ ID NO: 11101 - DNA, 527 bp, Zea mays
  Clone ID: cC-zmpo14820023c07a1
taataaaataaaattgggatcataataatattagcatcgagtcacgattacagaacaaacccttcgacaattcacacgaccacgaaacgaacgaacaaacaaacaattaaccaatcgcaaaccacgtaaataaaaaaaacaattaattaatcggatgaaccaaacacgatgcatcccaacgttgccgtcccgcgcgtcgtcgctcagtggaggtagtaggcgaggaaggaggcgacgagcgccccggcggcgggcacggcggcggcggcggcgccgcttgcgctagggccagccgcaccaccggccgcgccggcgggcgcctcggagggcgcctcggaggcgaccgaggccagcacggcggtggccgaggcggcggcgacgagggcggcgcagaggaccttcttcatctccatggctggcgggtggatcactttgtcgctcctggatatagcggtccaaggaacctggcgttcgatgagatgttattagttattgggtggaattgggagactgctcgctcgacgggc

SEQ ID NO: 11102 - DNA, 525 bp, Zea mays
  Clone ID: cC-zmpo14820023c08a1
tcctctagagcggccgccgcggcgacgccgacgcccggatctgccgctcccagtgcagcccgccccacgacgccgcgaagtagcgggaggaggtgtccacgatggagtggacgctcaggtacgtggccgtcatggccaccaggaagagcgcccacaggaacatggtccccgtggacgcgaagcaacggtgcaggtatcggctcatcgcccccgcccgctccaccttcaccttccccggcgtcgacgggtacaggtcctcctccagcactcgcatcctcctcgcatgcgatccacacttgcactgcagcccactccggcggccaatgcgctaggagcttttgcagctggtctcgctcggtctcgggatcaagccgtcgattccacctcctgctggctgctactcctctatatatgtgacgacgttcttgcatgcgctttccttgcaagatcgtcttctcggagttggcatggtgcacgacgatgagcggaggcggccggcacgcccacgcgttcgctgacgcgtgg

SEQ ID NO: 11103 - DNA, 614 bp, Zea mays
  Clone ID: cC-zmpo14820023c09a1
tcctctagagcggccgcgaaggtgaagtcccatgtcgcaccacggtggaggtcctgtcccggagggcagtgccccagcgaggagacgtcgccgtcgctcccggcgccatgggctggcagcatcctggacccatccggctcacggtaggagagcgcgggcatggaggagaccttgaccatactcgggttgggccgcagcaggtgttcgtcgccgatcagcatcgactgatccagcagcccgccgctgctggaggtgtcgaattggttcgaatgtagctccgcctgcgttctggcggttggcagtggcggcaggcgagaggagacgatgtcgccgaaagccgccgcgctgccgtcctggtggaacgacggctgctgactgcccgcgaggtggtggaacacctgcatctggttcagaagcgggtagttctggttgatcagtggcgagtgcgagtgcgaagccggctgcgacagtgacggtatgctggagagcatcgcgaacgggtttccgacgtcgtagaggagctgccgcgccggaaggccggcgctggcgttggcgttggcgttgcgttggcgtgggcagcgtcagcgtctgcgtctgcgaacgggtttgacgtc

SEQ ID NO: 11104 - DNA, 497 bp, Zea mays
  Clone ID: cC-zmpo14820023c10a1
attaatagtttaacctggtcttgtgagttacagtgacagttttactcttgtgatgagtatgacagcatggttacattatagtacaccggaacttctagttcattaaaaactattcagcatagtactggtactaatgttatatttcaagatttggatattgcaaaagaaagacaatatacaacacctccacttagcgaaggaacaagtgctgtacaggtttgctgctctaccaattgaatgatcagactcagaagtagcaaccagttcagagaaaaactgagttgctctgttttgcaggagcacccattggggcaaggtcactgaaaggatcaccaaatgggttcgaagctccagatgtaggcacagagtactgatactggtggtgatacatgtttggcattggcattgccaacgtctgttgatgctgctgaaaatactgctgctgctgtggctggaaatacagctgcgcctggtaatactgctgcgcctggaatact

SEQ ID NO: 11105 - DNA, 466 bp, Zea mays
  Clone ID: cC-zmpo14820023c11a1
ggtgttaataaatggtgagataaagttatatatataactcccattacaatgattttttttgagaaccccagtacagtgatttgagagggcatgcatctcaagattacatatatccattcatttgttccccttcactacgcttctttcgtatttgttcttttgagtttggattggatggtcagaccacgaggagaaaacgaggccttcgtcgtcttatcgcgcgggggcgttggacggcggcagcggcagccccacgaccttgccgcagcggagggcgttgtcgggcatgttgtactcgtcgcgcagtgatcgcgccggcgagacgacgctgatgtagaactgctccccgaggtagtaccgctcccagatgttggaatgcacgctccacatgcccgcgttgtcgaacgtcagcatgattgccgtccatgaccgcgggtacacctggatcgtgtgccggctcaccgtg

SEQ ID NO: 11106 - DNA, 639 bp, Zea mays
  Clone ID: cC-zmpo14820023d01d1
ctgaattcctgggtcgacccacgcgtccgctcgagaagttgcagctccccacaatggaaggtctggctaaaaaactaaactctgggagcaagatcgagtctgctattgttgcatgtcatccatcagaagcacctactatgactgccagctggtttaactccaagtcaggaaagaagattcctttgaaatcagtcacttcaatcgtcgatgggctaaagaaatcgtacattgagaagttgaggcccttggaaaaaacctatcagttccatgacttcgtgtctcccttgctgactagcagcgatttcgatgcgaagccaatggtcatgctgttgggtcaatactccacggggaaaacaacatttataaagcatttactaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggacagcatttttgtccaagttcgaatgttctcagatgccacatccactgttagagcacgtgaacttcgtggacactccaggagtttatcaggggagaatcagcggacgcagcgc

SEQ ID NO: 11107 - DNA, 638 bp, Zea mays
  unsure at all n locations
  Clone ID: cC-zmpo14820023d02d1
ccacgcgtccggccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatatcatgaaggaggacgactgcaactggcctgagcccgaccgcatcggccgacaggagctcgagatcgtcatgggcaacgaacacatttcattcaccacttccaagatcggctccctcgtcgatgtccagtccagcaaggacccggagggactccggatcttctactacctcgtccaggatctgaagtgcttcgtgttttcactcatcaacctccacttcaagatcaagccaatccagtcttgagctccatctcaagccttcatgcgactggtttggagtgttctaagagagaaccttgtaccatgtnaagatgatgttgagcttgtgacgatgcgcactgtagaagtggaccctttttttttt

SEQ ID NO: 11108 - DNA, 289 bp, Zea mays
  Clone ID: cC-zmpo14820023d07a1
caagaacagagagcattccaattatatgaataaacatacccacagaatctggacaacggtggcaatatatcacaatttcagaaaacaataacacacacgactgtagatacacacacaagctaataacagcagtaaggaaaatacggcagtacatgaatatacatacttaaggtagtaggattgtaggaatacgtagtcgcgatttgtgtaccataggagcgatgaaactgaaacgctttgcaccgatgagttggcgtccagatcaggcgtgctcctcccggacgcgtgg

SEQ ID NO: 11109 - DNA, 302 bp, Zea mays
  Clone ID: cC-zmpo14820023d09a1
tcctctagagcggccgcgctcatggcgggcctcgcgcccaaaaccaaggtgctcagggacggcaagcggaaggaagaggaggcgtccatcctcgtgcccggggacatcatcagcatcaagctgggtgacatcattcccgccgacgccaggctgctagagggcgacccgctcaaggttgaccaggcggcgctcacgggcgagtcgctgcccgtgaacaagcacccgggccagggggtcttctcgggctccacagtcaagcagggcgagatcgaggccgtcgtcatcgccaccggcgtgcacac

SEQ ID NO: 11110 - DNA, 468 bp, Zea mays
  Clone ID: cC-zmpo14820023d10a1
tcctctagagcggccgcggtggtgtccttggccgcggcgctaccgctcccctcggagcttcccttgtttttccggcggttggacttcttgggaacggcggggaggtcctggcatgtgcccgaggcgtcgtcgccggccgacttgtcctgcttcttgcggttctttcgggtgcccttcttgctcttctctgctgggaaaccttaaaactctgttaacaagattgtccaagaatatgttggcaattcttgttaactggttctcaagcttcctcaatgggccagtgccattttttctccctgcttctcaatctctttcttttctttttttttctgaaggctagctcagtatttgcctagcctcaggcatcgccaagctatgattcagaaacctacactgaccgcagcggatggccctttgcggtcaatgttgcttggagggttgggtgagaaggggagatcggacgcgtgg

SEQ ID NO: 11111 - DNA, 420 bp, Zea mays
  Clone ID: cC-zmpo14820023d11a1
cacccgacaaatttccttctttttaaggggaaactgtccatttttgggactccaaaaccccttgcagcaaacttgcaaaacatcctaaagggaaaaaaaaaaaagagactattgcccccaaaactttcaacgggttatctatcgacaaaaaaaaatttagaagggctttcattccttaatgaccccggttttctctggttcttttaaacaactccaaaaacggggtttgctgtggggaacccacaggatttcctgacaaacgtaaaacttgctccagtttatgctcctttgccgaaaccggtttaacaagccctttcccggagggagtgctgtcccctgtagcagcagcattctgaccataccttgacaagtccttgtctaccgctgcaaagcctgccgtcccttcgtgatggcccaaac

SEQ ID NO: 11112 - DNA, 448 bp, Zea mays
  Clone ID: cC-zmpo14820023d12a1
catggcccacaaaagttcagcaaaaggaaccaaattaaagaatcaaccaacaacgacgacacacacatacgcacaacatgatctgagtacattttaacaagaacagatgaaccccaacggacaacaaacgcacgcacccatagatttcagcatccacgtcccaatccacacacacaccccttaccggccagtcgggtgaacgagctgcgagaacaccacgctgttggcgatgtcctcctcgtccatgtcctcgctgatcagctcgagcgccgcatccgaggcagccatgctgtcggccatagacacggtgccactgtcgctcgagctgcctttttcaccctccggcttcccgccgttctcgaaggtgtcctgcatttgcaacgcgaactcgaggttccacagcacgttgcccatggacggccggtccactccatggtcacacaggcac

SEQ ID NO: 11113 - DNA, 197 bp, Zea mays
  Clone ID: cC-zmpo14820023e01d1
ccacgcgtccggctgcgcagggagctgtcgacggcgtcccgcgccgagtttctcctgtgaccgggcttctaggtgctttttagagtctagaagcggtggaactcgggtttctgtgcctactgcggaaggattctcaagcgttctctggactctggtggaggagaaagaaacaccgctgatgtgaaccatgtgatgtc

SEQ ID NO: 11114 - DNA, 555 bp, Zea mays
  Clone ID: cC-zmpo14820023e02d1
ccacgcgtccggcgagccggagagcctgcccaagtacgcgcccaacaaggagatggacgctaagctccgagaagaatctagaaggaggagcaaccttccgagccaaggcggcgaggcggataagggtctgtcgagggggcacaagagcatgcggctgcaggacacgaaccagagccacgtgcacgccgaggaatcgctgcccgttgtggccgaaaacggggtgacaatggcggggaacgacggcgactcgcggctgttcgtcgacctggagcccgttccggccatcagcaagcggcacggcggcagcgtcggcggcgaccacgcggcgccgtgcgccagggctaggaccatgtccaccagcttcaaggagccgccttgtgtcgccgaacacctccctctctctggccccgtgcagctcgcggcgtccaccggcttctcctgggccaagaagccccggcccgacgccacgacggcggcggtaactgtgacgatgcggagcggctccatggtgccagggaccaacaggaacatcaacagcggaagatgagacggagc

SEQ ID NO: 11115 - DNA, 335 bp, Zea mays
  Clone ID: cC-zmpo14820023e06a1
acatactggaggggtcaattttcggccaaatagttcgacagtttttcaggcacgcactttctggccggaaaaaatctctagcctgatttcatgaatcaacagcacgggcagcttcatcacaaagcttaatggttgaaaggggaaagaagaaagaaaaaagggcccttctggaacaacaacaccagccccagtcgttattctacgggagcgttcccgtcgagggggccagcgagccagccagcccggagcatgaacgggggtcgggggagtcagtttccttgcggagcaacagccagcgtctactttgagcattagggtccacagccagaagaaca

SEQ ID NO: 11116 - DNA, 386 bp, Zea mays
  Clone ID: cC-zmpo14820023e07a1
caaggtatcgggtggcattgcccgacacgtcagcttctttggaagggtgttccacagcagctcccaagtcccaactcccaagtcccatcccaacagcatgcatgccaatgccaccgtacaaggtcggcttctctcttacacggcctcctcgtcgtaccctacgtagtagaagtagacacacagaaggcatccagacggagctagtaggtacatgcacatgcaggcccagttacccgtcaagctgccatgcacacgtgtattattttgcatccacgcacgcacgcactcacgcatgtatgcatgcaaatggtggcggtagccggtagtgattgactagtacgtagcacggtcagaagtcagaagtcagaagtcagacggacgcgtgg

SEQ ID NO: 11117 - DNA, 508 bp, Zea mays
  Clone ID: cC-zmpo14820023e08a1
gacccaaatcataggagttccatttaggtatcaaaagtgttcaaaaaacgccacaccacagtaacaatggcatgttcagtttcttttgttcaccacgataccatgttaacaacaacatagacaaataaataaacacgtatatgtataggccagcgagggcgtgagtccatcccaggaagtactccgtattttgtaggagtattacacaaggttttgccggagcagtggctgcaccttaccaccagcatccgcgttactgtcctgtgccttccataggtccttgaagaggccgtgctacttttgatgctgctgctctggtttaggagtcgaaacagaatcggtcaacacgcctgatgcctgcacgggtagcttcaacgcatttgaagatgaattctgcacgtgctgtaggcacacttgcacggcgttatgcactcgcacaaagcaccacccagctcctaccaagtcaatgatgcccgatcttgacaacagaaggtacacttgccggttc

SEQ ID NO: 11118 - DNA, 430 bp, Zea mays
  Clone ID: cC-zmpo14820023e09a1
gagagcatatactagtaaatgtccatcgcatttcaattagctgacaaacgacccaaacaatacaatagcttctgcttaatattgcagaacactggagtagcgagttcaccacgagagcagcaagacacaaacgagaagaaaatagcggcagagcacagggctcgcaatcatatacggccctttatttaaccgaccacggactcacgggaggacgaggcacccttcagcgacgggcagaggggtaaccttgacaggaacataggccgtagggccctcaccgtcgctggcttcctcctcttcctcatcatactgaaccaggccagcagcgctgaagatgtacgccttcacttcctcgaagcgctcctcggagagagagacctcagcgaggagttttcacgcggaggtttcagatgcctccttatagtccatc

SEQ ID NO: 11119 - DNA, 352 bp, Zea mays
  Clone ID: cC-zmpo14820023e10a1
tcctctagagcggccgcagcggtggccgtctccacctctgtgtgcacgtcctcaaggcctagcacaggctgtccgaacgtgaggccccaggcccgtccgctcctaggcaggccgtcgccgcgccggaggctgcagacggccttggccgcgacgggcaagacgccgggcgaggcggaggagcaggtccccgcgtgggccaagcccggcgcggacgagccgccaccctgggagcgcgagggcggtgccgcgcgtggacaggatgcccggcaggtccccttctacgcgtacctgctcgcgtccacgatcaccgcattggcgcgatcgggttcatcttcggagtacaccaaccagg

SEQ ID NO: 11120 - DNA, 205 bp, Zea mays
  Clone ID: cC-zmpo14820023e11a1
ctattaatagttccttctagtacttaaaaaaacatatagcgaagcaccaatttaaggttgagcttattaaaccccaaaaatataaataaaaattagaaggaggaaacgaaaacatcaaacaaaaggaatacaaaggactgccattatcatacccaaactgagctaaccgaccaactcatcggaaatgggcggaagaaaaaaaaca

SEQ ID NO: 11121 - DNA, 307 bp, Zea mays
  Clone ID: cC-zmpo14820023e12a1
ttttactctcaagcatgccctttattcatcgaatcaacgagacaaaaaattaccgcaaatgcttatttgcgtgacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatgatgtatcagtgattcagtgtcacgcaagcaggcagaagacgacgaccggcgggcgtgctctgcgttcaggaaggaggaggggtgcaggcggacgcgtgg

SEQ ID NO: 11122 - DNA, 600 bp, Zea mays
  Clone ID: cC-zmpo14820023f01d1
ccacgcgtccgccactgccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgacgactacctgtatggcgagtccctatacttactcatacataagctgcgccgccgtgtcgtcggtgcgtgcaccgcgcagtagtgtgcgtacagcggaagctgcgactgcgagcgaggtaaggtgtggggtgggtgactgggtaccaggagtggggtacggtacgtaagtgccacgttggaggctttggcgtttgctcagagcctggcaggagatgggtttgatgttctgctgctgagttactgttttctacacctacagaatgtgctatgatctggactggtataattttaacg

SEQ ID NO: 11123 - DNA, 652 bp, Zea mays
  Clone ID: cC-zmpo14820023f02d1
ccggaattcctgggtcgacccacgcgtccgcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgagaaggagaagccatcagcagtccatgcagaggaaaatattgccaccaacaaggtggcagccgagcccacgacagaattgaagaaagacaccgaggaggagatatagatggagaaggagaagccatcgctaagctaattgactgcatgtcaattggctgatgcctgatgatcaatgtgcaagatagagatcgaccactaattggcatacatggttaagtcgggagagagactcggtcaccttgtaacaaaac

SEQ ID NO: 11124 - DNA, 493 bp, Zea mays
  Clone ID: cC-zmpo14820023f06a1
ttttgagacagtgcagagtatcacattcagctgcagaaaatgcaacttttaccgcggcataattctgcagcttcttatgcctaaacccactaaattgaaccatcattcatggtacgacacaggaacatggaagacggaagcaaaacagaacaggaacgaagacaaccgggaacaacaattttggaactatgatattgaaattttataacctaaatggccataaaagaaagcctatgatgttgtacaactgacgggggcacgaccatattcaacacaccttcccctttctgaccttcacatcgcaccatgctattcatctgctgctccaaatttgcagatagaagggaaacgaatcaactgctttcctccacagggcctgtgttcaggtttgcacttccttcaaccttggcggtggcagcggatcccttttcagctgaagcaccctcagttttgggggttgtcccactgttctcagtattcttcaactggacgg

SEQ ID NO: 11125 - DNA, 474 bp, Zea mays
  Clone ID: cC-zmpo14820023f07a1
ttaaaaccaagttagttaaattttgcaatattgtcttcgaaatggcactgcctacacggagtgactgtgacaccgtactcaccgagcagctgtactcaccgagcactgtctagagtagtttacatggagtaagagaacactggcaccggcggtgcaaaaaacggcacacgggtacatgcagaggccgccggtcgatgatgcaagacaaacagctagcactgctctgtcggttccggggcatgcatggcgatcgcgcgagcggatgcgcgtcttcctcttcagagagctcgcgccctgacaatgtccatgctcatctcgctggggtcggtggcctgcagctccagctggatgccctccagctccctcttgaaccggtccttggagctcgcgtacagcatcttgctcctgaccctcgaggtgtccggggaccaggagatgaacaagatcttgctcttctggcaagtctcgtcggtg

SEQ ID NO: 11126 - DNA, 507 bp, Zea mays
  Clone ID: cC-zmpo14820023f08a1
gcagaaacgcttttcatgccctgcattttatcaaaagtagttttgtttctcgtagccatgagacccatcaaatcaaattaatgaagcacccatcaacaattagcaagaccgatgaactagcaaggcttcttgcagaagcacttgcgcgtggccacgacctgcttgcactcgccaccgggaaagctctccttcatgcacacatcggcgcatctgtcgctgttgaagcagaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggagaaacaagaataggacagctccctgagacactgccatccttctctcgttttagcaagaacaggaacggcttgacctgctggcggccccaccttgatgggtgggtgac

SEQ ID NO: 11127 - DNA, 179 bp, Zea mays
  Clone ID: cC-zmpo14820023f09a1
acaggcattgagagctcaacatttgatattattcattgagaacaccacatgtatttttgcaagtagcctcatcaggcatctcattaaaattgaataggtcgaacatgtgtccaaaatgacaagtgagaagcattaggtagcaacaatagacattacagtcttgatgaataggagaaagc

SEQ ID NO: 11128 - DNA, 290 bp, Zea mays
  Clone ID: cC-zmpo14820023f10a1
tcctctagagcggccgccaaacatgggccgcatgagcgcgtcgtcgaacttgcgccagtagtagtgcaccgtgtgggttggcttgcttaggagcatccggaggctggacggcctcacaatctgtgccgaccccgtctcgatgtccgagccctgcatgctcgtcaggagaggcgagtgcagggacttgggtgaggacggctcggaggtggccgtgttgctgcaggcagggagcagcagccggatcaatggcttcgtcatcatcccatacaccatagtgctaaacaggaccc

SEQ ID NO: 11129 - DNA, 354 bp, Zea mays
  Clone ID: cC-zmpo14820023f11a1
gaataagttccaagattgggaggcgtcggtctaataataattacatcggttggttttgggatgatccaaagaagaaagaaaattcaaaccagcggattatatattcggtggagacttgagagtacgtgagaaagagagaggttacgaagagggattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcagttgagcgtgcggacgcgtgg

SEQ ID NO: 11130 - DNA, 516 bp, Zea mays
  Clone ID: cC-zmpo14820023f12a1
tttttgaatcaagcactctgttacatttttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtagccgagcgggttggcggggcgcaggctgtcggagatgccgacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggacgcgtcggtgaccccgtcgatggcgcgctcgagctgccggtgccgaagtgcctgcactgcagcctcaccttggcgcccgcgatgtactcggtgacgttggtcacgaaccc

SEQ ID NO: 11131 - DNA, 251 bp, Zea mays
  Clone ID: cC-zmpo14820023g01d1
ttcccggtcgacccacgcgtccgcggacgcgtgggcggacgcgtgggcggtcgagagcacatcgtgtaccgtgtctccgcagcgtgcgcgcgcgcgtggacggaggctgccgtcgctcgcgtcgggcgatcacggtccccgacggccagctagagcgagggacaacgaccgtcctaccgaccagctacaggcgaatgaacagaccaataccagttcttcagaaaatgcaccgctggatcattcctagctgc

SEQ ID NO: 11132 - DNA, 309 bp, Zea mays
  Clone ID: cC-zmpo14820023g02d1
ccatcgcgtccgtatacctagtatataatatatgcatgttagtcaattggttcagatgcaggtcattttttagtaatgctatcaagaatcaactcataaatcataacaaatgtcgaagtctatcatttgaaacaaccaaaatttgactcaatgccattattaatcgaaatagacaaatccttggttgataatataggatatgatgatgtaccatggccttcatagaacaattttgtattgcagggtgaaaaattataaaaagctatattctaagcatatggaaatggaatggtaagttgggattttttc

SEQ ID NO: 11133 - DNA, 233 bp, Zea mays
  Clone ID: cC-zmpo14820023g06a1
acgtaaaacaactgaatatattatgcgtaccgtctggatctggagacatgaatatatgaacagatgaattaaatggagacatgcatgcatgaaccaacagatcggagacatgaatcaaaccccgacgggctggctggctggtcgacggatgatcagcgccccatcccctgcgaggccggcgggcacatggcgacgccggcggcggccctctgggcgttgaagcggacgcgtgg

SEQ ID NO: 11134 - DNA, 374 bp, Zea mays
  Clone ID: cC-zmpo14820023g07a1
aaaacccagggggcccttcgttaacaaaaaattttacaatccccaggggctgggaaaaacttttttttgccccaaggttttggcagccccaacccagaacccccaacgctccaaaaaagggccctttttgggaaccccaaagttgcccccccgataaaaaaccccagcccggatccctcggcagcggggaagccccccaaggcaataggggggttgccaaaccggttggccccaagggggtccaaacccttgacaacaatccccttgtggggacggaatcccccccttttttgcccccaagggggggccccaaaagccattttggctacacccttgggagggttttcccccccgacccttggatccacccattg

SEQ ID NO: 11135 - DNA, 486 bp, Zea mays
  Clone ID: cC-zmpo14820023g09a1
caacctgtattgaaattattatgtatgcaaggcatgctatccgcaccgccttctgtctgtacaaaattcttgagtacaaagaacgtgatatacacactaccggttgcgctcatcctgtactcaacccactagcctggcaccatcagtctccgtgtatctcaggacatgtcagacgattaccacctgtgtccgataaatcttcactcaaagttgtgtgtagaaaatggtcgtgtatgttgaaatggtaacgatagccccattggggacgtgtgttccatggcacgtttaaggtttctttgcttgtacctttttcaggtattttttgtgaagtttcaatgctccagcgcatgctttcttagcatctaagttcccatttacatcgttcattatcctgataagaccatccagtcctctggcttttggaacagcttttctctcttctccttgaggacacttgcaaccatgaagactgaaatcggaaccgga

SEQ ID NO: 11136 - DNA, 259 bp, Zea mays
  Clone ID: cC-zmpo14820023g10a1
tttgttttttttttttttttgttttgtgcttttttcggggttggggcattattaagaattcggttataaagaggccatgcacggcgagccagcaggggacggcgcgcaaccaccgccgcgagggggccgcagccgccaagcccgcccacaaaccgaggggcgactccgggcccgcccgggcagaacgcggccccgccgcgaggcccgagcggggcggggcgcggggggcagcgggcggagcgccggaggggcccccggc

SEQ ID NO: 11137 - DNA, 441 bp, Zea mays
  Clone ID: cC-zmpo14820023g11a1
tcctctagagcggccgcccaccttcctggacgtcgaccctggctgcgacaggccggccatctggtcggcgtcgatggagctgatccgtatcaccgacgtgctgccgctggtgttctgcgggttgttgaactcggagcacgtcttcctgatctcgccgtccttccccgtgagaaccttgagggcgctgagcttctccatggccttggcgaagatggggacgaagtcggtagtcttgtccgacatggccttcactatgggctcggtcgtcttgtccatccccagcaggcggtcgatggtgaggggcatcttcttctccagcaccaggccgaagtagctcccgtccatgtcgttgggcgaggtggagtccatggggacggagcccgagtccttgccgtcgcaagcgtcgctgatcttcttcttgaacgcctcgcggacgcgtgg

SEQ ID NO: 11138 - DNA, 580 bp, Zea mays
  Clone ID: cC-zmpo14820023g12a1
gcagcttaatactgataatatttctcaattggagctacacagtgacagctacacaatcctgcaacagcgagcagtccgatagaaccttgaccttacctaagatcaaaagattaatcacaaccgacctcacatttctattcggtttgactgtttgaggaatggatcagcacattctatcaaatacaagggcttttttcatctttgtctatggaggaactctcctcgtacgtacgatcagtctcattcttgagtcatcacagagcaagtacccattatcccttgccttatcacaacattgttaaaccattccttgctaaggaaatcttcgtataattatgatggaatcatctcaaccctgatctgtgacactctaggacagcaggtatattggtcagaagcttccttagaatagctcaccattcttgatcaattgcaaaggatagtagccatctaaatcttgcaatagagaagcgatcaaaacaaaattatcactgctcaaatgtcgattttcatgcaaaaaaatgtaatgcccgactgccataagtcaacagatcatctatttttttggaggtaccaccca

SEQ ID NO: 11139 - DNA, 572 bp, Zea mays
  Clone ID: cC-zmpo14820023h02d1
ttcctgggtcgacccacgcgtccggcaactgagtggttcggcagccgagaccaaataacatttttaccttggtgatgactcggtaggagatgtaggcctgcacgccggtgcccatcttgacgggatccatgacagatatccacaggaatggcgcccccgccaccgtctgcgaccgcgggctctgtgacgaactcctctcctgcgagagccccgtatacagattcagcaccaatttacaaccgaccgaaccaatcgtcaaaagcgcggcatatgagatgatgcgggggagcgggcatagcggttaccggcgagatcatggcgagcttcgcggtgaagccttctctcctccctggtgcgggacggcgaagcgacgggaagaagaggacagcttcagaagaacgggaaaaggaccatttttcccctcgattggattttatttttggaacatttggatctataccattaaaagatccaaactttagatatattccatggaccccacatgtcattgactcatgtggacccacttgtaagtgagatagtaatggtctggatccaaagggatgatcttt

SEQ ID NO: 11140 - DNA, 369 bp, Zea mays
  Clone ID: cC-zmpo14820023h06a1
gcagcccccggggaaaaccgggcccaaaacccctttggccaagggcccaaggtcccccgttcttcgaaaaaaaaaaaggggacccaaggggccaattaaccccccctttaaaaccccgaaaagggccatggggggggccccccccgggtctgaaaacccttttttaaccttagcccctcaacgggggccccagtcccgggggcccccgggggtttcaaaccaggaaccccgggggggggaggaatttttccccaccccccggggcccccgttcaatctttttgaaaaggcccaatttcccttactggcccccccatagggggcctttttaaaacccgacccccgggggggggccccagcccccctggca

SEQ ID NO: 11141 - DNA, 486 bp, Zea mays
  Clone ID: cC-zmpo14820023h07a1
ttttagctctcattgaaacgtgaccacaaatcaacattaacattatggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaagttgttggcgcagttgagcgtgatggcctccggcgtgttggaggtgccgtggatgttcttgaagacgacgtcgttgacggtcacctt

SEQ ID NO: 11142 - DNA, 552 bp, Zea mays
  Clone ID: cC-zmpo14820023h08a1
tcctctagagcggccgccaaggttcctggcggggtggtcgtcagcgccggagaccaggataggtccggctccggcccgaagctccgcggcagcgtgggacctgtagtgaacccggtcccggcggcgcccggcggcgccgaggaagctgccaagcaggaggcggtgacggccctggaggagaagaagaagaggaacatggccaagctccgcgcccccggtcaggccaagctgtagatggatcatcgtcggagtaggtgttcgggccttcgggctgccactgccactgtgccaggtcacccaagtcattttttttcctcactgtctctttcgtttgtgcaagaagggacgagcaaagtacctaccgcagcggattactaaattgtataattacgcaattgtcgtgtcgagtttactaaagatgaccacaggtaccttcttggtgtccccggtcggtcaggagaagtcctgtcgaggcatgctcaagtttagtatatcggctttgcttaataattgtctgcgtgcaaaactacgtgagaatgtggtgatgaatcg

SEQ ID NO: 11143 - DNA, 402 bp, Zea mays
  Clone ID: cC-zmpo14820023h09a1
atatatatatatatatatttatatatatatatttatataaatatatatatatatatcacaattgggaggggcgtggcaatgtacagaggggggctttattatggggggtgggaatatgccacagagttggaaaccaaaagaaacgaaactaaaaagttaaacatgggagaggggtaaacgggcgggattatccggaaacagatttatggtacctacgtacccctttttcgcacggggcgtacaagcatacggtgttatcaatccacattggggggggtaaacgggcggcccatttggttatgggaaaaaaaaccgtagtttttgagtaggctccaaaagacccaaaatccgggtctattgttaccctcaaactggaccccggtaatcggacaaaggcgccgg

SEQ ID NO: 11144 - DNA, 371 bp, Zea mays
  Clone ID: cC-zmpo14820023h10a1
tcctctagagcggtcgtcctttttttttttaaaaccttgttttttaatttttggaatcaagcactcggaaacattctgtatttaccttgtgtccctttacttcgcgcagatcctgctattcatgccatgcgtccgctatgtatcgttgtaacttggtgcaacatagtccgtgacaccggcggggtataaaacactggccgtcgcctgcgtacgagtccagctgcttgagcagcacggagcactcggggagcggcacctccttgaaggcacccatcgggttggcgcgagccatgccgccggagatgccaacgttaccggggagcctgacaccggcacggttccctgagctccgggacctggcctgaaacctt

SEQ ID NO: 11145 - DNA, 470 bp, Zea mays
  Clone ID: cC-zmpo14820023h11a1
gaacaacaacatatctccattgcagcaaacaacatgtgagcctaaaactcggaaaaagatcaatacaatgtgcagggaaaacaacggcatgcagctaattcccagcagaatcctcggtggcggtgcgcctccttagcttggcgcgcgtcacacggatcgtctcctccatcagcgtctcctcgagcgcagggtcaagctcttccgcgccctctgcagcatcaccactgacctcatcgattgccatgttgcctacttcttcggtctcagaaagtggcggggcactaggctcggattttggagaatctgcacttgaggctggagtttgaactgggtcgacagcaggtttgacctcacctttctttgggctaccgccaggttttggtgtggatgcagctgctgcaggctttgtggatgccaccgaaccaggtcttcctgatgtttgacccttgatcttgggtgaagatggaacg

SEQ ID NO: 11146 - DNA, 337 bp, Zea mays
  Clone ID: cC-zmpo148069b01a1
ggccaaaggacttttggagtttttccaggagaaacagccaaaggaatgcaaatggggaaggtacaaatgtcagcccttctggtttccgacccctttgtttgcaagtttcagtcattgcacatacacacaaacatgtgtgctcgcgcgcgcgagcctgtgtgccacctcactatatatgatgtgatgtttgccatgccatgcggcctttaaaacttgaaaccaagcatgtgcggtgcgcctgtttacttgagccacatggcgccgttgatttacggcctggtggtgaacggttcggcctccttccgttcgatgacggggaagccgggccaggtgaccc

SEQ ID NO: 11147 - DNA, 372 bp, Zea mays
  Clone ID: cC-zmpo148069b01b1
ccacgcgtccggctcgtttacgtgaggggcgtgtccgtgtgcatggggacctcgctgctgaatccaactgactgttacacccactacaagacacactagtcgatcacccacgacgatcgatattccacaactggttgttctccagcaccagcaacttcatcatactgaactggactaaagcacaacagaactgcatcatgatcacacagatgtcaatggacaaggaacagaactcagtgacggaacagggtggctgcagcccaaaacatgaagctcgatcctggcttccaaaactgccgcctggtgcccgaccagaagctgttcccggaccgcttcaagatcccctcgtacctgggccgcccctggaaggag

SEQ ID NO: 11148 - DNA, 365 bp, Zea mays
  Clone ID: cC-zmpo148069b02a1
ggggggagaaacccccccccaaaaatggggcccccccccccaaaccaattggggttgcctttcccttcccaaaaacaaattggaaaccccggggaaaggggtttggggttaaaggccaccccatctggaaaaacgggggggggggggcaaaacccggctaaaaaaaaaagggcggggcgcggaaggggctaataccggggggggggcggccccaagaccaactgttggggaaaggggggcccaaaggggcccgcccccccccttggggaaccccccccgccccggggggccaccccgaaaatcccggcccgggcccgggggggcccccattttccctttagggggggcgattaaaagcgggggaa

SEQ ID NO: 11149 - DNA, 402 bp, Zea mays
  Clone ID: cC-zmpo148069b02b1
ccacgcgtccggctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggctgtaccaaattctgagtgctggattcttgctaaaaaaaaaaaaaaaatgaaaataaccaacaaattaaaacatcataaattaaaaaaaacattaaataacaaaacttaaatcccatataaaacaaaaaaacttaaaacaagggggggg

SEQ ID NO: 11150 - DNA, 357 bp, Zea mays
  Clone ID: cC-zmpo148069b03a1
ttttgttttatattttttttttttatttggggataattaaaatttttttagggatttaaaataaattaaaaaattttttttttttttattattttaattatttttaaagaaaaaaaacacaaaccccccggaaaaggggggggcaaccagaaaaaaccaggcggaacccaggggggggaaaaatattcctaaaaagggggggaaaaaaaaagggggaaaaaaaaggaaaaaaaactgcccggggaaaaaaaatatttgggttaaaaactcaaaaaaaaaaaagggggggaaaaaaaaaagggaaaaagggggggggccaaaaggggggagaaaaaaaaaaaaaaggggggggggcaa

SEQ ID NO: 11151 - DNA, 324 bp, Zea mays
  Clone ID: cC-zmpo148069b03b1
ccacgcgtccgggtcgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaaaaggggggggccgttttaaaggacccaagtttacctccccgggtaggaaaagaaaaaatttttttttgggggccccaaaattaaattaattggccgggtttttaaaacgtgggaacgggaaaaacccggggtttcccaaaataaattccccttggaaaaaatcccccttttccc

SEQ ID NO: 11152 - DNA, 417 bp, Zea mays
  Clone ID: cC-zmpo148069b04a1
gtatcaaacaaaagaataatttaggctcagcatgatacaacatttcatgactcacataagttttgacaaaataaataattaaaccctcgcctaattcacttacttttaatcaaaaggaaaagatagagagagagacaagaggtaacacctgaatttggtttgcatttagagaagaaattttataccctaaaattcagggtgttacaccgtcgaacataatatagctgttggatgtttgtcgttttactgttgtgcgttaccaatggatagcaactaatatgcaatgcaaggacgagagaaaaattataactagagagatgggtcagtccacggagggtctagaagcatgcaagctccttgaggcaacccttggtgctgcccttggcgttcgtgcatatagccatggtcttgttgttg

SEQ ID NO: 11153 - DNA, 336 bp, Zea mays
  Clone ID: cC-zmpo148069b05a1
tcctctagagcggccgccctccttttttttttttttgttacgaaacgggtcataccacatagtagtgaaatagaaatgttcggagaacgatcctgggctgatgaataatagtctgaccggacagcgattaattaataatggagacaacatccacagtaagcccaactagaacatggtggttcatcagaagaactccgcggaggaaaataatgggagacatcgaaagatagtttgttacatggagcggccggccgagagtgtttattccgacctatggcaaactgtagagaattcaagggtcaaatgcttggttgaacacagggttacacactgaac

SEQ ID NO: 11154 - DNA, 418 bp, Zea mays
  Clone ID: cC-zmpo148069b05b1
accgcgccgtaatttcgtggacccacgcgtccgcctactcgtgcggacattcaagcacctgctcttcccccggcgggcaacaactgagtcgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggcggaggagcccgctgcggcggccgacgttgagcatcagaaggctaatgaggtgctcgctccagaggcgggccgcgccgagcccgaccacaaggaggaggaaagccgggagaaaacccgcgtcgaggaggagaagccagcggcagcagcccatgcagaggaaa

SEQ ID NO: 11155 - DNA, 313 bp, Zea mays
  Clone ID: cC-zmpo148069b06a1
ggggggagtacaccattctttgcattagccattgaggtgattacatcgttattttggcagccatgggcatatttagaggctaacatgttctttgatgtcgccgagacgggggtccatgatcttcgagacagcctgcaagaagacaggcttgcattcttctccccgttccggcgcctcacggacgatctttttgatgggggactccttgggcagggtctctctgcacatgatgctcccgatggggaagggggggaggccccttttcacacccttttttagcagaatgggggcgacgcgcagcgtgggcgcgcac

SEQ ID NO: 11156 - DNA, 368 bp, Zea mays
  unsure at all n locations
  Clone ID: cC-zmpo148069b06b1
tggtacgcctcctggaggtgccggtccgttattcccgggacccacgcgtccgccgtcngttgtcgacatcgtgatctacctgacggcgccgggcctggccgtgttgccgatgcgggtgatggcgtccgactccatcgcctcggtgaagctccgcgtgcagacgtcccggggcgtgagggcgcgcaagcagaagctcgtcttctgcgggcgcgagcttgcgcgcgaccaacggccgcatcctgacttccggtttgcgggccggctacgtggtgcacctggtcatccgcgtcccggacgtgcgccttatcaccgtggagaccgtgcagggcggcaagctcaggttccgcgtggagcccgggcgcaccgtc

SEQ ID NO: 11157 - DNA, 405 bp, Zea mays
  unsure at all n locations
  Clone ID: cC-zmpo148069b07a1
ttaatgaaaaccctgagctttcattagctcgtctatatatatatataagcaaaacatctcatcagtaaagagattagagattcgtgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctccttccccatcttngtgtacgagtagacgacccgggaggagtccccccaggcg

SEQ ID NO: 11158 - DNA, 422 bp, Zea mays
  Clone ID: cC-zmpo148069b07b1
ccacgcgtcctttctgcttctacgaggactgccgcatcgagtcggtggtcaaggaggtggcggtgctgacggcgcagcagcgttccaagtccatcgagggcgccatcgacaccggcttctcgttcaagaactgcagcatcggcggcgtcaagggcggccagatctacctgggccgcgcctggggggactcctcccgggtcgtctactcgtacacgaagatgggggaggaaggtggtccccgtgggctgggacggctggcagatcgccaagccggagagcagcggcatctactacggcgagttcaagtgctttggccccggcgctgacgccaagaagatgaagagggtggggtgggcgcttgacctcaccgaggcgcaagccaagccatttcgtggcacacactaccttctcggcgacacgtg

SEQ ID NO: 11159 - DNA, 438 bp, Zea mays
  Clone ID: cC-zmpo148069b09a1
tttaagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggaggcgctggttccggcggttgctcctcgtcagccacgtccggcagaacctcctgagacgggctcttcttgttcatgtggttgtagctccccttctccatgaa

SEQ ID NO: 11160 - DNA, 413 bp, Zea mays
  Clone ID: cC-zmpo148069b09b1
ccacgcgtccttcctcgcgtccgcccacgcgtccgcggacgcgtgggtcgggattgtgggcgagtgcgtgcgttcgtgcagccacagacaggcgttcgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttttccaagaactttacgccaggtggcaagtcatcagacaagggtgaactgacaagggccccaagcaagctgtcggctgattttctgggacccaag

SEQ ID NO: 11161 - DNA, 306 bp, Zea mays
  unsure at all n locations
  Clone ID: cC-zmpo148069b10a1
cttggactcctctagagcggccgtcctttttttttnataatttccgaaacgttgtcttacttaattggggggtatttttataatatgtgaacgaccacgggatgaggaataagtatacagggaggggtgccaaatggataccggagtgcgcatccacagatgggtccaccccgaacatggcgccatagcaaaaaaaccagatgccggaagataccccggggcatcgcaagatacaaagttgcgcgcccacggggggggacaaagaacttcacgacctaaaccagactgcagacaaaacaagcgttt

SEQ ID NO: 11162 - DNA, 249 bp, Zea mays
  Clone ID: cC-zmpo148069b10b1
ccacgcgtcctttcttggcagcttttcgcctcgtcgtacatagtctagtttctcatgactgttttagatttagcacagaaatgcagctgctgtctgcacgactgttgcagctatgaagctgtatgtacctcactgttggtgcactattttagctattgctaatcacaggggatgcaatcggcatctgtgttgattactatggggacaaatgaggcgtggaaccaattctacaacgcaaacttgtaacca

SEQ ID NO: 11163 - DNA, 416 bp, Zea mays
  Clone ID: cC-zmpo148069b11a1
ttaagatggtgttcatttcaacttggattcaaataattatgtacgcagagcatgctacccgcaccgacttctgcctgtacagccaacaaaattcttgagtacaaagaacgtgagatacaatacaatacaaactaccggttgcactcatcctgtactcaacccactagcctggtaccatatctgagaacatgtcagtcgtctaccacctttgtcctgtaaatcttcactcaaaagtggtgtgtagaaaatggtcgtgtatgttcaaatggtaagaataacccattgggtaggtgtgttacatggcacgtttaaggtttcttttcttgtacctttttcaggtatttcttgtgaagtttcaatgcttcagcacaagctttcttggcatctaagttcccatttacattgggtaaatatcc

SEQ ID NO: 11164 - DNA, 325 bp, Zea mays
  Clone ID: cC-zmpo148069b11b1
ccacgcgtccttggaaatgaagctgatgaatctgcagaacgcattaccgataagcaaattatcgagtggaagctgacattacatcaaattgggcttgacgtcctacggactgatcgcaccatggtattctatgagaacaaagaaaacctttccaaattatgggatattctagccgcgtatgcatggattgacaaagatgttggttactgccaaggaatgagtgatttgtgctcaccaatgatagttctactaaacgatgaagcagatgcattttggtgctttgagaaattgatgcgtagattgcgaggaaatttcagatgcacag

SEQ ID NO: 11165 - DNA, 365 bp, Zea mays
  Clone ID: cC-zmpo148069b12a1
agccagagaagcatatatacatgttgaacaaatgaataccataaaactgatttcaatttggttacacaagacacatactcacatagggtactaatcgtgaattgcacaagtataaaggacagctaaacactgaagatgatttgtttatggattgaaacatgatggctgaaagaacgaatcatccggggccagctataggcaaacatcaagatactgcagggagaaccttgtgcatttgtatgacttgctgccaccactcaactgcagcagccaccagcctgagaggacgagccagcaccaccttcagatgagttgggaacagcgtagccaactttgatcccgttggactcatttgatacattaaa

SEQ ID NO: 11166 - DNA, 305 bp, Zea mays
  Clone ID: cC-zmpo148069b12b1
ccacgcgtcctttttgatgtatcaaatgagtccaacgggatcaaagttggctacgctgttcccaactcatctggaggtggtgctggctcgtcctctcaggctggtggctgctgcagctgagtggtggcagcaagtcatacaaatgcacaaggttctccctgcagtatcttgatgtttgcctatagctggccccggatgattcgttctttcagccatcatgtttcaatccataaacaaatcatcttcagtgtttagctgtcctttatacttgtgcaattcacgattagtaccctatgtgagtatgt

SEQ ID NO: 11167 - DNA, 363 bp, Zea mays
  unsure at all n locations
  Clone ID: cC-zmpo148069c01a1
tatcccatccgagacagttgtcatctgccggagcatctaccactatacagaggccatcgctctagggctgctctatcgtaagctcggctctcagatgcagcatcccatccacgaagaataggctgtcatcggacaagaacttctgccatgggattgcaaagagattcctgtacccaaccgcctttgcaccggtgaatgtgtagataccccttgtactcgctcacaaactcgccggatggtctcgtccttgcagcgaactcgtagtccactgtcacactggnggagcccttctcttgcatccccaggaagagcccgcagcagtggaacgcgctttgctgctccatgttacagggagctgagagg

SEQ ID NO: 11168 - DNA, 231 bp, Zea mays
  Clone ID: cC-zmpo148069c01b1
ccacgcgtccgatttcttctcttcttctggatatctagatggctgcggacaaatttgaggctgttccatgcatgaggtactgcagccagttgctcacaagcttgcatatgaccacagaatacgcacttctctacctagatctcacttgcgtagatccaatggcagatgcagttcaacctctgacacacgcagcttaggatcatctcgctggtaagtacaaggatttgatta

SEQ ID NO: 11169 - DNA, 374 bp, Zea mays
  Clone ID: cC-zmpo148069c02a1
ggaattcgatcatgaacccgaacaaaaggattacatatactagaatttggaagtctcagtagtatataaggttagcggtgcatgctgccaacttaattagcttgctgctgaaggtccatagcccgctgtgccggatgaatcgaagggaattcaaagtctagtagaattggacgttggaagtgtagacggcatcgggtctccagttcgccgggatgacgtctttggcgatgaccttcttgccggactcgctggtgaggcggatggagaaggggcccttgagcgccttggcagtgtccatcctccagatggcgccccaagagagcttcatgggctttcactcaaccgacaacttgtcctggatttccatcagcacg

SEQ ID NO: 11170 - DNA, 392 bp, Zea mays
  Clone ID: cC-zmpo148069c02b1
ccacgcgtccgccctctcgtccgcccacgcgtccgggcatttcgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgccaggaaaaacccgagtgctc

SEQ ID NO: 11171 - DNA, 384 bp, Zea mays
  Clone ID: cC-zmpo148069c03a1
ttaaaaaaagaattgcctctttgcaccaagcatcctacgttaatcacatgaattccatccttgcccgatgatacaactcaaaaaataaattctacataaaaagatagcggctacatacaattgatgtacacgaacgccacttaaaaaacgagaaacaaactatttctcaataccctgctgcaagtactgaatcaagtcataccctgcggtagtccacttgttgtaagcatcagcacatgttcgtaccatgaagttagcggcctcacgttcattcatctttggatgaaaccggtttcgaagattattgattggatcctccctgctaaagcaaggaaagccactgttcaccatttggttgactgtacttaaaatcccaattatatg

SEQ ID NO: 11172 - DNA, 435 bp, Zea mays
  Clone ID: cC-zmpo148069c03b1
ccacgcgtccgccctttcgtccggtcaaaggatacctagcatcaaggaggcatatgaatgggattttaagtacagtcaacctaatggtggacagtggccttccttgctttagcaggggagatcctatcaataatcttcggaagcggctttatccagagatgaatgaacgtgaggccgctaacttcatggtacgaacatgtgctgatgcttacaacaagtggactaccgcagggtatgacttgattcagtacttgcagcagggtattgagaaataacttgtttctcgttttttaagtggcgttcgtggacatcaattgtatgtaaccactaatttttttattgtagaaattattttttgagctggatcactcggcaaggatggaactcatgtgatttaacgttgaggcttggtgcaaagaagaatttttttttttt

SEQ ID NO: 11173 - DNA, 425 bp, Zea mays
  Clone ID: cC-zmpo148069c04a1
tttccatgataaaattgggattgcatatataggagatacatatacaatacaatatttgtgttgttgtttgtcacactccttatatccttttattaaataaaaaataaaaaataaaggtctatcaagtgtgccatttgatacttattattatttggttagtttatttggcggtgtaggcagtgttgggcttccagccagcggggatgacatcgtcatagacggtcttagtgccttcctcggtggtgagttggacggtgatgggtcccttgatcggcttgtcgctgtccttcctccagatggcgccccaggagtgctttaaaggctcgtacgtgtcggagcccttctccttgatctccaccgccacaatgtcgccatcgccgttgacgtacttgaccaacaatgccaggtaagtggggttgcacccc

SEQ ID NO: 11174 - DNA, 304 bp, Zea mays
  Clone ID: cC-zmpo148069c04b1
ccacgcgtccggtttgttgactgttgtgagtatcatgtggtcattagtgcaggtgcaggtgctggcggcggtggcactagcatttctggtaggcactgcctgctgtggtcctcccaaggttcccccgggtaagaacactacggccaaatatggtagcgattggctagatgccaaggcgacatggcacggcaagccgacaggtgctggccccgaccacaatggtggcggctgcgggtacaaggacgtgaataaggcccctttcaacagcatgggcgcgtgtggcaacgtccccatcttcaaagac

SEQ ID NO: 11175 - DNA, 239 bp, Zea mays
  Clone ID: cC-zmpo148069c06a1
gaaaaaagagaagacatttttttctcacaaatttcggggaaacaatgaagaaaagaaactcctaaactatagtgatctattaggacagctcacaaacgtttgtgtcaccagaaaaagaaagaaagaatgaaagaaagcaagaaaaaggtctcaggcttaaagcttgcgcgcgagctggatgagcaagttggctttcctctgcgccctgctggcgccgtttttggcgaacctggagaggt

SEQ ID NO: 11176 - DNA, 302 bp, Zea mays
  Clone ID: cC-zmpo148069c06b1
ccacgcgtccgcgttgttcgggctgctggcgtgccccgacaagaaggggcaggtttacacggtgacgtcgctgctgaacctgtccatcgacgacaagaacaaggccctgatcgcgaggggaggcgccatcccgctggtgatcgagatcctgcggaacggcagcccggaggcgcaggagaactcggcggcgacgctgttcagcctgacgatgctggacgagaacaaggcggcgatcgggagcctgggcgggctggccccgctggtggagctcctgcgcaacagcggcactgccccgcggaaaa

SEQ ID NO: 11177 - DNA, 468 bp, Zea mays
  Clone ID: cC-zmpo148069c07a1
ataattcttttttttttttttttttttttttgggtttttttttttttttttttcttttttttctttttttttttttttttttttttttttgggggggggttttaaaaaaaaaattcttccccctcaaatttaggggggcccccccccaaacaaaaatattcgcgcgaacgcctggggttttaccggggggggcccccaagggatcgcctgcaaggggaccctccgggcccggaaaaaaatttttctttgggaggggggccccaccccgggggggctaaaacatgccaccctctttgggggcccccccgggggtccccttggggttggcaccttaaacacgggccttggtggagggccctcttttccaggggttgaacttttccctggaacccccccgccttgggccccttttaggccaaaacacgctttcccccctccggggggagagggcccccttattttttttaa

SEQ ID NO: 11178 - DNA, 391 bp, Zea mays
  Clone ID: cC-zmpo148069c07b1
ccacgcgtccgcttggtcaccgtcaaggacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattacatgctatccattggtaacgcacaacagtaaaacgacagacatccgacagctatattatgttcgacggtgtaacaccctgaatttgagggtataaa

SEQ ID NO: 11179 - DNA, 371 bp, Zea mays
  Clone ID: cC-zmpo148069c08a1
ataattttttttttttttttttttttttttgggggtttttttttttttttttttgggtaacaggattagtatcatggcaacggggagggattccatatggatacaagtttgcgttgcaaaatggggtcccccccttatttgtccccatagtaataaacaaagatgccgattggatcccctgggattaggaaaaactaaaaaaggggaccaacagggggggacatacagttttattggtgcaacagtcgtgcaaacagaaactggatttttggggtgaatttaaaacaggggtgagaaacttgacctttgtcccacgaggggaaaagttgccatgatcggacccgggggttgacccgggaaattcggaccgg

SEQ ID NO: 11180 - DNA, 276 bp, Zea mays
  Clone ID: cC-zmpo148069c08b1
ccacgcgtcctatcatggcagcttttcgcctcgttgtacataggctagtttctcatcactgttttagattcagcacagaaatgcagctgctgtctgcacgactgttgcagctatgaagctgtatgtacctcactgttggtgcactattttagttattgctaatcacaggggatgcaaccggcatctgtgttgattactatggggacaaatgaggcgtggaaccaattctacaacgcaaacttgtaaccattatggaatcactcggccgtgacatga

SEQ ID NO: 11181 - DNA, 330 bp, Zea mays
  Clone ID: cC-zmpo148069c09a1
agtaataatatgatgaaatgaattcattcctccaaattaataaagtcgtaatgaagtcataatgcttcacgaatgaattgactcttccaacaaacacctcattaacatctaatcgtattctgccagcagcatgcttcaaggcgacctgtgcgggcttcacctgcttaaccgtatcaattgtctttgacacttcaagtcagcctggttaactataccgcccatccaacaggacttggtgaattcagcggaagcatttgacacacagtattcccaaatagcgtttattcaaacatgtcctgataaagaagcacgccatcgatgttcgatgga

SEQ ID NO: 11182 - DNA, 381 bp, Zea mays
  Clone ID: cC-zmpo148069c09b1
ccacgcgtccgcttttgcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcagaaagagttctgctgcaatggtacagtggtccaagacccagaacttggacagggca

SEQ ID NO: 11183 - DNA, 364 bp, Zea mays
  Clone ID: cC-zmpo148069c10a1
ttaaagcagattaaagtgcaaattgtgtaacccatcagtatgtcatagctcacatttttacatgcttggcgtcatcacaaaaaaaaagattactcacttgtgaacaccccaatttaactgccacagcccacaaccaccaagtccaagtggctccaaggtcccacatattgagctccgtgtacacggcacgaagccacttcatctgcgtgtcccttccacgtttgaagccttcgaagttgaacacacccgcccttatcattgctcctcggtttcctcctcctcgttatcttcgtcgtcgtctgaagaagaagatgacgaggagtctgaatggtccgattctttgtctttccgacgcctgggtcga

SEQ ID NO: 11184 - DNA, 358 bp, Zea mays
  Clone ID: cC-zmpo148069c10b1
ccacgcgtccttttagacaaagaatcggaccattcagactcctggtcatcttcttcttcagacgacgacgaagataacgaggaggaggaaaccgaggagcaatgataagggcgggtgtgttcaacttcgaaggcttcaaacgtggaagggacacgcagatgaagtggcttcgtgccgtgtacacggagctcaatatgtgggaccttggagccacttggacttggtggttgtgggctgtggcagttaaattggggtgttcacaagtgagtaatctttttttttgtgatgacgccaagcatgtaaaaatgtgagctatgacatactgatgggttacacaatttgcactttaatctgcttt

SEQ ID NO: 11185 - DNA, 366 bp, Zea mays
  Clone ID: cC-zmpo148069c11a1
ataattttggcgaccagaatggtaccccatcggacgtatatataccaacacgagcatacaatggaattcctgatgaactgtgcaggaacccgatcatttgctacagaaagtaaaggaaattccttctgaaattggccccgatcgaagatagccaatggttaataatcggctggccatcttcttcggataatcaggtgtacacgtacgtacgtactactaggtacagtatcttcgtcgtggtgtgatcttggcgatcgaacaggggcagatagtgcatgctgcatgcatcagtcgtcctgcagaatcctccgattgagcatcttggtgcgcaggttggcggcgtccaccttcttcgtgccggtgacc

SEQ ID NO: 11186 - DNA, 305 bp, Zea mays
  Clone ID: cC-zmpo148069c11b1
ccctactattgtaaagctcgcccccgtgaaggcaccaacccgtatttcctggtcgacccacgcgttttttttcggcgtcatcgccgagggccttcatttgtgctagtttgccccgaggtgacgattgcgagacctgcagtacgtcgggctccgatcgagaacagggaaacaagaggctgctagagatcgagctcatcaaccaatcaagtcgtacgtcgtcagcatcacgcgaccggatggcgcgcgccgtgtccagctatgtatccaggagggggctctccgcaccgatgacggtgggggaggac

SEQ ID NO: 11187 - DNA, 456 bp, Zea mays
  Clone ID: cC-zmpo148069c12a1
ccagtaaaaattaaatacatggaaattaaagctggactggcaggtatacacttatccgatcgaggaaacacagaaaaaataaataaatggaagtccacatatatatttgattggtgaccatgaaaatataaaataaaacaaaacaaaatcctactagtagtacttataaggaggtgaacgacagcaataagaccggcgaggcaggccagatgaaatgacacgttgggggcatgatcatcgatggtatcctattgatgatgatgtgatgtttcagaagacctttgcgacgtccttcatgagccccgggttggcgttactgaaggtgatgaactcgttgaagtcgatgcagccgtcgccgtcggtgtcgatctcggccatcatgcgctgcacctacgcggtggaggtggaccccagagtccgcagagcctccgtcagctccgacagcgagatcttgcc

SEQ ID NO: 11188 - DNA, 348 bp, Zea mays
  Clone ID: cC-zmpo148069c12b1
ccacgcgtcctgttcgaacgcgtgcacgcgctgacgccgacgtggaggtgtacggtaactcggagcgtcatcggagagagagacccgccaccgccacgcttgaccgtaatccgtggagagtgagtgcccggccgggctaccagctaagacacgacggtccatccagccatcggtggcccagcagattccacaatggcggcaacggcggacatggagcggatcttcaagcggttcgacaccaacggggacggcaagatctcgctgtcggagctgacggaggctctgcggactctggggtccacctccgccgacgaggtgcagcgcatgatggccgagatcgacaccgac

SEQ ID NO: 11189 - DNA, 461 bp, Zea mays
  Clone ID: cC-zmpo148069d01a1
taaaccttaaataaataatgtatttagtttatgtaataatatcaacccaacacaacaaggcgtcagaagagacatgtagcataacttatttcttgggtggtctggtgccaaaaaaagccattgaaaaaataatattgtcttgtaacacatgcgctaggtgagctcttttgaaatataattcatcatgagaggttgattagatgctgagtgtggtcttataggtggtgccagccttgaaatcggcggggatgacgtcgtcggcgatgcggtagccgccagacttgacagcaaagcggatgcaaagggggtacttgagtggggccttggtgtcgagcgtccacgtgccagtcgggccctccttgagcgtaaaggaaaagtcatcaccaccgtgctctttgatctccacatcggatatggtggcaacgttgggggtgaggatcaagtggacaggcttggatccc

SEQ ID NO: 11190 - DNA, 336 bp, Zea mays
  Clone ID: cC-zmpo148069d01b1
ccacgcgtccgattgtttcaagcgcccacgaacatctacctcgccaccaacaatggcctccaggtcctccattgtactcgccacggtgatgttggctgcgctgttcgcggttggtttctgcaccaccccgctcaccttccaggtcggcaagggatccaagcctggccacctgatcctcacccccaacgttagccaccatatccgatgtggagatcaaagagcacggtggtgatgacttgtcctttacgctcaatgagggcccgactggcacgtggacgctcgacaccaaggccccacttcagtaccccctttgcatacagtttgcttgtcaagtct

SEQ ID NO: 11191 - DNA, 442 bp, Zea mays
  Clone ID: cC-zmpo148069d02a1
tttacaaagagaaccaattgtgttacttgacaggtacagttataatatgatcctaggtactttattaatttccatcctctcttttttgtggttgatgttttcaccactagcaacaaatttggcttggaaaggagctggagcaatgtatgcattgtagtgagccacaaaatataaatcccaaaatataaattcaacatcattgcctgcttaaaggcatgcaatcccaaacatagtagcttatatgaaaaacactcaaggaataaataaaatggagtcgaatggggaccctgagctttaaagcacttccgatgaacaattccaggtcctgacttgtcatactcaagccttgagatccacatttgttggaaggtgctcaaggaggcaaggatggatcctcctatccaaacactggatttcctttaggcggtgccccaccttgatt

SEQ ID NO: 11192 - DNA, 500 bp, Zea mays
  Clone ID: cC-zmpo148069d02b1
ccacgcgtccgcgtgctgcctgatggtcaggtgatcaccattggggcagagaggttcagatgccctgaggtcctcttccagccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccgtatgagcaaggagatcactgcccttgcgccgagcagcatgaaaatcaaggtggtggcaccgcctgagaggaaatacagtgtctggataggaggatccatccttgccttcctgagcaccttccaacagatgtggatctcaaaggctgagtatgacgagtcaggacctgggattgttcatcggaagtgcttctaagctctgggtcccccttcggctccattttatttattccttgaggaggttttcatataagcctctattgttgggattgcatg

SEQ ID NO: 11193 - DNA, 463 bp, Zea mays
  Clone ID: cC-zmpo148069d03a1
tggacatcttcttttctttatatatttgacagtagtaaaatgccaaattttggttagtggattgcatggatgctggggcatcctttacatctgtctatgtctaagtcatgtattctattggaatagtaaattttacttccagagcaaaggacaatgccagagggcttgctagttgacgaagtttgtcaagcatgcaactggtatatgtgatctccttcaacccttatttccaccagatccagtaatcctgcttttgcgttgtctttgatgctgtttagttgaggttgagggtcgtggtacttcagtcagtaattgctgcttggaaactactttcttgtttcataaagtatctttgcacagtttttgactgaggctgctgaaattctctgttgagtaacgtctagaggcgttcctccagtccgatccacttttcatcatcaattcatactctgggtaactgatg

SEQ ID NO: 11194 - DNA, 323 bp, Zea mays
  Clone ID: cC-zmpo148069d03b1
ccacgcgtccgcatagcaagtccttgagcacccttggctcaagaatgctgataaggcttcaaatgtgtcactcggagaggttgttcggtcgaggctgaagcagttgtcgtctatgaacaagcttaagaagaaggcacttggagtcgtcgccatgaatttaccgatggaagagattggcaaattcaaagagatgttccatacaatggacaaaaacaaggacggtagtttgtcacttgaagagctgaaggagggtttccggataaacgatcatcctgttccagaggaagagataaagatgttgttacaagcgggcgatatacatg

SEQ ID NO: 11195 - DNA, 381 bp, Zea mays
  Clone ID: cC-zmpo148069d04a1
gataattttttatcgatttttttttttttttgggggttttttattttttattgtttttttttaaacaaaaaaaaccaggtcattattttattttaagggaaaattaccgagacggggaaaaaattccacattgcaaagggctttgggggggtggatgtccatggaaaccacggtacagaaaagggggggagcacaccttaaaaggaaagcgatattatggaggggggcaaccaaatgcatgaattcttagggcgggggggaaaaaagccaaaaggaatcccccggggggaaagcccttgattggtcgttccaaggggggggggggcaaaaatgcaacccttggcgggaacatgtattctcactgggaagagacggtacttg

SEQ ID NO: 11196 - DNA, 490 bp, Zea mays
  Clone ID: cC-zmpo148069d04b1
agctgccccctggggaccggcatttctggtggaccacgcgtccgcttttcagccgagcgatctcctctccctctccctgtccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacattatgaaagactttgacgagccaggggcaccttgcgccgacagggcctgttccttcggacctaccaagttcatggtcattcaagggcgagcctggtgccggcattcgtggcaagaagggatcaggaggcatcaccgtgaagaagacagggcaagcactcgtggttggcatctacgacgagccgatgacccctgggcagtgcaacatggtggtg

SEQ ID NO: 11197 - DNA, 448 bp, Zea mays
  Clone ID: cC-zmpo148069d05a1
ttacgcacagttgcagattactattactggctgcagtgtaccatataatacccagggacaagacaacagtacatcacatagctagataactgcgaagccaaatacccgtctcagcgagaccaccataaatagagcttacacaacatagccaacatgcaaatcattttagaactgaccagatgcagaggcaggaattctcgaggcgggctacacaagtgtgcaccgtgcactgcaatgcccaacaacaagattgtagcagcaaacatggaagagaaaggcgcggggggcaaggcagcagttccgcatgacgagttaccgcggtttacaatcttcctgatacccaaccgtagggaaccccccctagatcttgtcgagcttgtctgccttcaccaccggattagccttggcaatggcgttcctggcagcagttcggtagtcgaacttgcag

SEQ ID NO: 11198 - DNA, 305 bp, Zea mays
  Clone ID: cC-zmpo148069d05b1
ccacgcgtccgccctgtgattcctctcccctcgcctcctcgtctccccctaggggatcgccggagaggaatcgcatagagggccgcctcatccgagttatggaagccatggagcacaaggaggctgggtgccaggcccccgagggacccatcctctggatcaataactgtggcttcttcggcagcgcggcgaccatgaacatgtgctccaagtgccacacggagatgataacgaagcaggatcaggccaagctggctgcctcctctatcgacagcattgtgaacggcagcgacgccgtcatggag

SEQ ID NO: 11199 - DNA, 271 bp, Zea mays
  Clone ID: cC-zmpo148069d06a1
aaattgggggacccggtcgttgtccttaaccacccctaattggaaaccgggggggggacctccctacctttgtactacaaaagtacctaggggttggttgtacccgctgattggtgatgattaattaaaatttggatgcctgccttgtaaaaacaaaaaaaagggggggggtttaggccttccttccttattcatggggccttaatttatttattcacgggcaccggatgcggggggtgaccccggaatttcggaccgggacctggggggg

SEQ ID NO: 11200 - DNA, 229 bp, Zea mays
  Clone ID: cC-zmpo148069d06b1
ccacgcgtccggtggccttggatgaattaattaaggccccatgcatcatgcatgcatgcctaagctacctcccatttctttgcttctacaatgcatgcatgcagatattaattaatcatcatcaatcagcatgtacaaacgagccctacgtactactgtagtacatacgcacgtacgtactccctccggtttcctattagttgggggctaggacaacgacacggtctcc

SEQ ID NO: 11201 - DNA, 424 bp, Zea mays
  Clone ID: cC-zmpo148069d07a1
tgttggaacggtcgtttcttgttatgctcatcaggatacgatactggcagtggcagcttcccttagacattatacccaatatagtataactttggtgaacaatgcaaggagaaagaacattctctgttgaacagaaaaaacgctcccaatgcaatgcaatggagagcgaatacatgcatgttacagcaagcaatcagccggcgagggtgaatcgtggcgcaaaccagacccaggaatgcgcaagctcccacgttcgagctaggcggcctatttggcgacgagcttgcgcgcacgctggtttgctcccttcaccctggagttgagctcctccacgtcgccttgcagatgatccagcgctttgttttgcctgtcaagctcggagcccatgtcgacggccatgcccttgagctggcccagcacgccg

SEQ ID NO: 11202 - DNA, 401 bp, Zea mays
  Clone ID: cC-zmpo148069d07b1
ccacgcgtccgctcttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgaccgacgcgctcgccggctgcctgcgcatcgccgaggacatcaggcaggacgccagcgacacgctgatcacgc

SEQ ID NO: 11203 - DNA, 394 bp, Zea mays
  Clone ID: cC-zmpo148069d08a1
acaacccgagcattagtacatgtcatttctcaatttacattcgagtagaacaagtgacgatgtaacgtgtaatctataaagacaaaacgttgtataagtagtaggtacatattaaagccaaacgaacaggctctaggtcgatcacgtctaactttataacctaaaaattgtgattatgttcttaacaaggtcgcttgagctacggaattgatggtagaacagcggtcgtctcctaatcaatgctcttcgataatctggaatacagatagccgttgcacctcacaagaagccacttttctccgtacgggtgttcttcagcaagtctgtcaagaacgcgtcaaacgccacgtgagatgagccgccttccttgagaaccttcacagccatattcttg

SEQ ID NO: 11204 - DNA, 353 bp, Zea mays
  Clone ID: cC-zmpo148069d08b1
ccacgcgtccgttctgctgagagagatagcacgtggactggagaactccgggcagaggttcctgtgggtcgtccggagcccgcctgagcaccggagcaactccgtggagccggacctggacctggagccgttgcttcccgagggtttcttggagcgtactagggaaaggggcttcgcggtgaagaactgggcgccgcagagcgaggtgctacggcacctttccatcggtgccttcgtgacgcactgcgggtggaactcggcgctagagggaattgcgtctggcgtgccgatgatctggtggccgttgtacgcggagcagaagatgaataaggtgcacatggtggaaggagttt

SEQ ID NO: 11205 - DNA, 363 bp, Zea mays
  Clone ID: cC-zmpo148069d09a1
atatttttttttttgtttgttttttttttgtggttttttagcccggagaataggtgtagtttcaattttaatatcagcaaatacaatattgtatgagattttgaatggatatggctgcgacaaatctgttttaatggggcttacaacatatggacatagccccagaaggaacatgtttgaaaagcaatcactcccccattatacatttggaggtacagatcaatacttacaacacccatttgggcgacccaagattgtcgtaagaaagaacttgaaaggcggaaacagaaacaaaccatgcacaggaggccttctttgtcttcgatctcccgcgtttggtctcctccattgggaccccactta

SEQ ID NO: 11206 - DNA, 303 bp, Zea mays
  Clone ID: cC-zmpo148069d09b1
ccacgcgtcctttttatttcttctcatgtttgcagtatttgagcgggctggtttgaccgtcgttttgtacccgttgagatcccaggattcagactggtgccattcgatttgatttggcgcggggtactttcctatggccgcctccatcgcggcctcgcccttctttccagggtcgccggcgccggccgctcctaagaacggccttggagagcgcccagagagcctggacgtccgcggcgttgcggcgaatccgggagcctcgtctaatgccgtgagggcgggcaagacgcgcgcccacgctgt

SEQ ID NO: 11207 - DNA, 415 bp, Zea mays
  Clone ID: cC-zmpo148069d10a1
atatttatcgatgcgatcactgatacatttcttcctgatccatattgggtagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccacccttagcacccttttcctggtcgctgtccatctggtgcagatcctcagcggacgcgtagcggctggtcatgcccacctccttgatctcgaagccgaaccgtgcctgcgacggcggcgggaggatcacgtcatggtacacatcggcgtggcccaacggcggtggccg

SEQ ID NO: 11208 - DNA, 363 bp, Zea mays
  Clone ID: cC-zmpo148069d10b1
ccacgcgttctcttaccctcgaagccgaaggcctcgtgccttctcttcctccctggcatggaggaagtagctgtttcgcctatgatcgttgccgccgtagtgctggacaacaatggcgccgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgcaccactcccgtctcctccagtagccctttcactcgcaagaaagcgcgggcgttcagcctcttcaaggcgatg

SEQ ID NO: 11209 - DNA, 405 bp, Zea mays
  Clone ID: cC-zmpo148069d11a1
caagaaattaaatgatcaaatcaggaatgagacgcacatctccgtttgttcgagtgatcacaagaagcaaaacgaccgaccaacaaacaagaaagcaacgatccaaagagaaccctaccaaaattcaaaccagacagacaccaccgccagcgccagtcgagactcgaccgatcttccctccaaaaaaaaaaaactcgaatcagctcgcccgggggctgtccatgacggtcttgaacgcccccaccagcgccttcaccttgctcttccgcttctccatcagcttgctcttggcctcctcgatcacgtcgttgctccgcgccacctccttccgcttgggctgttcctccttcgaccgcctctccatggccgtccttaccctgcgccccctgaacgccagcgccgacg

SEQ ID NO: 11210 - DNA, 322 bp, Zea mays
  Clone ID: cC-zmpo148069d11b1
ccacgcgtcctcttttcgcgaactctgaggaaccagaccaagaaaccagcgtgatctccgaagaacccaaggagggtacgagcgtggtctcttgagaaccaaaggaggcagctgatcctaccactgtgcaaagcccgagggggcgttccgacgaaacataagcggctgccggatcgagcgcgtcagctccaacgacgccactgacagaagcggccaactacgacggcgacgacgacatggaggcggcgcctaaacaggtgagcgcttcggagcccgtgacgccggtgacagaaggcatcagcaagggcaaggaagtgatgga

SEQ ID NO: 11211 - DNA, 453 bp, Zea mays
  Clone ID: cC-zmpo148069d12a1
cacagctcaggagtgtgtttctttgagcgcagaaagccctcagacaatttacaggagacttgtatggtccgtgtgattacaaaggttcttttgttacaattacaagttgccaaggaaacggcaaaactgcggaccaatcacaggacgatgtcctagctcagaatttccaaccgtcacattgtggcttcacctcctttccccccaactcaatcacttgaacccggttcctgaaaatagtcaatgatgctcttgcacaccttcttggacttctctagattggccgcgtgcccagcgttttttacgactactaatctagaactctccccaagatgcctcttcaacctatgcgccagctccattgggaagacctgatcctgctccccccaaatgatcagcgttggctggtttatctttggaagatctgacagtttcctatctgtgatgaaagcgtgt

SEQ ID NO: 11212 - DNA, 389 bp, Zea mays
  Clone ID: cC-zmpo148069d12b1
ccacgcgtccggttccggctcgtcaagctcaccttcgtccggccgccgcccatcatgccctcctgcttcctcaaggattacatcaatgtgatgggctcagaccaccttgaggagaaggccgagcttctacacgctctcatcaacgataggaaactgtcagatcttccaaagataaaccagccaacgctgatcatttggggggagcaggatcaggtcttcccaatggagctggcgcataggttggagaggcatcttggggagagttctagattagtagtccgaaaaaacgctgggcacgcggccaatctagagaaagccaagaggtgtgcaagagcatcattgactattttcaggaaccgggttcaagtgattgagttggggggaaagga

SEQ ID NO: 11213 - DNA, 212 bp, Zea mays
  Clone ID: cC-zmpo148069e01a1
atttattttatgatcattttttgcttaatttgggattttatattttttttttttttttagttttttttttttttttttatttttttttggggggccaagaagggtcaaaaatggagaggcacaaaaggggattaaaaaccccctacatatgccctgggggagccctttcccaaggtaattctgcatgagagggggaagtagaacggagttgg

SEQ ID NO: 11214 - DNA, 101 bp, Zea mays
  Clone ID: cC-zmpo148069e01b1
tcccacgcgtccgatctttcaatttatgatcattctatgctcaaaatggcattaaaaaccgacgtgattggtgcttttttgccgctttcttgtcaactttg

SEQ ID NO: 11215 - DNA, 163 bp, Zea mays
  Clone ID: cC-zmpo148069e02a1
tcctctagagcggccgccctcccttttcttacttattttcttcttatccttcttttcttaaattgggattttttttttttttttctctttttacccccctttcctttttttttttttttttctggggggcccaaaggcccacccaagggtctgaccaaaaggg

SEQ ID NO: 11216 - DNA, 63 bp, Zea mays
  Clone ID: cC-zmpo148069e02b1
ccacgcgtccgactatttgaatttatgatcattctatgctcaaaatggcattaaaaaccgccg

SEQ ID NO: 11217 - DNA, 367 bp, Zea mays
  Clone ID: cC-zmpo148069e03a1
ctatttttgtatttttttttttttttttttattagtgggaggatttagtatttgttttgagcttccccgaacaataggaatttgcgaggacatatataagaaccagggcatcacctacacaactaaggaaaaacacagaaaccggaaaaaaactccacaacccaaaggccattggagagtcgaatgaccatgcaatacacgcaaaagcaaaatggtcgcgccaaccccaaaagcaaagcgaacttattcaggcgagccaccaactcgctagacatcctacggactggaggaaaacaccccccagcaaatacgccgggaggaaggcccttccccgccgcaccaactatcggaggcggaactttaaaac

SEQ ID NO: 11218 - DNA, 332 bp, Zea mays
  Clone ID: cC-zmpo148069e03b1
ccacgcgtccggttttctcaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataattgtaacaactaagcaaaggccttccttccggcgtatttgctttggctcttcttcttcacgccataagatatctagcaatt

SEQ ID NO: 11219 - DNA, 348 bp, Zea mays
  Clone ID: cC-zmpo148069e04a1
tttagaggatgcagatgcatatgcatgcaaggataaacataccaaaccaaaccgatgcagatactcttatatttacatcacatgacggtacacacccccaaagaatgcacacacggacacgcacacggcacacacacaccaatcctagcagcgggaggggcaacctcgctgtgatgggctgcagggcgggcgacagggccatgcccgactacagggaccgacttggatgtctggacgtgtggtcccaccacctacttctcatcacgagggcggtccgggcgcggcggtcccctcgctgccgatcatgtacttgttcgcgcggaccgacggggtcgtgtagggcttcct

SEQ ID NO: 11220 - DNA, 401 bp, Zea mays
  Clone ID: cC-zmpo148069e04b1
ccacgcgtccggttgttcctaagcgcgccaagaggaccctggcgaaccggctgtccgcgcagcggtcgcgcgtgcgcaagctgcactacatctaggagctggagcgcagcgtctcgttgctgcagacggtggtgtcggccctgtccccgcgcgtggcgatgctctaccaccagcactcgctgctgacgctggggaacagccacctgaggcatgggaccgcggcgctcgcgcaggacaagatcttcaaagatgctcatcaggaggcactgaggaaggagatcgagaggctggggaatattctaccaccagcagagcctgaagagcggcagggagcccgacgcggccccgtcggtccgcgacgacaaggacatgatcggcagcgaggggaccgtcgcgcccgg

SEQ ID NO: 11221 - DNA, 198 bp, Zea mays
  Clone ID: cC-zmpo148069e05a1
attaagcccaattagaacatgttgtttcatcagaagatctccgtggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatccggacgcgtgg

SEQ ID NO: 11222 - DNA, 197 bp, Zea mays
  Clone ID: cC-zmpo148069e05b1
ccacgcgtccggatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttaa

SEQ ID NO: 11223 - DNA, 231 bp, Zea mays
  Clone ID: cC-zmpo148069e06a1
tcctctagagcggccgcccttctttttcttaatattaagcccaattagaacatgttgtctcatcagaagaactccgcggaggacaataatgggagacatcgaagaaggttagtttgttacatggtgtggccagccgagagtgtctctcccgacctatgccgctatgccaactgtagagaattcaagtgtcgtctccttgctcgatcacacactgatcatccggacgcgtgg

SEQ ID NO: 11224 - DNA, 198 bp, Zea mays
  Clone ID: cC-zmpo148069e06b1
ccacgcgtccggtttgtcttgtgtgtgatcgagcaaggagacgacactggaattctctacagctggcatagcggcataggtcgggagagacactctcgactggccacaccatgtaacaaactaaccttcttcgatgtctcccattattttcctccacggagttcttctgatgaaacaacatgttctaattgggcttaa

SEQ ID NO: 11225 - DNA, 341 bp, Zea mays
  Clone ID: cC-zmpo148069e07a1
tttaacacaagtggccttaatttggcagtctttcaattcaccatgatctgaagaagagcacgtcttatataattaaccatgcacacgtttggtttcttaacgaacaagacagatcgaccggattgatggatcgtgagtcgttctcctcgtcatcgatcagaggtcacgatggccggcggcggcgggcgctggcagctggccgctgttggctatgacgaccttggccttgggcacgccggtgagctggccctcggcttcgatcttgcgcacgacgtccatccctttcaccaccttgccgaacaccacgtggcgcccgtccagcttcttgggcaaccgggttt

SEQ ID NO: 11226 - DNA, 342 bp, Zea mays
  Clone ID: cC-zmpo148069e07b1
ccacgcgtccttgtgtcgcgtgggaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaaggtggggaaagggatggacgtcgtgcgcaagatcgaagccgaaggccagctcacc

SEQ ID NO: 11227 - DNA, 303 bp, Zea mays
  Clone ID: cC-zmpo148069e08a1
gcaagaaatattcatcatatatattaatatcatgaacaaaagcagttctcaacaatcccttgtactccatttttaaggaaaatatttccttatctatatataataaaaaaaattaaagccatacaaatgacgccccagacatgtctcttgcaccttgtcgtctcatgtagttagttcacacatgcacacgttcatacatagagtatgtacggagaagcaaatactcacgcgtgcacatgcaaaaaataaataaacaatttcacacacgcctgcaatgtacatgtagctgtttggttgcgcatg

SEQ ID NO: 11228 - DNA, 360 bp, Zea mays
  Clone ID: cC-zmpo148069e08b1
ccacgcgtccttttagctcgccacctccagaactgaagtcctctccaccaccagccccagttagctcaccaccatcagcgccaaagtcgtcacctccacctgctcctgtaagcttgccacctcctgaagtaaagtcttccccaccaccagcaccgattagctctccaccacctccggccaagtcaccaccttcaccgggcccctgtgagctcacctccctccccctgtgaagtctccacctccaccagcaccgggtcagtttcgccaccacccttcaatgaatgtccccacccgtcgccagcacccaatttagctctcccgccaccagcaccaagtgaagtcaccatttggttccaccac

SEQ ID NO: 11229 - DNA, 487 bp, Zea mays
  Clone ID: cC-zmpo148069e09a1
ttaaaaagtataaaacaatttataattgaggacaaagagagtatatacatgacaagaacatagcccatcatcacatttcctgccagacatcacccaaaccaaaagaatgacgacattagaactgaaaagcatggcgaaacttcagttaacgtgtaattgacagctcaggtgccacaaacatcgaaacaatgcttcggctcagttttgttgcccaccgccggcgccattgccgtcgaccattttggtgatgaacttagggatggggacctcgtacccgtacaacgagaagtcgggcggtagctgcggcatcctgggctccgacggcatcgccgggaacgagatgttggccagcccggagaggtcgggcatcttggggatctgagggatgtcggccgggagagccggggccgccccaagctggccagcagccgcaggctgctgcacggccgcgagactggccatcatctcgggcgtaatgttggccggc

SEQ ID NO: 11230 - DNA, 350 bp, Zea mays
  Clone ID: cC-zmpo148069e09b1
ccacgcgttctttacgcgtccgcccacgcgtccgcgccagtcccttccaccgtcgggtcgttgccggagaacactccggcgagcaacgtcccggtgaatatgcccgccaacaccaacacagcgacaggtgcagcggcgccggtccctcccaccgccgggtcgttgctagaatacaccccagcgaccaacgtcccggtgaccatgcccgccaacgccaacgcagcaacaggtgcagcggcgccagtcccttccgccgctgggtcgttgccggagaacactccggcgagcaacgtcccggtgaacatgcccgccaatgccaacgcagcaacaggtgcagcggcgccagtccc

SEQ ID NO: 11231 - DNA, 326 bp, Zea mays
  Clone ID: cC-zmpo148069e10a1
tcctctagagcggccgcccttcgctttcaataattcatcgaggcgaacactgatacattggtggctgttccatattgggtagagtcgtctctgacacgaatgcaatttcggttaagatcagaacgattacatacatgccgtaagcggatggatcattggattactcggaggcacggccgttgaacgattctgacttgaactgctcatagaacttggtgatgaactcctccgcctgcatgtcgatggagtgtgggcaactgttgccaccgtcatctccatcccttaggtacctttttctggttggttgtcaattggtgcagattctc

SEQ ID NO: 11232 - DNA, 195 bp, Zea mays
  Clone ID: cC-zmpo148069e10b1
cgggtcgacccacgcggttttcctcgtgaagccgaaagatgagccgaaggtactcttctagcatgggggaagcagccgaagcccccataaacattgtcgactgagcgctggacaacactggcgcccactcggtgtagtgcactaccatccttagcgaaacagtatgcctagaggagaaagaaaatctcaatgggg

SEQ ID NO: 11233 - DNA, 452 bp, Zea mays
  unsure at all n locations
  Clone ID: cC-zmpo148069e11a1
taggaattatataagaaccagttcattacttcattttataggaaaattacagaaacgggaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaggcgtcatcggcttgttgtagatgccaaccacgagtgcctgccctgtcttcttacggngatgcctcctgatcc

SEQ ID NO: 11234 - DNA, 439 bp, Zea mays
  Clone ID: cC-zmpo148069e11b1
ccacgcgtcctgtttagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaagaggcatcaccgtgaagaagacagggcaggcactcgtggttggcatctacgacgagccgatgacgcctgggcagtgcaacat

SEQ ID NO: 11235 - DNA, 436 bp, Zea mays
  Clone ID: cC-zmpo148069e12a1
aatagcaactgccagcatgccttgtttattattatccattcaatcgatgaaaaacacacatttgcgtgacattacatttggagttccatcgacggtatatatatttgaacaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcaggaccttttgcagttctcgctgaggcgcgggtttttcttcttggcgcacgtgacgctgcaggcccttggtgacctttcgtcgtcttaaccacgtacgcctt

SEQ ID NO: 11236 - DNA, 362 bp, Zea mays
  Clone ID: cC-zmpo148069e12b1
ccacgcgtcttgttatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccaacagtccaacctggtgctgtacggcaggatccagtgcaagggcaagtgcaccgagcagaagggcatcacggcg

SEQ ID NO: 11237 - DNA, 92 bp, Zea mays
  Clone ID: cC-zmpo148069f01a1
ggtaacaccaccactcgcagatgcggcatgacatccctagggagagaacggctcgacccatcacacaatacaagcatgacaacctatacata

SEQ ID NO: 11238 - DNA, 278 bp, Zea mays
  Clone ID: cC-zmpo148069f01b1
ccacgcgtccgctctttgatgcgggaactccagagcttgtatcctgtacttttactaacagaaggagggacatcgaaacaccacgatccaaggaggaactcgtttgacgacgccgtccgggtatgcctagagtacgatctgcacgggatcgtgtcaaaagcgagaggcgttctcaagaacccatccgcggtcgccagagcacaagaatctaacctcgcgcttctcacgtacgggcagcttaacaacgtgtgggaggcaggctacattcaatacctgat

SEQ ID NO: 11239 - DNA, 367 bp, Zea mays
  Clone ID: cC-zmpo148069f02a1
tatggaaacaatagacttcggttacggttgtcattcttggttgtcaacagcacacgttacaatcatacaagtttccaacaatacattgctgacctttttctggtgagcctacttgaaacaacaagagatcgaccacggtccatggtcggctgtacctgtactgaaccaacaaggaaccgcgagttttcagactatacagaagagtgtgtgcacgcagcacaagtatacgctgtcaaatcggacctatcaatcagtcagtcagtcgggacaagggttgacctcaaagacgaattcttgccatccgctttcagggtcaaaaactgggatgttacatatggtgtaccgtcctttctgtgccggtgctcaa

SEQ ID NO: 11240 - DNA, 127 bp, Zea mays
  Clone ID: cC-zmpo148069f02b1
tcccacgcgtccgtctgtgatgcggcaactccagagcttgtatcctgtacttttactaacacacggtgggacatctgcaacaccacgatccaaggaggaactccattgacgacgccgtccgggtatg

SEQ ID NO: 11241 - DNA, 371 bp, Zea mays
  Clone ID: cC-zmpo148069f03a1
tattcagataattttctcatgttattatcgttacatagtcaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcagacgacgactatggcgctggtgcgctagagggaccggatgaggccgtcgtcgccggagcatcagcagccgacgcgctggcaccagcaccggacgccggcg

SEQ ID NO: 11242 - DNA, 197 bp, Zea mays
  Clone ID: cC-zmpo148069f03b1
ccacgcgtccgcgaagagagaaacgcgagcaaccagcgatcgccccatggccgccatggctcgttccgtctccctcgtcgtggcgcccctgctcctcctctccctcctcgtctccgccgcggccagcgcgcggaccgtgggcgacaccgtgcaggacgcgtgcagcaagacccagttccccaagatctgcgtggaca

SEQ ID NO: 11243 - DNA, 214 bp, Zea mays
  Clone ID: cC-zmpo148069f07a1
gctcacaccaccgccgcataggcgcatgacattcgtgggaggaatggctcggaccatcacagagatcatgaacctaattggcgacataataagttcacacggaaccatgccaatctgtgtttagctggccgccctgaacggaggagcgtgtatagacagaataaacaacaccatgttataatacgaaggacagccacttgcccacccttggaag

SEQ ID NO: 11244 - DNA, 370 bp, Zea mays
  Clone ID: cC-zmpo148069f07b1
ccacgcgtccgtgtttaccgttccctgccccccgactccccgaggcaccccctcctccctcctcggcgaaacgacaaccaccccgccggggagggtaatccaagcgagggcgagccatcaccgtgctgttcctcgtttgctgtcgcctcgaagagcctcctccgttccctctccctcgaccgatcggccggtctcacggggcatttcgcggggctggtcgatctctccccgctcattctgtcaagggattggtcggttgccgattccgtgcggccggataactcggatttattcagtttttcgggttcgctacatgcgtgtgcgatgccggccagctccctcccggcgtaccccgacgccaccggcgaca

SEQ ID NO: 11245 - DNA, 290 bp, Zea mays
  Clone ID: cC-zmpo148069f08a1
atgtaaaaagagaagacatttttttctcacaaatttcggggaaacaatgaagaaaagaaactcctaaactatagtgatctattaggacagctcacaaacgtttgtgtcaccagaaaaagaaagaaagaaagaaagaaagaaagaaaaaggtctcaggctcagagcttgcgcgcgagctggatgagcaagttggctttcctctgcgccctgctggtgccgttcttggcgaacctggagagggcctcggggagtccgaacctgagcccgtgcaccagcagcggcctgttgtt

SEQ ID NO: 11246 - DNA, 290 bp, Zea mays
  Clone ID: cC-zmpo148069f08b1
ccacgcgtccttttgatcgggctgctggcgtgccccgacaagaaggcgcaggagaacacggtgacgtcgctgctgaacctgtccatcgacgacaagaacaaggccctgatcgcgaggggaggcgccatcccgctggtgatcgagatcctgcggaacggcagcccggaggcgcatgagaactcggcggcgacgctgttcagcctgtcgatgctggacgagaacaaggcggcgatcgggagcctgggcgggctggccccgctggtggagctcctgcgcagcagcggcactgc

SEQ ID NO: 11247 - DNA, 362 bp, Zea mays
  Clone ID: cC-zmpo148069f09a1
ggctggtgggtccatcgtcttcctgacctctgccatcagagcacatatccaatgcatatacatactactgagtactgtcgccagatcaatggacgacaggctgggatgaaacttgcttaattaatcagctgcacgccttgtgctcttggcccctgatcacttgagctgtagctagctagcaagctctcttgcttgcttttctaatggcatcacacagcagtaccaggtgctcaggtcaatacatgcaggcatgcaaatgggtcggagtgcttggtttgctagctagctactggaaggtggtatcaaaccacacacaccaaaaaaagaaaaaaagaaatcacctatatatcagtctaccacta

SEQ ID NO: 11248 - DNA, 342 bp, Zea mays
  Clone ID: cC-zmpo148069f09b1
ccacgcgtccggctctgttcgtgctggaaacggtggaggaagaggcggacgcggacactgagaggtcgtccatcggcgcggcgtccgaggacggcgacgacgaggaggaggaggaggtggctagcggcgggacgaagggcgccggcgccgcgctcgcgtgcatggacatgggcgccctcgacgacgcgctccccatcaagaggggcctgtccaacttcttctccggcaagtcgcggtcgttcgtcgcgaacctgcgggacgcggcgtcggcggggagcagcgcccggggcctggccaagccggagaacccgttcaacaagcggcggcgggtgctgcgctact

SEQ ID NO: 11249 - DNA, 428 bp, Zea mays
  unsure at all n locations
  Clone ID: cC-zmpo148069f10a1
cacagctcaggagtgtgtttctttgagcgcagaaagccctcagacaatttacaggagacttgtatggtccgtgtgattacaaaggttcttttgttacaattacaagttgccaaggaaacggtaaaactgcggaccaatcacaggacgatgtcctagctcagaatttccaaccgtcacattgtggtttcacctcctttccccccaactcaatcacttgaacccggttcctgaaaatagtcaatgatgctcttgcacacctccttggacttctctagattggccgcgtgcccagcgttttttacgactactaatctagaactctccccaagatgcctttccaacctatgcgccagctccattgggaagacctgatcctgcttcccccaaatgatncagcgtggctggtttatctttggaagatctgacag

SEQ ID NO: 11250 - DNA, 453 bp, Zea mays
  Clone ID: cC-zmpo148069f10b1
ccacgcgtcctgttccggctcgtcaagctcaccttcgtccggccgccgcccatcatgccctcctgcttcctcaaggattacatcaatgtgatgggctcagaccaccttgaggagaaggccgagcttctacacgctctcatcaacgataggaaactgtcagatcttccaaagataaaccagccaacgctgatcatttggggggagcaggatcaggtcttcccaatggagctggcgcataggttggagaggcatcttggggagagttctagattagtagtcgtaaaaaacgctgggcacgcggccaatctagagaagtccaaggaggtgtgcaagagcatcattgactattttcaggaaccgggttcaagtgattgagttggggggaaaggaggtgaagccacaatgtgacggctgggaaatctgagctaggacatcgtcctgtgattggtccgc

SEQ ID NO: 11251 - DNA, 510 bp, Zea mays
  Clone ID: cC-zmpo148069f11a1
agataaaacgaactttattaatccatgcatggaaacaacacaaacaaagcattccataagtattaaaacattggaaaatcaaatgtacaaccatctcaataataaagctagaccagatcaacaaatttctccaaagatcttaaataaataatgtatttagtttatgtaaaaatatcaacccaacacaacaaggcatcatatggacatgtagcataacttatttcttgggtggtttggtgccataaaataaccaaagaaaaaaattgtcttgctaacacgtgcgccagatgagctcttttgaaatatagttcatcttcagatgctgattagatgctgagtgtcgtcttataagtggtgccagccttgaaatcggcggggatgacgtcgtcggcgatgcggtagccaccagactcgacagcaaagcggatgcaaagggggtacttgagcggggccttggtgtcgagtgttcaggtgccggtcgggcccttcttcaggaaaggagaagtcatc

SEQ ID NO: 11252 - DNA, 417 bp, Zea mays
  Clone ID: cC-zmpo148069f11b1
ccacgcgtccgtcttcgcgtgcgcaaataaacaagcgcacacgaacaaatacctcgccgccaataatggcctccagatcctccattgtgctcgccacggcgatgctagctacactattcgcggttggtctgtgcaccaccccgctcaccttccaggtcggtgagggatccaagcctggccacctgatcctcaccccgaacgttgccaccatatccgacgtggagatcacagagcatggtggcgatgacttctcctttacgctgaaggagggcccgaccggcacctggacactcgacaccaatgccccgctcaagtaccccctttgcatgcgctttgctgtcaagtctggtggctaccgcatcggcgacgacgtcatccccgccgatttcaaggctggcaccacttattagacgacac

SEQ ID NO: 11253 - DNA, 383 bp, Zea mays
  Clone ID: cC-zmpo148069f12a1
tgtttttttttcttttttatttttttgtggggtttttttttttggggggttttttattggaaatcgatttattccccgggcaaactccggggatggccggagcctgaaacgggacaaaacatcttgggtctcccctccctggtttccctcccgggtggggcacaatacaatttcatttacgccggagctggactgcactgcactgaactggacgagagactggtcggtggctttggactgggcttccttggtttccacccaaaggaaaacccaacaagaacccgagctcccttccaaggcccaacccctgtatgtacaggccatcggagggttttctttgggcccgtcccggcccggccggtcagtttcggagcgggacgggg

SEQ ID NO: 11254 - DNA, 377 bp, Zea mays
  Clone ID: cC-zmpo148069f12b1
ccacgcgttcggtcgagctgcgctacccgtcctacccggagagcaacagttcctggaagttcccaggcatcggcgccttccagtgcaacgacaggtacatgcgtagccgtctgcaggcggcagcggaagcggccggctagcctgaatggggccacggtgggccgaccgactgttgggggtacaacaactggccggaagacaccctcttttttccgggcgacaacggtgggtggagcaccgagtacggcgacttcttcctgtcgtggtactcgcagatgctgctggagcacggcgacctcattctgtcgggcgccacattcgtgttcggcgccacgcccgtggaggtctccgtgaaagagggcggaattcactggcac

SEQ ID NO: 11255 - DNA, 374 bp, Zea mays
  Clone ID: cC-zmpo148069g01a1
ttgcggatttctaatcggaaatcgatatatgccccggacaaactccggcgatggccggagcctgaaacgtgacaaaacatctttgtcctcccctccctgctttccctcccggcttggtcacaatacaatctcatctacgccggagctgcactgcactgcactgcactgcacgagagactgttcgctggctctcgactgcgctccctcgctctccacccaaaggaaaacccaacaagaacccgagctccctcccaagtcccaacccctgtatgtacagtcgatcgtaggcttccgttcggtcccgttccggactcgccggtcagtttcgcagcgcgacggtggcctcgtgcaccagcgacccggtggcctgcgcg

SEQ ID NO: 11256 - DNA, 204 bp, Zea mays
  Clone ID: cC-zmpo148069g01b1
ccacgcgtccgggctctctagcagatggccaccacgggcgtcagggggcgctgtaccagatggtggcttcagccctgccataggacagactttccacccgtaactggcggtgctttgccatccatttgcgccgcatgaacggtaaccggccgtgcccggagggccctgatctggaggcgcacggaataccccaagccaccgggt

SEQ ID NO: 11257 - DNA, 421 bp, Zea mays
  Clone ID: cC-zmpo148069g02a1
gtcaaataaatttacttttactatataatcgctaaaacagctttgccaaacataatgttagttcaatcacatcgtggataactaacccgacccaagacattggttgacaatgattacaatagcccagtttgatacattttcttatcagctgtcatcatcatatacctaatttccagtatgacattacataccatggttatgtgacacacacacacaggacagggcattctcatcaccactagaccagtgatgtgaaggacgatactaaagaattcaattagagacgcagacgcaggactgtctcgacgaaatgcggggaccatcatgccagttgccacacactcagaagtcagaacgtacgcggtacgacgatgaggtcagtcaggcgccccagacggtgatcccctgcatcatgcacttg

SEQ ID NO: 11258 - DNA, 260 bp, Zea mays
  Clone ID: cC-zmpo148069g02b1
ccacgcgtccgacttgttccaccgcgcgctcggggacgccttcttcggcgcactgggaggccaggacgacgccaccgccgcggcggacggcgccggcgccggcgccggcgccgaggaggacgagcaggagatgcgggaggcgttcaaggtcttcgacgtcgatggcgacggcttcatctccgccgctgagctgcaggaggtgctcaagaagctcggcctccccgaggccagcagcatggccaacgtccgggagatgatct

SEQ ID NO: 11259 - DNA, 282 bp, Zea mays
  Clone ID: cC-zmpo148069g03a1
aaaaattaaaaaaaaaagcaatttaaaagagcagaagtagcagtacatctgcatgcatgcaaatttaggcccatcaaaagaagcggatcgaacgtttgcttacgaggccaggcccattatcgctgccctcgaatgcagggcattgacatacacaatacaaaaaacgcggaagggagctaccatcttcaattcttgggcgagcgggcagggcaacaatggatgcaggcatgcacaggacggaggacgatcatggcgtctcggaggcgtccttgagatcgtact

SEQ ID NO: 11260 - DNA, 155 bp, Zea mays
  Clone ID: cC-zmpo148069g03b1
ccacgcgtccgctctccctctccctctccgtcccccaagcaaagaaaagaagctagctagctaggcgtagaacgaatgacgacgcatggcggcaacaggtcgacgacgacgctggtcgccgccgtggccgtagttctggccgtggcggcggcgtc

SEQ ID NO: 11261 - DNA, 374 bp, Zea mays
  Clone ID: cC-zmpo148069g04a1
atacaacaattgttttcccaaagaaatgacagaacattgctgtactgcaaacaaaagaaattcttatttggccatatacattgctgctgtacatgcatattttttaaacgggaaactgaactcacgtgcggtcacctcggcattaccctagtcaaacaatggctcagtatagcattacagtgtttttctatttccattgttttccgtggtcggagaacacaacctaaagatagccctacatctctccgatccttttcgtggaaaggatatacgaaccagatggatttcctgtacagtggagttagcatattaaataactgcacacccgttgttaccaacaatagaaccggggacatgtgccagtggaactttca

SEQ ID NO: 11262 - DNA, 499 bp, Zea mays
  Clone ID: cC-zmpo148069g04b1
ccacgcgtccgcttggttttggtgaggcaaatacatcaatgctatcacaactaactaccgctggtaaagtgaagaagatatttgcccattgtttggataccataaaaggaggtggaattttttctattggggatgtggtgcagccaaaagtaaaaacaacgccattggtagccgacaagccacactacaatgtgaaccttaagacaatcgatgttggtggcactactctacaactcccagctcatatttttgaaccaggagaaaaaaagggtaccataatcgacagtggtaccaccttgacataccttccagaattggttttcaaagaagtaatgctcgcggtatttaacaagcatcaggatataaccttccatgatgttcaaggtttttctgtgtttccaatactctggaagtgtagatgatggattcccaaccatcacattccatttgaggatgatcttgcctacatgtgtattccatgagtactttttcgcaatgg

SEQ ID NO: 11263 - DNA, 365 bp, Zea mays
  Clone ID: cC-zmpo148069g05a1
attttaaactagaacttgatgtctattacataaagaaaggttacatatagattcaggggaaatcttaactctaatagaccggcaggccaaataatgatgccgacccacatacaggctaacctccatgaccatgcgtgtcaactaataaggtttctagcagactgcttgacttataccatatattactatattagtataaaactttgattcggcactgcgactgtacattaatcatgaaaagctgggccacgttcatcaaatgatcaatcgattgaacgcaagaaacgtcggatttcacatgcacacacggtgcgagaacgacacgacagagcgcagggcggccgctgtctgcacagtgacagggg

SEQ ID NO: 11264 - DNA, 83 bp, Zea mays
  Clone ID: cC-zmpo148069g05b1
ccacgcgtccgtctttctgtccgccgacgcgcacagcaagaatgcagggggcgtaagcgccgttcggttgcccgtagaggctg

SEQ ID NO: 11265 - DNA, 420 bp, Zea mays
  Clone ID: cC-zmpo148069g06a1
gggcccccccggggagccacctctcaaaaaaaagaaaccggggaagcccccacaaaatggaataaaaaatttccaccggtgtcaaaaaaaaaaccgccccctttatttaaggaaagaaaaaatcgaaccccccacgccaggccaggggaggagaacccgcccaccttttcaagggccccagcagtcttttagaccaaccccccggatgaacttttttaaaacaaaaaaggggacctaaaacccccccaacaagggcacaacccctggttcttctcccccgggggggcacataaatgggggaacccacccccccccccccctgggggattgggggcccccccctaaaaacttggccccacaggggaaaatcaccggccttaagggggggggctaccctctccctaaaatgggccctttttt

SEQ ID NO: 11266 - DNA, 443 bp, Zea mays
  Clone ID: cC-zmpo148069g06b1
ccacgcgtccgatgtgttctctcctgcatggtccaaaaaagagaaacaggagaagcgtgacgggaaggacagcgaagacctgagcagcacaggcgacaaggcttgtgtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagttgctagtactggggccgagtcaagggacgatgccgctactatggaacgcgagccgctggtagcagcagcagcagcaccac

SEQ ID NO: 11267 - DNA, 350 bp, Zea mays
  Clone ID: cC-zmpo148069g07a1
tcctctagagcggccgtcctttttttttgatagttgtaaacggaaatatcatatttattgggtgacatgattacagaacgactggacgcgaacacatgaattttaaatagtaatgtctacgtaataataatacttaagtaacacatcccgttaccatgcatgcatagatattcatagcagaccagtagtactatatgggaacagcgttgcatgtgacgtcgtccatgcatgcatagatgttcaacagtccatgcttgccaatgccatgcgcgcgtacgtccgttcgttcgcttagtgcaggtagttggctaggagggagaagaggagcgcggcggtcgcggaggcgaggg

SEQ ID NO: 11268 - DNA, 182 bp, Zea mays
  Clone ID: cC-zmpo148069g07b1
accgctccggaggaactgccgggacgccccacgcgtccttgttaggcgaaccagcagcctccaataaaaggggggacatttaaataaaaccgcgcgacctcagcccccaggcaaggagaccgaaaacttaccaccgggccaacccgggagaaagaaggacacgaacaaagaagatcctaaaa

SEQ ID NO: 11269 - DNA, 292 bp, Zea mays
  Clone ID: cC-zmpo148069g08a1
tgtaaaaggaaatatcatatatattgcatcacatgattacagaacgacttgacgcgaacacatgaattttaaatagtaatgtctacgtaataataataattaaataacacaacccgttaccatgcatgcatagatattcatagcagaccagtagtactatatgggaacagcgttgcaagtgacgtcgtccatgcatgcatagatgttcaacagtccatgcatgccaatgccatgcgcgcgtccgtccgtccgttcgcttagtgcaggtagtaggcaaggagggagaagagga

SEQ ID NO: 11270 - DNA, 57 bp, Zea mays
  Clone ID: cC-zmpo148069g10a1
tcctctagagcggccgcccgcgatctatttctagcggacgcgtgggcggacgcgtgg

SEQ ID NO: 11271 - DNA, 56 bp, Zea mays
  Clone ID: cC-zmpo148069g10b1
ccacgcgtccgcttcgcgtccgctagttctagatcgcgggcggccgctctagagga

SEQ ID NO: 11272 - DNA, 420 bp, Zea mays
  Clone ID: cC-zmpo148069g11a1
gaacatgtgttttgggcagcggctatgatggtagtgctcgccgtggtggcgctggcgctagccgcagcgccgcgcgcggaggctgggcagaactgcatctgtgagtgcatgaagctgtgcgtgcggacgcggatcccgagcatgggccagtgcgcgggcaagtgccgggagatggcctgcaccaagagctgcgaggatgcctgcacgcgcaagggcttccccgggctgcccagcgagggcatccccacctgcgagctggagccgctcacccccgacgaaacgcacatgttgcactgaacgatgatgcacttatggggccatgtccaccggagcttttactgtttgcgtgtcgcgccggtcggcccaacggcggcgggctatgctcccgatgtgcatgaaaaattcccgctgttttctttg

SEQ ID NO: 11273 - DNA, 432 bp, Zea mays
  Clone ID: cC-zmpo148069g11b1
ccacgcgtccggttcgcccttttttttttttttttgccagaaaacagaactatgcatactatgctttgagaagaggcagcgtacataataacgtacataccaaacaccaaagaaaacagcgggaatttttcatgcacatcgggagcatagaccgccgccgctgggccgaccggcgcgacacgcaaacagtaaaagctccggtggacatggccccataagtgcatcatcgttcagtgcaacatgtgcgtttcgtcgggggtgagcggctccagctcgcaggtggggatgccctcgctgggcagcccggggaagcccttgcgcgtgcaggcatcctcgcagctcttggtgcaggccatctcccggcacttgcccgcgcactggcccatgctcgggatcccggtccgcacgcacagcttcatgcactcacagatg

SEQ ID NO: 11274 - DNA, 327 bp, Zea mays
  unsure at all n locations
  Clone ID: cC-zmpo148069g12a1
aatttcaaacagactgcattaacgttatgctggtcaatctcacaagagatctgtccaattgaagttacaaatcagaaaaggttgaagaatcaagcttactccttgngctctctgcctttctttctcttccatttgagatatatttggatagagaggcctaagaagaccattacaacactaccccattgcttcaaagataatggattgccactgatgacggatgaaaccacaatgctcatgaatttacgggtggtagtgattgttgtgttagtaagagagcccaaccggctgatggttaaaaagatgaagtttctgccggacgcgtgg

SEQ ID NO: 11275 - DNA, 327 bp, Zea mays
  Clone ID: cC-zmpo148069g12b1
ccacgcgttcttgtagaacttcatcttcttaaccatcagccgggggggctcttttactaacacaacattcactaccacccgtaaattcatgagcattgtggtttcatccgtcatcagtggcaatccattatctttgaagcaatggggtagtgttgtgatggtcttcttaggcctctctatccaaatatatctcaaatggaagagaaagaaaggcagagagcacaaggagtaagcttgattcttcaaccttttctgatttgtaacttcaattggacagatctcttgtgagattgaccaggataacgttaatgcagcctggttgaaatt

SEQ ID NO: 11276 - DNA, 336 bp, Zea mays
  Clone ID: cC-zmpo148069h01a1
tagttaaattttgcaatattgtcttcgaaatggcactgcctacacggagtgactgtgacaccgtactcaccgagcagctgtactcaccgagcactgtctagagtagttcacatggagtaagagaacactggcaccggcggtgcaaaaaacggcacacgggtacatgcagaggccgccggtcgatgcaagacaaacagcttctgtcgttccggggcatgcatggagatcgcgcgagcggatgcgcgtcttcctcttcagagagctcgcgccctgacaatgtacatgctcatctcgctggggtcggtggcctgcaggttcagctggatgcccttcagc

SEQ ID NO: 11277 - DNA, 307 bp, Zea mays
  unsure at all n locations
  Clone ID: cC-zmpo148069h01b1
ccacgcgttctctatgtctaagacctctgcgggactggagctgacgtcggacaagacgtggccgttcctgctccggctccccgtgtcggcgttcggtatctgcctgggcgtgagcagccaggcgatcctgtggaagactgatcgcgtcgtcgtcgccgaccacgttcctgcacgtatcccacaaggtgaancctggtgctctggtgcatctccgtgctgctcatgtgcgccatcacggacgtctacgcgctcaagctcgccttcttcttagaggccgtgcggcgcgagtactaccacccgatccgga

SEQ ID NO: 11278 - DNA, 397 bp, Zea mays
  Clone ID: cC-zmpo148069h02a1
ttttgttaaaaaaatgcctccaaaaatggggtgtatatttaacctttggcttggtgtccactctttggaattcgatcatgaacccgaacaaaaggattacatgtcctagaattgggaaggctcagtagtatataaggctagcggaggatgctgccaacttaattagcttgctgctgaaggtccatagcccggtgtgccggatgaatcgaagggaattcaaagtctaatagaattggaccttggaagtgtagacggcatcgggtctccagttcgcccggatgacctttttggagatgaccttcttgccggactctctggtgaggcagatggagaaagggcccttgggcgccttggcagtggtcatgctccagatggcgccccagggagctctatgggc

SEQ ID NO: 11279 - DNA, 307 bp, Zea mays; identical to SEQ ID NO: 11277
  unsure at all n locations
  Clone ID: cC-zmpo148069h02b1

SEQ ID NO: 11280 - DNA, 334 bp, Zea mays
  Clone ID: cC-zmpo148069h04a1
attttgggacaattctattgcagcttctcttctctgctatctcagaatcatacagaatgggggtacaagaggagaaaaaaatctcaacaccaaagaatgagaggtgctacagagcggctagagggaacacatttttgaagatctacaggcagacggcagacgctgcggtagagaagttaaaagaagccaacatgcttactacaaaaagtagtctggtgtcttgcgcgtcatgtccggctcaatttgcctcggagctgggtcgaattggaggaagttctgatccatgttctcgccaatttcgaggatggcagccatgttttcgccggacgcgtgg

SEQ ID NO: 11281 - DNA, 334 bp, Zea mays
  Clone ID: cC-zmpo148069h04b1
ccacgcgtccggcgttttcatggctgccatcctcgaaattggcgagagcatggatcagaacttcctccaattcgacccagctccgaggcaaattgagccggacatgacgcgcaagacaccagactactttttgtagtaagcatgttggcttcttttaacttctctaccgcagcgtctgccgtctgcctgtagatcttcaaaaatgtgttccctctagccgctctgtagcacctctcattctttggtgttgagatttttttctcctcttgtacccccattctgtatgattctgagatagcagagaagagaagctgcaatagaattgtcccaaaat

SEQ ID NO: 11282 - DNA, 470 bp, Zea mays
  Clone ID: cC-zmpo148069h05a1
ttttaggagatgaggatcttttacatttaaggcctaatggcaattatcacatatgaattgtcatgtacactgagatctctttatgattaaatgtcaaaaaacaatttgtcagtaatcatctacgcccaacctttgaaccactgtgttacttatgcaccccaggactcatgcacgaaaagaatgatgatttccttgtctttgagccaaacagaaaagttctaaggggaattccagcttttgttgacaggttccggaagttttgttgggctcgatggcttctttctagagatacctcgagattctttctgagcttcaagagcacccttccaaccttcacttggagacctcttacatgatccagcccagcttctagctccttagcaactttgatggttctttgtttcatattaaggaccttttcttggaattttgcagcttgaaaagggttgaagtgaatttcatcacattta

SEQ ID NO: 11283 - DNA, 493 bp, Zea mays
  Clone ID: cC-zmpo148069h05b1
ccacgcgtccgccttttcgtccgcggacgcgtggggcagaaattgatagggtattaggggagaacttggacttctggttgagatttagcacatcatatcatcaaatacggaatttccaaatatgctttgacatgttgaaaactgagatgtacagattgactgatgaacaggaagacgggggaaattacggctttgctggtagttatcaggtagcaaagctggaatcagcagtactagaaaagaaattcagggatctaaatacagatcttcaagtttggattgaaaagaacgtgctattgaaaggagaggtagaaaacagattttcgtcactatgctgcatacaagaagatatatcaaagatcacaactctggataaatgtgatgaaattcacttcaacccttttcaagctgcaaaattccaaggagaggtgcttaatatgaaacatgagaacaacaaagttgcttaagagctagaagctggctggatcatgta

SEQ ID NO: 11284 - DNA, 412 bp, Zea mays
  unsure at all n locations
  Clone ID: cC-zmpo148069h06a1
tcctctagagcggccgcccttcnttttcttttttttttttttttttcttttttttttttttgaaaaataaaaataaaatggctttaataccgagatctatagttacaaatcgggagtagtagctttatatgctactatcgatatacaaaccgagagcacagtacatatggtcacactactacaggggcacgcatgtattgccgcttataaatgggggaaaaaaaagataacccgtttctttagcaatggaaagaagaaatgacaaaaacacggcacacacacagagaaggatggttttttttcactgatggccgcctgatggaaacacttgttccgtagtgtatacgggtggacggggggttaatttcatgcaggagctctcccttaaaccttaatcactgcaggagcagca

SEQ ID NO: 11285 - DNA, 498 bp, Zea mays
  Clone ID: cC-zmpo148069h06b1
ccacgcgtccggcttcgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgcctccggggacacgcccaagagcaagctggggatcacggacgccgtgctcaagctgaggctcgccaccgacgccaacatcaacaaggcctacgcggagggggacaaggacaagatcgcaaaaatccttgctgcatacggccaggcggccgacgcggtcgctgcgggcccgcctcccgagaagctcaaagtcatggagaagaccttctggcggtcgcccgccgcgctcatatgaggcggcggcggctgctgctgctgctgcagtgatt

SEQ ID NO: 11286 - DNA, 408 bp, Zea mays
  unsure at all n locations
  Clone ID: cC-zmpo148069h07a1
agntaaagccactctgcatgcataatggtgtccacgataaataagcagccgcgtttcatacaacgtagcccactctgtacattcaagtagttctctactgactagtagtagatagagtaactaatagatgcaatccatcaaaggtcctcagcgtgcgccatcgaaccaagtaggcaatcctatagaaagatccaatccaatccaagcaagaactcggtcgcgtcatccccccacgcttggcgtgcgtgaagctcggcgacttgggtgtgtgcgcgcgcgtgcattgcttatgcatgcttcctagctaggcgtcgcgtccctcactgtttgccaccggcgccggcctcgatgtcgttgctgatggtgctgctgtcctcgccatggctctcgtgcagcttcatgatgggc

SEQ ID NO: 11287 - DNA, 307 bp, Zea mays; identical to SEQ ID NO: 11277
  unsure at all n locations
  Clone ID: cC-zmpo148069h07b1

SEQ ID NO: 11288 - DNA, 407 bp, Zea mays
  Clone ID: cC-zmpo148069h08a1
agcacaagccactctgcatgcataatggggtccacgttaaataagcagccgcgtttcatacaacgtagcccactctgtacattcaagtagttctctactgactagtagtagatagagtagactaatagatgcaatccatcaaaggtcctcagcgtgcgccatcgaaccaagtaggcaatcctatagaaagatccaatccaattcaagcaagaactcggtcgcgtcatccccccacgcttggcgtgcgtgaagctcggtcacttgtgtgtgtgcgcgcgcgtgcattgcttatgcatgcttcctagctaggcgtcgcgtccctcactgtttgccaccagcgccggcctcgatgtcgttgctgttggtgctgctgtcctcgccatggctcttgtgcagctccatgatgg

SEQ ID NO: 11289 - DNA, 201 bp, Zea mays
  Clone ID: cC-zmpo148069h08b1
ccacgcgtcctctattctcaagacctctgcgggactggtgctggcgtcggacaagacgtggccgttcctgctccggctccccgtgtcggcgttcggtatctgcctgggcgtgagcagccaggcgatcctgtggaagactgatcgcgtcgtcgtcgccgaccacgttcctgcacgtatcccacaaggtgaacctggggctct

SEQ ID NO: 11290 - DNA, 266 bp, Zea mays
  Clone ID: cC-zmpo148069h09a1
tggtttttttaacacctgaatttggtggggatttagagaagaaattttataccctcaaattcagggtgttacaccgtcgaacataatatagctgtcggatgtctgtcgttttactgttgtgcgttaccaatggatagcaactaatgggcaatgcaaggacgagagaaaaattataactagagagatgggtcagtcgacggagggtcttgaagcatgcaagcttcttggggcaacccttggtgctgcccttgggcgcgacccggtgg

SEQ ID NO: 11291 - DNA, 255 bp, Zea mays
  Clone ID: cC-zmpo148069h09b1
ccacgcgtccgcgctctgggcagcaccaagggttgcctcaaggggcttgcatgcttctagaccctccgtcgactgacccatctctctagttataatttttctctcgtccttgcattgcccattagttgctatccattggtaacgcacaacagtaaaacgacagacatccgacagctatattatgttcgacggtgtaacaccctgaatttgagggtataaaatttcttctctaaataccaaccaaattcaggtgtt

SEQ ID NO: 11292 - DNA, 405 bp, Zea mays
  Clone ID: cC-zmpo148069h10a1
aaaaaaaaaaaagacaaaaacacaacaaaaaaacaagaaaaacagaaaaaaaaaaaaaaaaaagaaaaaaaaaaatcagagggatggaacccaatagatatgaggaaccacggaggacagaaaaaaaaatgaaaacaaaagaaaaaaaaaacaatttattaaaaaggaaaaaaaaacaaaaaaaagggggggaaataaaaaaaaaaaaaagggggcaaacccaaaacacaaaaaaaacaaaaaaaaaaatgacaaacaacaaagaaaaaaaaaaaggaaaaacaaaccaacagaaaaccaaggagaaggacaaagaagaaatccaacacacagaaacaacaaagaaaccaaaaaagggaaaacaagacgaacaaaaaagacgaacacgaaacccaaagacatagc

SEQ ID NO: 11293 - DNA, 150 bp, Zea mays
  Clone ID: cC-zmpo148069h10b1
ccacgcgtccttgtgaggtgaaccagcagcctccaataaaggggagggcattcaaataaaaccgcgagaccacacccctcaggcgagcagaccgtcggcgaaccaccgcgccaacccgagagacagatggagatgagcaagaggatcccc

SEQ ID NO: 11294 - DNA, 416 bp, Zea mays
  unsure at all n locations
  Clone ID: cC-zmpo148069h11a1
gattattcaacatctatatatattgngatggttacatgaaacaacacgagacagaaggaaagaggggggaaatacacatctttggtctgatcagcatctaccctccactcatttcatgttagttcccgatcaagaatgttccaatcacatttcaattgcaatgtcagaacaatgtaagcatcagtgccaaaccgaagggatgaacaaacaaacaagctgaaacgtccattaattagcagcatccatcttgttattctcaggcacccttcttgccccctccgcatctcacctgcacccccagtgtagcagtcgttgattggcagttgatgtccgcgccgtacaccgtgtgatccaccggcagcatgcaggatggcttgtcgaggcattccttctcaacgatctgctttgcattggga

SEQ ID NO: 11295 - DNA, 455 bp, Zea mays
  Clone ID: cC-zmpo148069h11b1
ccacgcgtccgttttgtggtgtaccataagctttcgcttggagtgggacgatttgccttttagaaatgacatccggcctgtgcttcaggtcaaaagtagtgcacactcaatgatgggatttgccaatgatgctttcgtaggatgcgcacgtggaagcaagcaggtgaagggtttcatgtttgaaaaacccgttgatctgaaagtaggtgtgaaccatgttgtattgctgtcgtcaactatgggaatgaaggacagtggtggtgaacttgctgaagtaaagagtggcattcaggagtgcctaatccagggtctgaacactgggacgttggatttacaagtcaatggctggggccataaggctgcactggaaggtgaggacaaggagatctactcaaaaaaggcgtgggcaaagttcattggaaacctgccgagaacggccgggcagccacttggta

SEQ ID NO: 11296 - DNA, 342 bp, Zea mays
  Clone ID: cC-zmpo148069h12b1
ccacgcgtcctgatttttctaccctaaacacaagaacccagatgcataatataaggtgaaagctagcagaagaggtacctaactctaccctactatagagaaaaagtcagcacattgcaagaaataataatggagacgacgacgaagctccggtggagccggcccggctccttactcctcgtcgccgcggcgttcctggcgtccgccgccgcgttaggcgtaaacgtcggccagttcgacgaccacttgcaaaagcggaaggagctcgccgaggcgtctgagagggaggcgtacagggccgacccgtacaaacgtaccaacaggtttaacgccgtcgtccac

SEQ ID NO: 11297 - DNA, 404 bp, Zea mays
  Clone ID: cC-zmpo148070a01a1
aagagctatgatccgcgcatgcccccctacgataggctggatcctctatagcgggcgcgctttttttttttttttttgacaagaaataggggcctggatttaaccggccaccattttcccctccagggtgttttcccatcaaaccaatggttgacaattaccggccactcttgaccgggaaacagaagggaattccgcatattgagtcctggggaaggacacccttattcaaagaagaaccagtgcatatatatcggctcagcgataaaaagaatatgaaaaacacctcgcataacaatggaaaacacctgaatcaatcgtgaacagaacacatgctgtcaatactcccggaacaaagtaaggacagccaccactgaaaacgtgtggctgacccaaaacaaacc

SEQ ID NO: 11298 - DNA, 103 bp, Zea mays
  Clone ID: cC-zmpo148070a01b1
ccacgcgtccggggtggctccgcctcgcgggacaacacgacgttgcggagttttaagcgcctcaccattaccaccagcaggaggaagtgagctgtcgaggacc

SEQ ID NO: 11299 - DNA, 363 bp, Zea mays
  unsure at all n locations
  Clone ID: cC-zmpo148070a02a1
nttaaannaaaccccttaaaactagggccggatcgacagaatcaagattgcattgtactttggagttgtcttccctcttggagtttggggagagcgttatactatacgctggggtttggggaaagggtgcattttcatggcagccttgtaaccatccatccatcatctatttgccgatttgctttagctgcagagagcaaggatcccgcaaaagttcctcggcctagtaaccgccttccactctcagaattcgtcggcgtggtcctcggcagctcacttcctcctgctggtggtgatggtgaggcgctcgaggctgcggaacgtcgtgttgtcccgcgaggcggagcctccccggacgcgtgg

SEQ ID NO: 11300 - DNA, 442 bp, Zea mays
  Clone ID: cC-zmpo148070a04a1
tcctctagagcgggcccgccctttttttttttttttttgggggacccataactcatagatacataagtcatatatacaatggtaattataaccaggagacaatgctttgagcggtgatataccaattatttcgaccggacgcacacctataatattctaaaacaccgctctttccaacgtgtgagtttcaggccttcgtcgcccgtaggagcagcaaaccctgatcgcatctacacacatgatttacagatcgaggcgaggatgcaacgcggtggctcgaacaagcgctcaaagctcaggacggcccaattgtcgataaggaggatgtctccgtgctgccatagtacgggcactgactcctcctctaggacctggccgcacgcgttgatgacttcagcaagcaggggtgagagcatcgcctgaggtcaccgccttcgtgggg

SEQ ID NO: 11301 - DNA, 379 bp, Zea mays
  Clone ID: cC-zmpo148070a06a1
tcctctagagcgggcgccctcttttttttttttttaaatcaaatagtgaaaggctgtcaaacagatgggacttaatgatacagggggaaagccctctcttagggggaagaacaaaagcggaacacatcaatgcgttaacataaggagatagggggaacaaacaataagaggacataaggagagctgaatgaacagcatccccactcaatggaatgcccagggccatggaactatttctactggtacacgacttactcagcctcctggcaaccggtcgtggggggattactgattgtagaaggccaagaatgaagcaacggcgggccccagggcgggggctacagtggacacgacagtagttgagcccatggcgggggcc

SEQ ID NO: 11302 - DNA, 424 bp, Zea mays
  Clone ID: cC-zmpo148070a07a1
caaatcgaattgttgaatggattcaaacaaatggcaagcgatgatacaagtgttaatccctctctcagggggaagaacatcagcggcatgcatcaattcgttaaattaaggagaaagagggaacaaagaaaaagaggacaaaaggtgtgtcgaatcaaaaacatgcccacgcatcggaatgcgcgcagccatgtcactctctctcccgcttcgtctcttcctcggcctccgggcgaccggccgcggccggctcactgaatgtagtaggcgaagaaggaggcgacggcggccccgagggcggcgccgacggcgggcgcgacggcggaggagccgctggtggggcccggagccggagcctccgcggcgagcgccacggtggccgccgaggcggcgactaggacggcgcaagcgatcggacgcgtgg

SEQ ID NO: 11303 - DNA, 59 bp, Zea mays
  Clone ID: cC-zmpo148070a08a1
tcctatagagcggccgccctacaccttttatccttaaaacaacaccataaaaccattgc

SEQ ID NO: 11304 - DNA, 422 bp, Zea mays
  Clone ID: cC-zmpo148070a09a1
aaaacataaaaaatgaataaggcttttattgattgggtttcttctcttcatgcatgaaacaaggccggaaccggaaaccctaaaacatatatatatacgtacgtatccaacagcagcacatacatatacatgtaaggaaattaaaataatttgatatagtacctaccccttggaaagacctgcatgcgggggggcatcaatataatataaattataatatgcatgccaatcgatgcaagaaggtcgagaagcgatcgatcatagtagatagcctgcctatatttatatataataattaatcgattcatgcggcggcggcggcaacggcggcgtggtgtgtgaatccgaaggcgatgtgcgccatccgaccgtactccctgttgtgcgcggagacggggacattcttcttctggcccttccac

SEQ ID NO: 11305 - DNA, 91 bp, Zea mays
  Clone ID: cC-zmpo148070a10a1
ggaaaaaatgtttcacagtgctgatcattgtgcttctattggtgaaaggaacaggagttccatgcccaacaatttctgctcggacgcgtgg

SEQ ID NO: 11306 - DNA, 434 bp, Zea mays
  Clone ID: cC-zmpo148070a11a1
tcgcagatacggaaagactgtttcaaatctgtgacataatgatttagggagatagctcacaccttttacaccatgccaacctttaacagtactttgcatatacattttttaatttgccaacccgacgctaattaaatctgtccacaacaatgtgacctgggacgacattagatcgagcaacaaggtcaattgatctagtttcactcggacacgactaattcatcgccatcgcaaccacttgtacgggtattatgtatggaagaagagcgtgaataaaacactgacgaggatcagctcgagtgcttcactgaacaagccactacttgagcccagtgcctgagccttgtcttcacaagcagagggttatctcctgggttgcaaatcttccatgactccaaggcgttactagagtgcgcaccagggctacctgggct

SEQ ID NO: 11307 - DNA, 391 bp, Zea mays
  Clone ID: cC-zmpo148070a12a1
tttttccagattgccctcctttcttaacactaatttgcaccatttacagaatcagctttagcttacagggactaaccaagtctgaaaaatatcagttaatgatgcaaagccagcatcgatgcatcataaacgatgactgaatgagccatgcgtgtgtgtttttataagctgagacgtagtaaaatgtagaagatcccatacagcgctgcctgatcagggttgggagcttgcatctgaagtggcagcaggaggcggcgaaggcttgcttctttggcggctgaacaagttgtgcttgtgccaagcggcagcgacgatcgacaagccactgaacctaagccatttggttccccctttaggttgagagacctcgctggagtcctgtgccttgttt

SEQ ID NO: 11308 - DNA, 518 bp, Zea mays
  Clone ID: cC-zmpo148070b01a1
tcctctagagggggcggccctttttttttttttttgtaagcaagcaaagatcttttgatcagccggccacccgtaggtacagtacagtactgtgctgtgacatgatttaaggccagggatgccatgccatccatataatatacacagtttcatttacacgagcatgctacgtcctcctaataattagtaataaataatccctttgagcaccaccaccacgattaattagaaagagaaagaaggacaggcaaggtgtgtgtttgaagattgcttaattagctgcacagatttggagtacatgcgccgtctggtgtctgctgctctttccagatccgtacggtgatcctgagcttgagctccttacggtccccgccggagaagaagagcgccatgttcctctggatgatgaggccgtcgtggctgtccctcaccttgcggtggctgtcgcggacgcttcttggagtgccctaccacacatttttctcccgttggcgccgacctcgaggctgtagctgtag

SEQ ID NO: 11309 - DNA, 343 bp, Zea mays
  Clone ID: cC-zmpo148070b02a1
ggccacaaatcaacattaacattatggaatgggattacagatatacactagcataatgaataagttccaagattgtgaggcgtcggtctaataataattacatcggttggttttgtgatgatccaaagaagaaagaaaatccaaaccagcggattatatattcgggggagacttgagagtacgtgagaaagagagaggttcccaagagggattatatatataatatatgcatgttagtcaattggttcagatgcaggcgagctcctttgccaagccgatggacttgccgatggcgttcttgcagacggccatggtcttgttgccggatccattgtacttgatg

SEQ ID NO: 11310 - DNA, 357 bp, Zea mays
  Clone ID: cC-zmpo148070b04a1
tcctctagagcgggcgcccgcttcgccactttgttgagctccacccgcggctgcatctcctccagatccaactaccgctgacggtgaccccggcacagcctcagaagacggtgcacctagacccgggtcctgggcgcgtcccgaccagacaagcacaccaccgccaggatcacaccctcctggagtacacgacgcgtgccgtgatgaactcagttgaagatcacggacagacacgacacggccacaccagtgatggcaggttcactttcgaggaggacgagaacgaaggcatcaacaatcgccggtccggacgcgagcccatcattgccaggggacgccacctccagggtgaatgcc

SEQ ID NO: 11311 - DNA, 496 bp, Zea mays
  Clone ID: cC-zmpo148070b05a1
tcctctagagcgggcgccctcttttttttttttttttggacccaacaacacttgagtgacttggcttgaatttcatgctgtccccaactgtacattaatagggcaacacatgaactaccctgactgaccctgaccccattaattgctggtttaagttgttacaatccgacattcacaaagaggttgaaaatgcgattgcttcgtttccttcacctgctggctgcagcaggagggatgctgagccactgcagctgcagctgaatcttcccgctctccacgttcctgagccggaggatcatgtcctgcgcgaacttgccgttcctccagcacacgtggctctcgtgggcgaggcagttcgtggcgctcggccgcaccgacaggatgatggcgccgttcctcaggctcgcctccgggctcgcgttcgccgcctccaccagcggtgccacgttgatctccgtgtcccccatcgggtcgtccctgtgaacgtgtccttgtt

SEQ ID NO: 11312 - DNA, 390 bp, Zea mays
  Clone ID: cC-zmpo148070b06a1
tttttgttcacccagggaccggaggccttcactaggttcatctttagaaacggactactgcacacagaaacaatgggcccaaagggccactgattctgccagttgtaccgtctccaactcatgatgggcagtcggccatacacacaaagctgtctgcatcatggcgcactcacgcgccccatctccgtatgtctcccaggttttctgccatcgcatgcaggctttaatacctgtaacctgtgctttcccatccctgcaggtctttgggctgcatgcccgcgaatatcaacccgccacctgcaaacgtatcagctttccttataccgagtactattaaagcttgccagaatcaccttcatctgtggcccctgccggaccctgttatgcggt

SEQ ID NO: 11313 - DNA, 509 bp, Zea mays
  Clone ID: cC-zmpo148070b07a1
gaccaaaaaaatttatattattcattcataagacatcaataaccaatgacaatccgaacacagcatggtgttgtttgctagtagcctcatcaggcgtctcattagaattgaatggaccttaacatattgtgtccaaaaaatcacaggtgagaagcataggtagcgacagttattgcagtcttgatgaataggggaggaaagcggcggccgatagaccggcacaaaactttgttcgcgctaatgaagaaacggcaacgaaaacgggggcaggagaggctggcggcggtaacggctcccccacggcttgcatttctcgggcccaaagaattagaagcatttcctgtggacgatggatgggccggactcgtcgtactcggccttggcgatccacatctgctggaaggtgctgagggatgccaggatggatccttcgatccagacactgtacttcctctctggaggagcgaccaccttgatcttcatgctgctgggagccaaggcagtgatct

SEQ ID NO: 11314 - DNA, 321 bp, Zea mays
  Clone ID: cC-zmpo148070b08a1
tcatgacatactattgaataaatagtgcgggacacgaacagatacatagagttactcaatatatataactcagagtttcacagggtccttaatttactgaactgtgaatgcacgcattccttgaatgccatggcacctcacgccggggttgcatgcgcggttcatatcatgtttgcacgagccatgcattcgctggtcatccggctgagctcaccgtcaaacttccctagggggtggccgacgccgatacgtgcgacggggctggcggacgcagttacgtcctggactgcgagctgcacaatgaccttggcggggacggag

SEQ ID NO: 11315 - DNA, 397 bp, Zea mays
  Clone ID: cC-zmpo148070b10a1
aatcaaatcgtttcagttatataacggttgaccccataaagttacaagagcaaacgaagtgagcaaagcaaagcaacacttgcgttattggtccctcccgaccagacgagcaattaccgcacagccaactacgtgcccaccctcgacgacacggtccctggtgaactcagtagaagatcatggtagcgacagcagcggcgacaccagcgatggcagctccgcttccaagggtagcagcaccggaggcatcagcagccgccggtccctcagcaggcccatcagcggcaggggacgccacctcggcggtggatgccgacggcgaagggctcaactcctcgtccgtggaaaaagaccgtgtaaaggcggcggtggtcggcgcggcagctggaccagactt

SEQ ID NO: 11316 - DNA, 479 bp, Zea mays
  Clone ID: cC-zmpo148070b11a1
aatagtaactgccagcatgcctttttattattatccattcaatcgatgaaaaacacacatttgcgtgacattacatttggagttccatcgacggtatatatatttgaacaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatgcatggttcattcatttcaaggggcttcgcttcaagaaggaggaggggtgcaggacctcttgcagttctcgctgaggcgcgggttcttctccttggcgcaggtgacgctgcaggccttggtgacctaggccgccttaccacgtacgccttgtcgcactcctcctggcagaccttcatggccggcgccgtgatgccct

SEQ ID NO: 11317 - DNA, 440 bp, Zea mays
  unsure at all n locations
  Clone ID: cC-zmpo148070c01a1
tagcttaatacaattntcacataagaagcaagcactgggtacattttgtttatttgcttatgttcactttgattatagaggatactgctatccatgccatgcgcgcgttcgctctgcaacatggacatagttttgagcagcctgtccgcgacgccgccatggaacagtttactggccgtcgtggagagccgagtccagctgtttgagcaggggggcgcaaacggggaggggcacgtccttgaagaagcccagcgggttggcggcgggcaggctgtcggagatgccgacattcctggagagcaggacaccggttcggtccctgagcgcctggacctagtaacataccttgcggggactggccaccagcaccacctggcaaatgccccccgtggggccgcccttgagctcgatcgggaacgggcccgccgcatgggttaccc

SEQ ID NO: 11318 - DNA, 439 bp, Zea mays
  Clone ID: cC-zmpo148070c02a1
ttgtttttttttaatttttttggggaatgaagcactctgttacatttttttatttccttttcttccttttctttcaggggatactgctatccatgccatgcgcgcgttcgctctgtatcatcgttatagttttgggcagcctgtccgcgacgccgccggggtacagtttactggtcgtcgtcgtcgtccgagtccagctgcttgagcagcgcggcgcaaacggggagcggcacgtccttgaagtacccgagcgggttggcggggcgcaggctgtcggagatgccccacgttcctggtgagcaggacaccgggccggtccctgagcgcctggacctcgtagcagtccttgcgcgggctggccaccagcaccacctggcagatgtcctccttggggctgcccttgagctcgatcgggtaggggccggacgcgtcggtgacc

SEQ ID NO: 11319 - DNA, 502 bp, Zea mays
  unsure at all n locations
  Clone ID: cC-zmpo148070c03a1
tngaagaagagcacgtcttatataattaaccatgctcacgtttggtttcttaacgaacaagacagatcgatcggattgatggatcgtgcagtgagtcgttctcctcgtcatcgatcagaggtcacgatggccggcggcggcgggcgctggcagctggccgctgttggctatgacgaccttggccttgggcacgccggtgagctggccctcggcttcgatcttgcgcacgacgtccatccctttcaccaccttgccgaacaccacgtggcgcccgtccagcttcttgggcaaccggttttcgtctacggtggtgatgaagaactgggagccattggagtcgggcccgtagttagccatggacagcgtaccggctttagcgtgggtgtgcttgaagttctcgtcggagaagatggtgctgccgtagatggactcgccccccgtgccgttgccgttggtgaagtcgcctccctggatcatgaaccccggatgatcctgtggaacg

SEQ ID NO: 11320 - DNA, 230 bp, Zea mays
  Clone ID: cC-zmpo148070c04a1
tcctctagagcgggcgcgctctttttttttgttatgttgttctcccaacgagccacatccgacgcaacatttgaaaaaatgatttggtttgggcacaaaggccaccaaagattttttatcggttacaacaaatacagatgttgcgccaagttaaatctttctgctaacaaattaaagcgaaggagaatggggcaaaccgaccgcgtggccggacgcgtgggtggaaccca

SEQ ID NO: 11321 - DNA, 455 bp, Zea mays
  Clone ID: cC-zmpo148070c05a1
gcacggtaactcacttttctgatctgtatttatgtgcaggttgatgacaatttatatctatttaaggaacattatgttacagttagagctacatttgaggagtaagagggacacacggagaggaagaaggaaaacgtgaatggaagccacgccaaggaaagatcagcgcacaaaggtcagggacaagagggcagcgatgccaggccacaagaggccgttccccgtgctggagctgaacgccgaggaggtgttgtcagccgtccctggcgccggcgcgtcggcggcgatcacagctttaactggaggcagcggcgggtccacaacgtcagcgggttggagcaacggtgccggcgcttccggcggagccagcgcccccggggatgccaggttgaccagagcgccaagttgtgcaggcaggatcgtgtaattcaggttcagcttcatgtcactgcatg

SEQ ID NO: 11322 - DNA, 299 bp, Zea mays
  Clone ID: cC-zmpo148070c06a1
gcatgcgcgcgcgcgcgtgctcgtgtcctctatagcgggcgcgctctttttttttattgtacaaaatagaacctgcattatccattcaggaacttatgttaatttaaaacggcagcgaattctgacgatatgtatgtaaagagatgaacaggggggagcgaggagatgacaccccagttgatggcgcccgccagaccatcagatgggggcggcggtggcaaactgattgctcagcgcaatgcatacgggctgatcgtattggtggggagccagcccactctagtatagctagtataggc

SEQ ID NO: 11323 - DNA, 429 bp, Zea mays
  Clone ID: cC-zmpo148070c07a1
tgttttttttgaatatgcatgcatgatgcatgttatcatctgcatggctgcttgcgggcatgcaggttgaagaagaggagggaaagtggctacttagaagttcttggacgcctggtacgtgacgccgaacttccagtcagcagggagaacgtgccatgaggtggccttgcggtggtcgctggtcatcacccggaacgtcagcgactcgcatgtgaggtcctccccggtctgccacacttgcccccagttgcgcttcatctccgtccacttaacgcgcttgctccccttcaccgacactgccgcgatgtcgccggcgccgcccacgttgtgtgatcgtcaccatgttgaagtacttgttcccggtgactggtgtaccgaatgccgccctgcttcgtgcacgccaccctgcggtaggagatgggcacgatg

SEQ ID NO: 11324 - DNA, 478 bp, Zea mays
  Clone ID: cC-zmpo148070c08a1
aattggaaaccacattttggagcttgtgatgcatattatcatcacaagcgagcacaaaaagatcttatacaacaccaacaacaacaacattgttgtctagttcaggtagaggcgtagagcaaattctggttgcatgaaacctgaaaaccactacagcagcttccatctgagctcttccctgatggcatgaggccgactcgtttgtctgtccccggccctgaaaaaacacctgctcatcaggagagctagctcacggtccaactcctttgatatgtttccagcatcttctcttgctctgtggtaagtacgtgcaaatctgatgggcgtttagttgtgtccatgccgtgtctctgccatcagtgctcctcctcctcggtgcctttcatgaaccatggccggcgaccagcttgccggatctgctgctcgtggatgtgcaggagctcgtcgatgcgccggggctgcgacagcagcggccctg

SEQ ID NO: 11325 - DNA, 203 bp, Zea mays
  Clone ID: cC-zmpo148070c09a1
tgaacaagaaaatttttttttgatcattggggaccactcttattgagcattgcatatctacactacaacttgatttaagggcagggatgcccagccaggcatattatcaacacagaatcagaggcaccaacatgcctaccaaaaactaataatgaagaataaacgatccctctatgaccaccacgacgatgaacaaaaaagag

SEQ ID NO: 11326 - DNA, 449 bp, Zea mays
  Clone ID: cC-zmpo148070c11a1
tttttatataacgtgtcaatccatttcttaactctgatcttttaaacaacagcgaagtctcactctagctatatatggagatgaagaagatggagaaggaggatgacaccatcattgttggcgccagcatcactgtcataatagggtagtggtagcaaatagatatcacggtccaatgcatgcatgtgtaatgcattgcttgggatccaacccaatctagtatagctagcataggtcagcttaaagtattgtcagcactaaagttaattatttggcggtgtaggcggcgttggccttccagttggcagggatgacatcgtcgtagacggacttggtgcctccctcggtagtgaggcggacggtgaggggtcccttaagcggtttgtcgctgtccttcctccagatggcgccccaggagtgcttcaggggctcgtacgtgtcggagccct

SEQ ID NO: 11327 - DNA, 287 bp, Zea mays
  Clone ID: cC-zmpo148070c12a1
ctatacctatgttttttcaaacaaacaacgggccaaaccatgcgggacttttaactttaaaagagcggtaaacccccagtctagctaggaacggagatgaagagagatggacaaggaggacttacaccatacttgtgggcgccggcatcacagatataagagggcagtggaagaatcatagattcacggtccaaagcatgcggtgctgaacgcattggttgggggggaaccccatctagtaaagctagcataggtgggctaaaaaggtcgggagctctcaagggaag

SEQ ID NO: 11328 - DNA, 355 bp, Zea mays
  Clone ID: cC-zmpo148070d01a1
ttcacaaaactgaaaaaaatccattacacaacagaggaagctccacaggttacaagaacaggtacacggcaatggcagagccgtacgattctgtatttactagtaatacataggtcgtacctggtgtcataaaattctgcaccaaactcatgctagaaacaacacctgctctagctacccctcgtgctaggcagcttatgcacctgcacatgacatcaccaccacccattgaccgatgctggaaataaaagtccatttgatgcccgtcaagcgtacgaccttgtcgcggcatggactaatcacccgatcttgagctgaacactgatacttggacactgtgagtgccatcatcatc

SEQ ID NO: 11329 - DNA, 507 bp, Zea mays
  Clone ID: cC-zmpo148070d02a1
gaaagaaagaatctgaatgtcgctcggcggtatgagatctacaacaggttctgagttcatcatatatcaatcatggaagcaacgaacaaaaagctctcagctctcctctgccaaacaagaacgcagcagcgatcaagcacgcgctgcgctacgcagccgtcaggccttccatggtttctgttacacggtacacaaaaatcccatatgaactcaaccagcagccaagcgatcactcaactaagtcagccaatcgtatcggacacaacccccgccgccataagacagacatccgcgagagagcgacgtccgtgcgcctcagggtcatgatgcagacggcgggcagccagctgcctagccactctctctaacgcagttgcctgggagaaggtacctgtaccgatcgaattgctccagcagataggcagggagatgaacggcggagaatgtactcgggataggccccagcttggcgaagatctcttggacgtgtactcttcgggaagcatg

SEQ ID NO: 11330 - DNA, 349 bp, Zea mays
  Clone ID: cC-zmpo148070d03a1
acaacgacttttacgtctggcgcacgcagccgcaggcttggattctctagagggcggccctcattattgttctgttggccacccacagagcggacacagtcaatcagtacatgctgcgtgatggtcttgtccacatgcaaccatggcatcatacaggccatcattaggctggatgaccggactctaactcccatgggtcctacaggaacataaggggggctgcctgaatgatatggatgctactgacagcctcgcgggagggctccctctttagctgctgactggcggacgccagcacgtctttgaactgcacgtacgaagctctgattggttgacgctgggcgaccat

SEQ ID NO: 11331 - DNA, 497 bp, Zea mays
  Clone ID: cC-zmpo148070d04a1
ctttacaatagcaagaatccagcactcagaagggggtactgccacgcagttacatttttgttttcctttcctttctcagttacatatttgcaatccaggtgaagaggatttgtggtttagtgccagccagtctgcgacgactgcggtcggtcgtcgacgacgtgctattacatatcgatcgtcgtcgtcgatgtgctattactgatcgtcgtcgccgtccgagtccaactgtttgagcagcgaggcgcagatgggcagcggcacgtccttgaggtagccgagcgggttggcggggcgcaggttgtctctgatgccgacgttcctggtgagcaggacgccggcacggtccctgtccgcctgcacctggtcgcagtccttgcgcgggctcttcaccaagaccaccttgcatatgtccttcctcgtggctgtccttgagcttgatcgtgtccgtgccgttcccgtcggccaccccgtctatggagcgcctcgagcttgcc

SEQ ID NO: 11332 - DNA, 541 bp, Zea mays
  Clone ID: cC-zmpo148070d05a1
tcctctagagcgggcgccctcttttttttttttttacacatctgtgaaacagatatttcatgtaaccaaacacaggcaaaactgttccctcaatcagcaggttcctgcctccacctgcggcttttatttcacactttatttatgggctgaatcgacaaagagacccctagatccatcacaaatgtcactacattgagaaccaggtcgctagccctgggaacatggagcctgccactgccattgtgggtcaaacggtgtgtgatcttgcctcagttatgcgcagcctgccaagttgcggatgacataagggaggatgcctccatggttgaagtacgccagctccacctcagtgtcaaagcgaacgatgcaagtgaaagatttcccattgtcggtagtaacagtcacatgctggccgggacggatctcactgaggctggagggagatcgatgctgtaccgctcatgtccagtgaggccaagtgaatcagcatcctgaccagctttgaagcacagaggaatgattcccatccccaccaagttgc

SEQ ID NO: 11333 - DNA, 512 bp, Zea mays
  unsure at all n locations
  Clone ID: cC-zmpo148070d06a1
tgagaaccgngtcatctcatgtagtgtctgtcgacatatcttgcatgctttacttaactcacaagatctgatccatctcagcaaggactaataataaggtaattaatgtgccatgcatgacatgaatgatttactagtacttaatcagactgccgcgatgccccattatcaataatccgagctgagccgtgtggtgagctgccagcctctggaaatggaacaggggagcttagctagctagctagctagggaagaaggccctctgcatgcatgctgcgctggccgatggagaagttcgttggtcggatagatcacaccttgatctcttcctcggcgggcggcttcgggcgctcggacttcttgctcgacatgatgctgttgaagttctctgatttgcacagcaggatctcgatcttggctttacggacaagccggcccttcgcctcatccttggtgccgatggttgatgtgaggatcttcttttcagtggcgaggccattgttctgaggatc

SEQ ID NO: 11334 - DNA, 262 bp, Zea mays
  Clone ID: cC-zmpo148070d07a1
aaaaactcggcctaggagggaaagaccgccctcccgatattgcatataagaagataccgaaacaatggtccggccgagaaaatccctgaaccctggcccccatcactaacgggccggcactaacgggccggcgtcaactgtccactctgcaacggcccaaccggagggtggcgcataggacatcgtaacctgagagcggattgggcacagcgaggggatttttttaaccaagactgaaacccacgcgtccgcggacgcgtgg

SEQ ID NO: 11335 - DNA, 484 bp, Zea mays
  Clone ID: cC-zmpo148070d08a1
ttagcggttcagattgatcacaactggttaagatgtcatttgaatttgcacattgatttacatttttttaactccggcaccgtatcggagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccggtctgccacacttgcccccagttgcgcttcatctccgtccacttaacgcgcttgctccccttcaccgacaccgccgcgatgtcgccggcgccgcctacgttggtgatcgtcaccatgttgaagtacttggtcccggtgatggtgtaccggatgccaccctg

SEQ ID NO: 11336 - DNA, 476 bp, Zea mays
  Clone ID: cC-zmpo148070d09a1
cagcttaatacaattttcacatattctctttttacaggctgattgatgattctggttacatgcaacctgatcatcatacaaatttccttttgactgtatcacagtaatctaactaccattagtactatttgtacaaaaggttgcaggcagggaggtcatggatgctattgagatcctccagggagagctccctctcgagctgctgccttgtggcctccagcacctctttgaactgcatgtacgaggctcgcattgctagccactgggcgtccatcatctcgaacgctatgcagtacagcacgtcgaatgcatcctcgtgttctgtcaacactttgatgaagttaatccctggcaaagacttcgggcgcactgagttgagctccaacagttgaatcagcatgtatgagatgtttacacctgcgaccgaaaggggtactcccacgtagttcgcattccttgctgcttagcatcagtct

SEQ ID NO: 11337 - DNA, 469 bp, Zea mays
  Clone ID: cC-zmpo148070d10a1
gatcacaactggttaagatgtcatttgaatttgcacattgatttacatttttttaactccggcaccgtatcggagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccggtctgccacacttgcccccagttgcgcttcatctccgtccacttaacgcgcttgctccccttcaccgacaccgccgcgatgtcgccggcgccgccttacgttggtgatcgtcaccatgttgaagtactttgtcccggtgatggtgtaccggatgccaccct

SEQ ID NO: 11338 - DNA, 323 bp, Zea mays
  Clone ID: cC-zmpo148070d11a1
aaaacaaaggacaagggggggtccataaaaacctcccccccctttgtttttcctttaaacaaaccaatcccatttgggtcgggatttgttgggccccccggggtttaaccaacggatcaataatcaattaatgaaccttggggcgggggggggggcccggttccctggcttacccggcccccccgggggcccccttgatgagcgcgggggccacccccataaacccctcaaagtccttttttttgggcagcaacgtgtttttcaccggcctggatggggcgttctttcaaaaaaccttacaagaccccgtgtcctcctccccc

SEQ ID NO: 11339 - DNA, 300 bp, Zea mays
  Clone ID: cC-zmpo148070d12a1
gtttaaaagcaaaatgggatgataagaatgtgagcatatagtgacggctacagttcacacacaagaacagatcaaacgaccacgggacgaacgatcaagcaatcaatgtgccatgcgtgaaccgcgtgaataaataaaacattttatgactggggtgaaccaaacacgttgcataccaacgctgacgccccgggcgaggtggctgactggaggaagtgggcaaggaaggatggccacgagcgcctcggtggcaggaacggcctctgcatgcatgccgcttgcgctcggggcagaagtacc

SEQ ID NO: 11340 - DNA, 342 bp, Zea mays
  Clone ID: cC-zmpo148070e01a1
taacgatagaacatgcatacccaatgacttgttggtgtaaataaatggtgagataaagttatatatataactcccattacaatgatttttttgagaaccccagtacagtgatttgagagggcatgcatctcaagattacatatatccattcatttgttccccttcactacgcttctttcgtatttgttcttttgagtttggattggatggccagaccacgaggagaaaacgaggccttcgtcgtcttagcgcgcgggggcgtaggacggcggcagcggcagccccacgaccttgccgcaacggagggcgttgtcggtcatgttgtactcgtcgcgcaatgat

SEQ ID NO: 11341 - DNA, 507 bp, Zea mays
  Clone ID: cC-zmpo148070e02a1
tcctctagaagcgggcggccttttttttttttttttaactctcaagcatgccctttattcatcgaatcaacgagacaaaaaattaccgcaaatgcttatttgcgtgacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatatatgatgtatcagtgattcagtgtcacgcaagcaggcagaagacgacgaccggcgggcgtgctctgcgttcaggaaggaggaggggtgcaggacctcctgcagttctcgctgagcagaggctgcttctccttggcgcaggtggtgttgcaggccttggtgacctcagccgccttgaccacgtagtccttgtcgcacgccttttggcacacctttatctgcggcgcggtgatgcccttctgctcggtgcacttgcccttgcactgga

SEQ ID NO: 11342 - DNA, 428 bp, Zea mays
  Clone ID: cC-zmpo148070e03a1
aagcccaattagaacatgttgtttcatcagaagaactccgggggggaaaataatgggagacatcgaaggttagtttggtacatgggggggccggtcgagagtgttttttccgacctatgccaaactgtggagaattcaagtgccgaacccttgcttgatcacaggttcacacactgaacatgaggcatgattagccaattttattaattggcacgcatgcacggacagtcgatcagctttgctgcgccagcttttccttcccggcctccttggcgttctttttcgcctccaccgttgtaggggcctcgggggggggggcgaccttttcctttgcatgggctgctgccgctggcttttcctcctcgacgacggtcttttccacggtttccttctccttgtggacgggcttggggaccgccgcctttgga

SEQ ID NO: 11343 - DNA, 410 bp, Zea mays
  Clone ID: cC-zmpo148070e04a1
cagacaaactgggtttatcgatgcgagcagtgattcatttcttcctgatccatattgggtagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccaccctaagcaccctcttcctggtcgctgtccatctggtgcagatcctcagcggacgcgtagcggctggtcatgcccaccttcttgatctcgaagccgaaccgatcctgctacgggggcggcaggatcacgtcatgggacacatcgggtgtggc

SEQ ID NO: 11344 - DNA, 511 bp, Zea mays
  Clone ID: cC-zmpo148070e05a1
cccgatcaagcacgttccaatcacatttcaattgcaatggcagaccaatgggtcattagcatcagtgccaaaccgaagggacgaacaaacaaacgagctgaaacgtcaattagcagcatccgtcttgttgttctcaggcacccttcttgccgcctccgcatctcacctgcacccctagcgtggcagtcgttgattggcagttgatgtccgcgccgtacactgtgtgatccaccggcagcatgcaggatggcttgccgaggcattccttctcaacgatctgctttgcattgggagtgtggcaagtgcctacagtgaagttgccgcacatgccgtccgggttgccgaagctggcaaagacaacttcctggattgtcttctcaggggggcaggtcaaggtgccccgcctgctgtgatcctctgcaatgagcttgatcttgtcaccatccgtgtcccacgtctttatctgtcccgggttgtgctccgagataaacaggcatatgtcgtctctcgt

SEQ ID NO: 11345 - DNA, 383 bp, Zea mays
  unsure at all n locations
  Clone ID: cC-zmpo148070e06a1
ctacgaagcgtcgtatcctctagagcgggcgccctcttctttttttttttnnnnnnannnnnnnnnncacccaaagcggacacatttattttttgttttattttaattgaacaacaggggcctaaaattggcaggctttgaatcaaccgtgaacccaaaaaaagcgggaaattatcaaattacaccggcacacgtttggttttttaacaaacaaaccaaatcgcccgatttgatggatcgagaggaattctcctaaacaaccaaaaggaggcccaatgggcgccactggcgggcccatatcaagtgcacccacttaggtataacaaccttgcgcttgggcccccccaggagatggccctcaatttttttcttgcggaggactt

SEQ ID NO: 11346 - DNA, 302 bp, Zea mays
  Clone ID: cC-zmpo148070e07a1
gcatggttcttttctcgggcataatgttacatgggcacacacttgttacattacctatgctggtatacccttacgcacaaacgtacatgcgcttatttgatagcattcaattcaggtcgctagagcattgtatggggcgaacgacttggcactgcttctcctggcctccctcatcgcgattactctcatcgtcagtagagcgcgctgagatcaccgcttagtatccttggaactgaggcgggggtggcgacccatactggtgcgccatgattgggggcaagatgaactcctcaggtgcccgc

SEQ ID NO: 11347 - DNA, 476 bp, Zea mays
  Clone ID: cC-zmpo148070e08a1
attgattcgtgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctcctcccccatcttggtgtacgagtagacgacccgggaggagtccccccaagcgcggcccaggtagatctggccgcccttgacgccgtcgatgctgcagtttttgaacgagaagccggtgtcgatggcgccctcgatggacttggaacgctgctgcgccgtcagcaccgccacctccttgaccaccgacttgatgcggca

SEQ ID NO: 11348 - DNA, 412 bp, Zea mays
  Clone ID: cC-zmpo148070e09a1
tttaaagcattagaaaaaatataatgtcattcagataattttctcatgttattatcgttacatagtcaagaagaaacatagtcaagaagaaacggattgcaagaatgcaatggaaagaagggatccctcttttacaataaaagggatcgtattttgagtggcaccggtaacccaaacccgcgtcatcggtcaggctcaagctgacccatcgtcgtcggaatcagaatcgtcgccggacgatggtgctggggcgctggaggtgccatcagaagatgggcctggtgcggcggaggactcagacgacgacgatggcgctggtgcgctagagggaccggatgaggccgccgccgccggagcatcagcagccgacgcgctggcaccagcaccggacgcgggcgcgtcgtcaccagac

SEQ ID NO: 11349 - DNA, 487 bp, Zea mays
  Clone ID: cC-zmpo148070e11a1
catccaaagcgcacacatatacgcgatggttaaattgaattgttgaactggcccagacaaatggcaagcattggtacaggtgtcgatccctctctcgagggaaagaacaaataacggggcaccaaattaaactggtacatcagcgataccaattagttaaatgaaaatcagaaagaggaaaggaaaaaaacaaacaaaaggaagacgaaggtgtgccactgccgtgcccaatcagagcacacccacccacgcatagggaatgcgcgggagcagcagagcagcgcatcgcagccaagtttctcccccccttggtctcttccctccggcagtccggctcctcgtccggcggttcagtgaatgtattacgcgaagaaggaggccacggcggcccctacgatggcgggtgcgaccgcggaggagccgctggtgggggacggagccggcgcctacgcggccagcgccacggtggccgaggcggctacaagga

SEQ ID NO: 11350 - DNA, 503 bp, Zea mays
  Clone ID: cC-zmpo148070f01a1
aaaacaaactgggtttatggatgcgatcactgatccattacttcctgatccatattgggcagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtagatggcgtgtgggcaactgctgtcaccgtaatcgccaccctcagcaccctcttactggtcgctgtccatctggtgcagatcctcagcggacgcgtagcggctggtcatgcccacctccttgatctcgaagccgaaccgtgcctgcgacggcggcggcaggatcacgtcatggtacacatcggcgtggcccaacggcggtggcggcggtggcggcgggtagtactccagctgccccggaggcggagcgggcgcataccgtccacgaggcgcttcacgacgttg

SEQ ID NO: 11351 - DNA, 435 bp, Zea mays
  Clone ID: cC-zmpo148070f02a1
cagacaaactgtgtttatcgatgcgatcactgatacatttcttcctgatccatattgggtagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgttattgccaccctcagcaccctcttcctggtcgctgtccatctggtgcagatcctcagcggacgcgtagcggctggtcatgcccaccttcttgatctcgaagccgaaccgtgcctgcgacggcggcgggaggatcacgttatggtacacatcggcgtggcccaacggcggtggcggctgtggcggc

SEQ ID NO: 11352 - DNA, 306 bp, Zea mays
  Clone ID: cC-zmpo148070f03a1
ataaactgaaaaaaatccattacacaacagaggaagctgcacaggttacaagaacaggtacacggcaatggcagagccgtacgattctgtatttactagcaatacatagctggtacctcgtgtaataaaattctgcaccaaactcatgctagaaacaacacctgctctagctccccctcgtgctaggcagcttatgcacctgcacaagacattaccaccaccccgtcaccgatgctggaaataaaagtccatttcatgcccgtcaagcgatcgaccttctcgggggcatgggcgaatggtccgctc

SEQ ID NO: 11353 - DNA, 66 bp, Zea mays
  Clone ID: cC-zmpo148070f04a1
aaaaccaagaaggaggaaggaccccgagggaagagcgaggaccctcaaaaggggcgcgccacaaaa

SEQ ID NO: 11354 - DNA, 187 bp, Zea mays
  unsure at all n locations
  Clone ID: cC-zmpo148070f05a1
tcctctagagcggccgcccccttttttttntttttttttttttttattgtgttttatctcccagggaattttttaagttcctatcacctcctcccaacaaagacagcaggccctcaaagactctacaaaggcaagggggccaaacaagggaaagaatgaacaaacccccgggggacccccccccccc

SEQ ID NO: 11355 - DNA, 477 bp, Zea mays
  unsure at all n locations
  Clone ID: cC-zmpo148070f06a1
tcctctagagcggccgccctcacnnnnntttatttnatntcaanannnannnnaaggaggaactgccagaatgcctttttattattacccattcaatcgatgaaaaacacacatttgcgtgacattacatttggagttccatcgacggtatatttggaaaaaaacaattagcttagaaaatgccagattaataggaatacaatatattgttccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaggaggaggggtgcaggacctcttgcagttctcgctgaggcgcgggttcttctgcttggcgcaggggacgctgcaggccttggtgacctcggacgccttcaccacgtacgcc

SEQ ID NO: 11356 - DNA, 297 bp, Zea mays
  Clone ID: cC-zmpo148070f07a1
ccaacaagaatgcggttggtgggcctagtgatccccggacgcccgggcggactcttggaccaacccggtaattgcggaccagatcatgaaggcatacaagctttacgtatagggagcaatgttacagcttggggcactgatggtcatagcatgtctcctgtgagaaattgatatccgttgacaattaaccacaacatccgagtgggaagcataaaggggaaactgtggggagcctaatgagcgacctaactaacattattcgggttgctctcactgcccggtttccactcaggaaac

SEQ ID NO: 11357 - DNA, 483 bp, Zea mays
  unsure at all n locations
  Clone ID: cC-zmpo148070f08a1
gatcctcgtccagtacagtgtgccatgaatcaaaattcagcgttacaagatgtgtatacatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaactcggcgagcgtcaccttgtcggtgctgccgctgtagcctatggttgtccagccggccgggtggatggtcttgcaaggtaaggtgtcggcgaagatgacgcgcgagtccggcgcggtgacgcggcccaggtacacctccccgacgccgtacaccttgcccttgaggaagacgaagccgctgctgtcctcctcctgccgcacctgcgcggtgatggagccgcngatctccgtccgccggtcaggcct

SEQ ID NO: 11358 - DNA, 322 bp, Zea mays
  Clone ID: cC-zmpo148070f09a1
ggggaaaaaggccccccccccagggaataaggaggggcgaaacaaaaaatgggccaaggggcttttgggggtcccccggggaaaaccgccaaggggggggaaggggggagggacaaaatggcggccctccgggttccccccccctttgggggggggggcaaggattgggccaaccccccaaaactttgggcccccccccccaagggggggtcccccccccacttagaagagggggggtaggccatgcccgggggcctttaaaactggaaaccactttgggggggggccccggggtacctggccccacgggggcccccaaaaa

SEQ ID NO: 11359 - DNA, 455 bp, Zea mays
  Clone ID: cC-zmpo148070f10a1
ggatcctcgtccagtacagtgtgccatgaatcaaaattcagcgttacaagatgtgtatacatgcatgcatgcttgatcgatccagcagtcgatcgtcggatcagtagtagtacgccggcagccagtccttgccgttgatgaagtcgatggtgaggtacttggccgcgtcgtcgggagagaacctccgcgaccatggcacgcggttcgtcacgtcagcgcccggcccagtgcagttgaactcggcgagcgtcaccttgtcggtgctgccgctgtagcctatggttgtccagccggccgggtggatggtcttggagaggtaaggtgtcggcgaagatgacgcgcgagtccggcgcggtgacgcggcccaggtacaccttcccgacgccgtacaccttgcccttgaggaagacgaagccgctgctgtcctcctcctgccgcacctgcgcggtgatgga

SEQ ID NO: 11360 - DNA, 361 bp, Zea mays
  Clone ID: cC-zmpo148070f11a1
tatgttaagattgtgttgtatcgtgtacttaaaaaacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcaggtcacctggttgttgcagcagcaggagcaggaccaggagggaagttcacccactgcagctgcagctgtatctccccgctctcgacgttcctgagccggaggatcatgtcctgcgcgaacttgccgttcccggacgcgtgg

SEQ ID NO: 11361 - DNA, 387 bp, Zea mays
  Clone ID: cC-zmpo148070f12a1
ggcccctcaaacacattttttttcaacaacagggtcgtatcatcgtcatcatctgtcaaacatacatgatacatccagcaagatgaaacacggaggggggcaaaaaaaatagcgctggctgaattacagattagtggggtgggtataagccatcctgtacgttctcaaggagattcgactccgattcattgccacgccaagggagggggtgctccaggcacaacatcaatcaatctgcctcgggcgtgcagctgccatcaacaactaacattttaagaatgcaaatacaacttactatgcttgtgagaacgcggtttactcctcgaagccatccatcatggggcggtggcctccttccgaagaaagtgttctttgaggactgttttc

SEQ ID NO: 11362 - DNA, 258 bp, Zea mays
  Clone ID: cC-zmpo148070g01a1
ctcaaacaaatggaaaaccaaatcatatattgcatctgttgattacagaacgacttgacacaaatagataaattaaatcacgtctatgtaattaacacaacccgccaccatgcatatatattcatatcagatcacatcaataataatatatggaaacagcggtgcaggtgacgtcttccaagtcgaccaccgcagcaacagtcaccaagaacgagcgaggcaactgcaatggcaacggaggacggatccatcgtcgtc

SEQ ID NO: 11363 - DNA, 473 bp, Zea mays
  Clone ID: cC-zmpo148070g02a1
tggtccttagagcgggcgggccgtcgctgtcctttttggggtcgatgacagtctcgacggcgcggacgagcagcgtagaccttgctccgacgcttctccagcagctacgggcgcgcctcctggatcacgttgttgctccgcgccacctctaggcgacgcggatgctccgactccgctggcgccttcaacgccggactaacacggctgtcgtggaacctgaccatagcctactgcttctagtacttctccgcctactgcttcttgatcgcctccttcacaaccgacacgaacttgtccgtcaccacgtcttccactgctgctacagcaacgatggcctccggcgccggcgccggcgacagagccgcttcttgcttgggcgattccaccacctgctactgctcgtagaggttgcggccgcagcagcggctataggctacggcgcccgcgacagaggcgtttctttcttgggcgac

SEQ ID NO: 11364 - DNA, 452 bp, Zea mays
  unsure at all n locations
  Clone ID: cC-zmpo148070g03a1
atggnaatcttcgttttataccaaaggaagatttaagggctttttatacataaccagtcaaggaattcacggttggtaggcgggaatgcacttgcactcgcttcagatctcaacgccggcaaaaccaaatactttgactgcgacctttcgctactgacaaaatcacttattgtgcattgggatcagacccaacagacgctagcacatagcagtcaatcgcaaaactttgactggaaccttccgcaacagaaggaactcaatggccttgtaactcaccaccatacaacagacgctggcacataacattcaatcgcaaaacaatagcaaaattgcattgacattttactgaacacctagactgtatgcaggggtagcataaagcaacatgcgggatactctaccttgacgcggctcttggagtagcccacgacgacggaactattgaagaaaca

SEQ ID NO: 11365 - DNA, 365 bp, Zea mays
  Clone ID: cC-zmpo148070g04a1
tttttggaatcaagcactctgttacatgggggtattttcttttcttccttttctttcagtggatactgctatccatgccatgcgcgcgttcgctctgtatcatcgttatagttttgtgcagcctgtccgcgacgccgccgtggtacagtttactggtcgtcgttgacgtccgagtccagctgcttgagcagcgcggcgcatacggggagcggcacgttcttgaagtagccgagcgggctggcggggcgcaagctgtcggagatgcccacgttcctggtgagcaggaccccggcgcggtccctgagcgcctggacctcgcagcaatccttgcgcgggctggtcaccagcaccacctggcagatgtc

SEQ ID NO: 11366 - DNA, 320 bp, Zea mays
  Clone ID: cC-zmpo148070g05a1
gttcttaaaaaaaagggggagataaagttttttatttaactcccattacaatgatttttttgagaaccccagtacagggatttgagagggcatgcttctcaagattacatatatccattcattggttccccttaactacgcttgtttcgtatttgttcttttgagtttggattggatggccagaccacgaggagaaaacgaggccttcgtagttttaacgcgcgggggcgtaggacggaggcagcggcagccccacgaccttgccgcagcggagggcgttgtcgggcatgttgtacttgtcgcgcaatgatcgcgccggc

SEQ ID NO: 11367 - DNA, 207 bp, Zea mays
  unsure at all n locations
  Clone ID: cC-zmpo148070g06a1
tnnnnnnnnnnccnnnnncaaggagnaactgccagcatgcctttttattattacccattcaatcgatgaaaaacacacatttgcgtgacattacatttggagttccatcgacgggatatttggaaaaaaacaattagcttagaaaatgccagattaataggaatacaatatatagttccggccatatcagatggatatcgcatgcgg

SEQ ID NO: 11368 - DNA, 516 bp, Zea mays
  Clone ID: cC-zmpo148070g07a1
ctattcttttacaactttaatatatttaaactccatgaataatcgattcgatcaaatgattacaccaaattaaacatgcctcctccgcccaagcatatacccgtacgcacctaattaatccgtatgccgaccctactacctacatcaacctccggtctcaccgcggcgcggcgtcggcggcaccggcaccggcggcgaggactgcctcgagcgtggtgacgaccctggccatggagggccggaccttggggttctggctgaggcagtcgtacgcgaggcgggccacgcgctgcaggcccatctccgagcagacctcgcccatccgccggtccaggatccgctccaactttttgggccggataaggatgggccgcgcccagtccaccaggctgccgtcgcggcctcccgcccggctcggctccagcgcgcgccgtcccaccagcatctccagcagcaccacgccgaagccgtacacgtcgctcattaccgtcaggtgcccggtggctatgtactccg

SEQ ID NO: 11369 - DNA, 517 bp, Zea mays
  Clone ID: cC-zmpo148070g08a1
atggtaatcttcgttttataccaaaggaagatttaagggctttcgatacataaccagtagaggaatccaaggttggtaggcgtgtatgcacttgtactcgcttcagatctgaatgccggcaaaaccaaaaactttgactgcgaccttccgctactgacaaaatcagttattgttcattttgatcagacccaacagaagctagcacatagcagtcaatcacaaaactttgactgtaaccttccgcaacagaaggaactcaatggcctcgtaactcaccaccatacaacagacgctagcacatagcaatcaatcgcaaaacaatagcaaaattgcattgacatttcactgaacacctagactgcatgcagcggtagcataaagcaacaagcgggatactctaccttgacgcggttcttgtagtagcccacgacgacggatctattgaagaaacatggcctcgtcgtagatggcgggcgcacacctgcagcggcgtgtccccaccgtcgttgaacgcgga

SEQ ID NO: 11370 - DNA, 383 bp, Zea mays
  Clone ID: cC-zmpo148070g09a1
ggctgtacgatgcgtatcgtattcgtatccaatagattaacaggggcaggggtgaatatccattaccatcgccgaccgctactacagtctacacgaatgctacatgtccgccgcgcgctttttgagctccctgaccctgtccctgctggccgccctgccgtgggagcgtcgcgggctcatccgccgccgcagcgcgaagcggaggtgtccggtgtccttgaaccgcctgcgctccgactcgacgacgtcgcacttggggaacgcggcggggtagcgcagcgtgtcgtaccagtaggagtagaccatgttgcgctcccggaacctgcgcatggcctgctgcttctccaccgtcatgacggccacgtccgacccctgagtgcgtc

SEQ ID NO: 11371 - DNA, 427 bp, Zea mays
  Clone ID: cC-zmpo148070g10a1
atggtaatcttcgttttataccaaaggaagatttaagggctttcgatacataaccagtagaggaatccaaggttggtaggcgtgtatgcacttgtactcgcttcagatctgaatgccggcaaaaccaaaaactttgactgcgaccttccgctactgacaaaatcagttattgttcattttgatcagacccaacagaagctagcacatagcagtcaatcacaaaactttgactgtaaccttccgcaacagaaggaactcaatggcctcgtaactcaccaccatacaacagacgctagcacatagcaatcaatcgcaaaacaatagcaaaattgcattgacatttcactgaacacctagactgcatgcagcggtagcataaagcaacaagcgggatactctaccttgacgcggttcttgtagtagccca

SEQ ID NO: 11372 - DNA, 508 bp, Zea mays
  unsure at all n locations
  Clone ID: cC-zmpo148070g11a1
ttaatgaaaaccctgagctttcattagctcgtctatatatatatataagcaaaacatctcatcagtaaagagattagagattcgtgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctcctcccccatcttcgtgtacgagtagacgacccgggaggagtccccccaggcgcggcccaggtagatctggccgcccttgacgccgccgatgctgcagttcttgaacgagaagccngtgtcgatggcgccctcgatggacttggaacgctgctgcc

SEQ ID NO: 11373 - DNA, 294 bp, Zea mays
  Clone ID: cC-zmpo148070g12a1
ggatacaaaacggtaattaaaatcgtaacgaggagaggagatcgagtagagcagcatgatcgacgatccttttttagaaccaaaactgggtttcttgaattataaatattccacctcaattcgcctccccgtttccgagaccaaattaacgcatctttacaggaaataacgatgtgagatggtcaaagcaaaacaaacttaactcatcagttattgtcgcgcgagagcgcgctcgcgggcatgggcatgcgaacgttagcagcggcgacaaacgatgcgagggcccaaaacgcc

SEQ ID NO: 11374 - DNA, 288 bp, Zea mays
  Clone ID: cC-zmpo148070h01a1
taaccacgaaatgagtttgtatcggaatgaaaatccatgaacagtatcatcgatagttgaactgtgaagaatcatgtattggtactgtacgtgtccatggatctttaatggccacaggtgccatgaaaataataccgcacaggattagagggggatccaatgcgcgatcgacatgccgtcggacacatcgattcatctgccgcaaccgaacatactttatcggccggtgaggccaggcaggacgccatgcgacgcatctgttcgcgcctattggcaagccgccaacag

SEQ ID NO: 11375 - DNA, 317 bp, Zea mays
  Clone ID: cC-zmpo148070h02a1
gcaatgatcaaccaacaagaccatggggggaattattaaggacatgtggtcttattcccagggacgttcgcgacaaccccgaaccagagacagagaatgcacctgtgtgttcaccacaccaaaatggcgggcctgggatacatagcctcctcagagaaaacacagcatcggtgctgcctttactcgaacctgtgtgcttgcaagggaaaacgaaagatggccacgcatcgccggaggaggtcgcggatagctcgctcgtaggcctgtcccgatcacgggggcgtcgatgtcgttcaggtgggacaggcttctgcaaa

SEQ ID NO: 11376 - DNA, 190 bp, Zea mays
  unsure at all n locations
  Clone ID: cC-zmpo148070h03a1
gcgaagcttgtatcctctataggggccgccctctttttttttttttttcataacaaatgaataaggcttttattgagggagtttcttctctttatgcatgcaacaagggcggaaccggaaaccctagaacatatatatatccntttcgtattctacagcatgacactcatatacatttaaggaaattaaa

SEQ ID NO: 11377 - DNA, 273 bp, Zea mays
  unsure at all n locations
  Clone ID: cC-zmpo148070h04a1
ggntnngcataggctagttagttagtagcgggtggatttgaaccacaactggtaggttttacaaaagtacatatataatcaagttacgccacagagctttggatgaattttcagattgccctccttccccaactctaaggtgtagtatttttttttctctacaacaggagcagtccagagctgatgcttcttgcgccatttacaggattagcttatcggatgcggggttagcttacaagaactaaccaggattggaaaattacagcaaatgac

SEQ ID NO: 11378 - DNA, 320 bp, Zea mays
  unsure at all n locations
  Clone ID: cC-zmpo148070h05a1
tgncagagaataaagcactctgttacaatggggcatatccttacctaccttgtctttcagtgcatactgccatccatgccatgcgcgcgcaagatctgtatgaacgaaatagcagagtgcagtctgtccgcaactccgacgtggaacagtttactggttgacaacatggaccgagtccagctgattgagcagtgcggcgcaaacggagaggggcacggccttcaagaatccctgccgatagctagcgcgcatggtgaaagagatgccgacgactctgaagagcacaacgacggaacgatccctgagcgcctggacctcgt

SEQ ID NO: 11379 - DNA, 440 bp, Zea mays
  unsure at all n locations
  Clone ID: cC-zmpo148070h06a1
ttnnnggaancaagcactctgttacattgttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtagccgagcgggttggcggggcgcaggctgtcggagatgccgacgttcctggtgagcaggacgccggcgcggtccctgagcgcctggacctcgtcgcagtccttgcgcgggctggccaccagcaccacctggcagatgtcctcctcgtggctgtccttggctcgatcgtgtaggtgccggtcgcgttggtgaccccgtcgatggcgcgctcgagc

SEQ ID NO: 11380 - DNA, 397 bp, Zea mays
  unsure at all n locations
  Clone ID: cC-zmpo148070h07a1
ccatttatcaatcatcaatcacattgttaaatatatcacatacattttttattattacattgcatgtacgtgacattgttgtagaatagaagagaagtatttccccttccaaacaaacaaaaaagaagggaaaacgaagttcgtaatcgtagtatcgaacacacaatcatgtttccctttcctcgatcctctcttcttcccgcggaaaacgaaggaagcccacgcatcgccggaggagcttgtggatagctcgctcgcgggcctgtcccgatcacctgtcgtcgttgtcgtccagctgcgacgggctcctccaaaagccggtgccgtagaacctcgcccacaccttcttctccagctcccccttttcctccagctgcaaggcnggcggcacgcgtgg

SEQ ID NO: 11381 - DNA, 458 bp, Zea mays
  Clone ID: cC-zmpo148070h08a1
gcaatcattttttaacagatatttgagtagaattatacagcagttgcaatcacacctaatgcggggttgcaatcacaccacaccagaagttgcaattacacctctttgtcctgacactaaaaccagctaactttgcatagtcaaggtaaaagaggtaggcttcttcccttgtatcaaatgtttgccgcaccctggggacaaacacatcaagtatgtttgcatccatccctaatcacatcccacgagccatcaccgttgaagtgcacgcggcatagtagatctccacccgggtgtcgccgccctccttccgaaccacgtcggacttggggtgttcctggccaccatctcgtcggggtctgaggtcccggaaaacgctgagcatgcccggcgcctcctcctgctactggccgatctcttcctgcagcagcttgatcctctcggcaggtcctgggatataa

SEQ ID NO: 11382 - DNA, 415 bp, Zea mays
  Clone ID: cC-zmpo148070h09a1
gcaatcattttttaacagatatttgaggggaattatacagcagttgcaatctcacctaatgcggggttgcaatcacaccacaccagaagttgcaattacacctctttgtcctgacactaaaaccagctaactttgcatagtcaaggtaaaagaggtaggcttcttcccttgtatcaaatgtttgccgcaccctggggacaaacacatcaagtatgtttgcatccattcctaatcacatgccacgagccatcaccgttgaagtgcacgcggcatagtagatctccacccgggtgttgccggccttctttcgcaccacgtaggacttggggtgttcctggccaccatctcgtcggagttgaggtcccggaaaacgctgagcatgccccgcgccttcttctgctactgcccgatcttt

SEQ ID NO: 11383 - DNA, 426 bp, Zea mays
  Clone ID: cC-zmpo148070h10a1
atatagcggcacttatattgggttattttacgactgtgggagtacatgcttgcatcttacatgtattatcattttctcttcacacacaatagcatcctcatttgaaataatgctaaacataacatcttgcaatacacggtgcctactaataaacatcctcaagctatctactacgctgaagaatacatattccgtggattttgacgtcatggttgattgacaaaattttttgctggactttttgccaagttccataattaataaagctcacctcttaaccaaccaagaataacaataacccctaatgtacatggcacaaggtacaacaacgcaggttgaccatgcccgtccatcaagaacagcccaagatacgtaatgaaaaggccaactgtatatccgacaattagccagataaaatttccactc

SEQ ID NO: 11384 - DNA, 506 bp, Zea mays
  unsure at all n locations
  Clone ID: cC-zmpo148070h11a1
taagagagaacacaactggttaagatgtcatttgaatttgcacattgatttacattttgtaactctggcaccgtatcggagtgcatgagcgaaagaatgaatatgcatgcatgatgcatgttatcatctgcatggctgcttgcgggcatgcaggttgaagaagaggagggaaagcggctacttagaagttcttggacgcctggtacgtgacgccgaacttacagtcagcggggagaacgtgccatgaggtggtcttgcggaggtcgctagtcatcacccggaacgtcagcgactcgcaggtgaggtcctgctcggtctgccacacttggccccagttgcgcttcatctccgtccacttgacgcgcttgctgccgttcaccgacaccgtcgagatgtcggcggcgccgcccacgttggtgatcgtcaccatgttgaagtactntgtcccggtgatagtgtaccggatgcacgcctgctttgcgcatgccaccctgcgataggagatg

SEQ ID NO: 11385 - DNA, 445 bp, Zea mays
  Clone ID: cC-zmpo148070h12a1
ggtactcctagctcagttcttcactaccgaatcgttgaatgaatacaggttccgtcttgacatactaaatacagaaagaatgagaaaccaaggggcaaaatacaaactggaggatgaaccaagcacgagtggaaggaaagatctgcaccccgttgccatttcgtataataataactaggatgcaaacagcaaaagaaagaaaaatggagactagagcagaaatttcatcttcttcccccgagcgagccttttcccccacgtcggtctcaactcaacaacgcttccgttggctgcaaccttttcttgcatcttactacgcatcagccggcgcggacgagaagatgaggctcatcaggagccccaccatgagacctattagcccagcaaacgcggtgaacgtcagggagaaacctgcatcgcctttgcggcttctgcgccttcgaag

SEQ ID NO: 11386 - DNA, 345 bp, Zea mays
  Clone ID: cC-zmpo148071a01b1
ccacgcgagcggagaatcgttatgcaaccagcgatcgccccatggccgacatgggttggttcgcttccctcgtagcggagcccctcctactgctgtaactggtcgactacgacgctggcagtgcgcggaccgggagctacacccggcacgacgcgtgcagcaagacccagttccccaagagctgcgtggacagcctggcccgcaagccggagagccagaaggtgacaccgctgaagctggcggagctgtacgtgaaacatcgaggccgagaagggatccgggatggccacctttgtgcaccgcaagtacagcgacaaggaggacagcgaagtattcaagggctac

SEQ ID NO: 11387 - DNA, 340 bp, Zea mays
  Clone ID: cC-zmpo148071a02b1
ccggttcgcttacgcgtccgggatgtgtcatagggcatcgacgcgaaagcggccgggcctggtgggtccttcgacatcaccaaggtgggcgccccccgcaacggcaagacagacagcacgaaggctgtgcaagaggcacgggcatcggagagcggcggcactgggaagcagacaatccttatacccaagggcgactttcttggcggacaacttaacctaacaggcccttgcaagggtgaagggaccatgcatgcggatggcaatctgcgggcgaccacgggcctaagccagtacaaggaccatggtaactggaacgagaatcttacgcggggataaccct

SEQ ID NO: 11388 - DNA, 252 bp, Zea mays
  Clone ID: cC-zmpo148071a03b1
ccacgcgtccggttcgtggatttcggtgccacaacctctcctgctgtcgttgctggtcgccgtgctagcggtggccgccgatgtcgccaacgccggccacgccaagcccctaacgcctggcgggcgcgtggtacacgacaaccacggcaagttcacggtcgggccgtggaaacccgcccacgcaacctttctacggcgggcgtgacgggtccggcaccactgcgggcgcgtgcgggtacaaggacacgcgca

SEQ ID NO: 11389 - DNA, 252 bp, Zea mays
  Clone ID: cC-zmpo148071a04b1
ctacgcgtccgcaaattttaatttatctttacaaatatatatatgcgtgtggtttgtatttgtaaagattcgttcggattttcattcccaccgggaagatttgtaactgtcctcctccctccttgtaagttgctccctgtaactcttcctgaattcatggcgtgtcgttgagcaatcaccacttcctccctgtgaatgcccacagcgtgtcttggtgaaagcatgtatgtatgaatattggagtatatgtta

SEQ ID NO: 11390 - DNA, 199 bp, Zea mays
  unsure at all n locations
  Clone ID: cC-zmpo148071a05b1
ccacgcgtccgaaggtccgttgaagccgncgccgacgcccgactcgtggaagcttaaggagatcttcgccacgggcatcgtgctagggacctacatggcgctcgccacggggctcttcttctacctggcgcacgacaccgacttttttaccaacgccttcggcgggcggtccatcaaggagaacgacaaggagctgatg

SEQ ID NO: 11391 - DNA, 409 bp, Zea mays
  Clone ID: cC-zmpo148071a07b1
ccacgcgtccgttccctaaagatagcatagcagcagcactcacaatagcaaaaaccaccatccgtcgtcgccaaccgtagcaaggagccaaggacatcaccaccgcccagcaataatggcgcagagcatgaggattgtggcgctggccttggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggaccagggcgccggtgccgccggcgccgcgccggcttgatcgcccaacgcattcatcggttcagttcgatataaatcgctgctccgtcagcaacccacatatgattcgatcaatcttcct

SEQ ID NO: 11392 - DNA, 397 bp, Zea mays
  Clone ID: cC-zmpo148071a08b1
ccacgcgtccgttcttttagctttggcagccaatcgcctcttgtcctgtcgtcgtctcttcctttcgcgtgagcagttcaggcgttcttgccctttcctcgctcaggtcaggtggggataggatcgtgacgtcgtcatcgccaccaccacccccagcatcccgagctgctgctggcggtggggcaaccgcgtgcgttgctagcttgctcgatctgcctctcctctggatcccctgtcctgtccctgttaatcgcgcgcgcttgcctatttacaaggcgaaacaagcgcgcagcagtggccatgtcgtccgacgcggtggccgccagcagcaggaagggccggctgaagcagcgctacgacaaccagttccgccttgtcgcagggtgcgtgccgtacc

SEQ ID NO: 11393 - DNA, 369 bp, Zea mays
  Clone ID: cC-zmpo148071a09b1
ccacgcgtccgtagcctcttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagccccagggcgtgggggtggtgcttgccggcgggggcatcgaccttgacggcgacggtgaccaggacgagctgccccacttccaaccccaccttatgatcctc

SEQ ID NO: 11394 - DNA, 325 bp, Zea mays
  Clone ID: cC-zmpo148071a10b1
ccacgcgtcctggcagtgttcagggaccaaaaacaacagcagcggagggggtgacagagcaagaaccacctgcgccgccaccgccactgaagcggcggcaccatacgaggtggagaagcaggaggtgatcaagcagtgggcacaggccgctgacgcattcagcgcctctgaagcttacagcagcaggttcaggcagacacttgctgccaggcagctcaagaatggaaagatgtacaaggggaaggtgagcagggtggaccacttcagggccgctgctgtcacagccccggcgcatcgacgagttcctgctgcatagccacgagca

SEQ ID NO: 11395 - DNA, 344 bp, Zea mays
  Clone ID: cC-zmpo148071a11b1
ccacgcgtcctcccatttgtccggtccgggttcatctgcaagatcatggggttccacaacacggccggcgcggagcggcaccaggcggtggcgctccgggtgcagggggacctcgcggcgttctacaactgccggttcgacgcgttccaggacacgctgtacgtgcacgcgcggtggcagttcttccgcaactgcgtggtctccggcaccatcgactttatctttggcaactcggcggcggtgtttcagaactgcctcatcattacgcggcgggtccatggacaacccagcaaaactcggtgaccggcgcacggggcgcacccgaccccaaacatgaaattccg

SEQ ID NO: 11396 - DNA, 170 bp, Zea mays
  Clone ID: cC-zmpo148071a12b1
ggcagaccgcctctgcaccgttaccctgaacccacgcggactccggttgacacgaatcgtgagcggactaccagtttcagtccaggaaattggtggcgctgctgcgcgcatggcgactctggattgcggtctgccccacccacgaacaatccatggctccatcttcgcct

SEQ ID NO: 11397 - DNA, 445 bp, Zea mays
  unsure at all n locations
  Clone ID: cC-zmpo148071b01b1
accggnccggaattcccgtgtcgtcccacgcgtccgcgattcngtctgcgccgagtttctccggcgaccgggcttctaggtgctttttagagtctagaagcggtggaactcgggtttctgtgcctactgcggaaggattctcaagcgttctctggactctggcggaggagaaagaaaccaccgctgatgtgaaccatgtgatgtcttcgcgttctgctcttgttttgatccttttgcgtggagcgaaggcttttgccggagctagctgctatatggaacgaagaagaggccggtatcctaatgtccgttcacccgcccattttcccggcccaacgtctccgttcttgacgacgaatggggagggggaggcagaaaagggtattgatagaccgggtggtgacccacaatgaccgatcaaaatttacaatataaccctttatttaat

SEQ ID NO: 11398 - DNA, 418 bp, Zea mays
  Clone ID: cC-zmpo148071b02b1
ccacgcgtccgcgactttgttccgcgccgagtttctccggagaccgggcttgtaggtgctttttagagtctagacgcgggggaacttgtgtttctgtgcctactgcggaaggattatcaagcgttctctggactctggtggaggagaaagaaacacccgtgatgtgaaccatgtgatgtcttcgcgttctgctcttgctttgatccttttgcgtggagcgaacgcttctgccggagctagctgctatatggaacgaagaagaggccggcatcctaatgtccgtccaccgtccattttccggcccagcgtctcgttctcgacgaccaagggggagggggagtcagaaaagggtatggagagaactgggtggagacccacaaagacagatctaaatttacaaaattaccccctttagtta

SEQ ID NO: 11399 - DNA, 389 bp, Zea mays
  unsure at all n locations
  Clone ID: cC-zmpo148071b03b1
ccggnccggaattcccggttcgatccacgcgtccgcgatttggttaaataacctctccggcggcgagacagatggagtcgacctccggcgaggatgctccgaagcgcaacccgctcccgtccgcgctcgtctccaacctacagttcgtgctcgccgcccgccgcccgtccgcggcagaggtcagcaccgccgccacagctagcgaggctgaggctgaggctcaggaagcggaggcgtccgatgcccccgcgggagatgggacgccggcgaggcccatcgtgctgctgacctgtgccggggggatccggtcggcgggtctcgcggcgctcgtcgacgccctctgtgtcgccggccgctgcgacgtcccacgtgtgtgcccccgaatcgga

SEQ ID NO: 11400 - DNA, 354 bp, Zea mays
  Clone ID: cC-zmpo148071b04b1
ccacgcgtccgagcttttcgtgataccacaacaagacgatcgacgggcggggcgcgcaggtgcacatcatgttcgcgcagatcacgctgcagaacgtgcagaacgtgatcctgcacaacctgcacatccacgactccaaggcgcactcgggcggcatgatccgcgactcgaagcggcactacgggctgcgcacgcggagcgacggcgacggcgtctccgtgctgtcgtccagcaacgtgtggatcgaccacgtgtccatgtccagctgctccgacgggctgatcgacgtggtgaacgggtcgacggccattaccgtgttcaacagccactttaccgaccacgaccacgtgatgc

SEQ ID NO: 11401 - DNA, 515 bp, Zea mays
  Clone ID: cC-zmpo148071b07b1
ccacgcgtacgttcggtcctctcctttcgtcaccatcacatccagccagccaacaaaaatgtcgcgcgtcacagctgcggtgctcttttacatcctcgccgttgctgccctcagcgcggccgaggccccggcagagtcaccgaaggaaggcagtgctgccaaggcacctgaggctgccaagagaactgctgcccccgctgaagcacccggagccgcgtccacccccgtcgccgccgctgccccatcatcgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctggtgctaccatgatcttcttctactaaactcaccgacgatggtcgtgtcgcggtgagacattagggt

SEQ ID NO: 11402 - DNA, 487 bp, Zea mays
  Clone ID: cC-zmpo148071b08b1
ccacgcgtccttttcgtccggagtagcaagcgtctccgatccgatccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggtgggcgactacgcgcggcacgagatggacgtggtgaaggacaacgacatgtggcagtgcctgaaccagtgcgccggggagatcgaggaggcgctggaccacctggacgacaccgagggcgggcctcgacgacggcaagctccacgacgtgaagctgttcctggacac

SEQ ID NO: 11403 - DNA, 452 bp, Zea mays
  Clone ID: cC-zmpo148071b09b1
ccacgcgtccgttccttctccctctccgtcccccaagcaaagaaaagaagctagctagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcactttggcgcgtccaaggagacgctcaaggcggaggcgacgacggacgacagcgggtggtacaagctggagatcgaccaggaccaccaggaggagatctgcgaggtggtgctggcccggagccccgacccggggtgcgcggagatcgaggagttcc

SEQ ID NO: 11404 - DNA, 524 bp, Zea mays
  Clone ID: cC-zmpo148071b10b1
ccacgcgtgctaagctcctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgacaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcatagctgatcgactgtccgtgcatgcgtgccaattaatataattggctgatgatgcctgatgt

SEQ ID NO: 11405 - DNA, 491 bp, Zea mays
  Clone ID: cC-zmpo148071b11b1
ccacgcgtccttaacttaacgccaaacgccgctgcgctctctctccttctcgtcctgaccccccagagcgagagggaggggcacccagaggagcctgtcgttttgatcggtgtctctctgcccccgttcccgcgaggagagaacaacctggagaaaatggcgccgatctccggagccacggccgtccttgtgatggccgtcgtcgccacgctcgccgccgcggctaacgccctggcccccgccccagcacctgctaccagtgacggaacaagtgtagaccagggaatcgcctacgtcctcatgctggtggcgcttgtcctcacctacctcatccacccattggacgccttcttcgcctacaagctcttttaaaaccatccgctttgtaatttggcgccaattgagggtgtcattaacggtgttcgattattaatcgatccagtttgggcccaccactagaaaagggaaaaatgcacacatcttatcctgct

SEQ ID NO: 11406 - DNA, 363 bp, Zea mays
  Clone ID: cC-zmpo148071b12b1
ccacgcgtccttggactcgtgggcggacgcgtgggcccgcggcgagatggcggaaataggaattaggaaaaggttgggcggtcattttcctccctgtcgatctaccgaaaccgcagctgccccgaaagcaatggcgatccgcaccgcaccgcaccgcacgtcttgtgccaggtctggttggtccgattcgcggcagttgggcggtaggtcagcggtggttgcgggacgggctcttctcgtttcttgccgccccggcaagggcgggcgtgcatgaaacccggttaataaactagcgacgtcggcgttgacccttccgtcgtcacacctcacaaagaaaccacagcctgccaggccccggacaac

SEQ ID NO: 11407 - DNA, 404 bp, Zea mays
  Clone ID: cC-zmpo148071c01b1
ccacgcgtccgaccttatcatccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcactgcggtggaccatggcgagccgcctcagcagtgcgcgaccccggtgagcgtggaggaggcgtgccgcggtgcgtccgagacgcacgccggcgtggcctacgaccactgcatggcgtggctgggcgccgacccgcgcagcaaggaggccggcaacaagaacatgcacgggctggcggtgcttgccaccgaggacggtcattgaccacgcc

SEQ ID NO: 11408 - DNA, 420 bp, Zea mays
  Clone ID: cC-zmpo148071c04b1
ccacgcgtccgtttttttttttcctcaagtatttccttttttcagtcacattgttcaatagacatacattttattaaatatgcagggcatcgtagaagagaatggttctcccttccaaaaagcaaaacaaaagaaactcgtatagtcgatcgacgaccatgcatcacatttccttttcctcgatcttctcttatttccgcagaaaaacaacgaaggaaacccaaccaaggaaacgcatgctattgcttaagcatcgccggaggagctggtcgatcgctcgctcactcacgggcctgattgttccggtcaccctgtcgtcgtcgtcgagctgagacacgctcctccagaagcccgtgccgtagaacctggcccacaccttcttctaaagcttccccgtctcctccaactggaaggcgggct

SEQ ID NO: 11409 - DNA, 246 bp, Zea mays
  unsure at all n locations
  Clone ID: cC-zmpo148071c06b1
ccggaccggaatccccggttcgactccacagcgacgggngtttgtttagcaagcgtttacgagccgatccaatgagcgagcatactcacggtgatatgggcgagagccgccatgagctggaactgcagatgccttctggaagtggtcatcgagctgttactgaccgtgaacctcggcgtgcgcaccaccggattcctggaagtcgtcgacatcaaggtgtcgagtgcagggactccagacccggac

SEQ ID NO: 11410 - DNA, 507 bp, Zea mays
  Clone ID: cC-zmpo148071c07b1
ccacgcgtccgttcctttccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgttacttctacgtaccagctggaatgcatgtcgacg

SEQ ID NO: 11411 - DNA, 508 bp, Zea mays
  Clone ID: cC-zmpo148071c09b1
ccacgcgtccggtcgtgtggaaaggggagatggcgcaggcggtggaggagtggtaccggcagatgcccatcatcacgcgctcctacctcaccgccgccgtcgtcaccaccgtcggctgcaccctcgagatcatttcgccgtatcacctgtacctgaacccgaagctcgtggtgcagcactacgagatctggcgcctcgtcaccaacttcctctacttccgcaagatggatttggattttctgttccacatgttttttctcgcacgatactgcaagcttctggaggagaactcatttagaggaagaactgccgactttttttacatgctcttgtttggtgctactgtcctaactagcattgttctgatcggagggatgataccttacatttccgagacatttgccagaattctgttcctgagcaattcattgacgtttatgatggtttatgtctggagccagcacaatcctttcatccatatgagctttctgggcctgttcacctttac

SEQ ID NO: 11412 - DNA, 520 bp, Zea mays
  Clone ID: cC-zmpo148071c11b1
ccacgcgtccgtgcacgtgcacgacgtcaagcacaccatgggcggcctcatgcgcgactcccccacgcacatcggctcccgcaccagggccgacggcgacggcatctccctcttctccgccaccaacgtctggatcgaccacatctccatgtccaactgcgaggacggcctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacattgcccgccaagtgatcaccaagcactacgcggaagaaggcgtgtggagaact

SEQ ID NO: 11413 - DNA, 438 bp, Zea mays
  Clone ID: cC-zmpo148071c12b1
ccacgcgtccttccatttgcaaacctatcaaatgagaatgtcattagtggcataactcctgatatcatggaaaaccatcttgctgaaatgcagtatcagaagttacctcggaattttgtgcagtgggttaatcacggtgataccttttggtactaagatcgcaattactggaattcaatatgtcgccagcttcacagggtgggcattaacacggatctgagtagtagattatagagtgatatggatgctgcggcaaggcatttctcccgtgatatactccgcaccatccccaaagtcctttattggtccacgtgtttttacaatgggtgagtagatagatatctttctggtgaaagaaaatagagatgataattagggcttattattgttgacctgaaattggcattattcatgggaacatgtcatattttcttgtgg

SEQ ID NO: 11414 - DNA, 431 bp, Zea mays
  Clone ID: cC-zmpo148071d01b1
ccacgcgtccggacgttaccttcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggaccttcgtggagcggcccggcgcgctgctggtgatcgccttcctggcggcgcagctggtggcgacgtgcatcggcgtgtacgcccactgggagttctgcaagatgcagggcattcgctggggcttgggcggggccatc

SEQ ID NO: 11415 - DNA, 467 bp, Zea mays
  Clone ID: cC-zmpo148071d03b1
ccacgcgtccgcggatttctatatagacgtcgtgccccgacgccgagaagatcatcttcgacgtcgtccagaagcggttcaaagctgaccccggcaccgccgccggcctcctccgcctcgtcttccacgactgcttcgcaaatggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctggggcggcgcgactcgctcgtgttcaaccgcgaggacgccgacaacctgacgggcccggacattgcggtgcccaagctcatcgaccagtttcacaagcagggcttt

SEQ ID NO: 11416 - DNA, 494 bp, Zea mays
  Clone ID: cC-zmpo148071d04b1
gcctccacctatcaccacccgggacgttttccatggccttctcgcagccgaatagccctatctcaccgcaacaactcctcattacatcctttatgagaggctgatcgattggtagatacgtactcgggtggagcagaacaacgagagacatggcgacgacgacgcgtgttgtcgccaccgccgccggcgtgctgctggtcctgtcggcgttggcgaccctggcgcgggccgaggacccttacctgttcttccagtggaaggtgacgtacgggaccaagtccctgctgggcgtgcccccagaaggtcatcctcatcaacggcgagttccccgggcccaggatcaactgctcctccaacaacaacatttggcgtaaatgttttcaaacagttcgaccatacgatccttttcacccggaaacggggatgcatccccggaagaactcgcggatggcgggttgccagcaacccatgtcctatcctgcttaacaccactt

SEQ ID NO: 11417 - DNA, 456 bp, Zea mays
  Clone ID: cC-zmpo148071d05b1
ccacgcgtccggagtttcttttgccctcctccacctttctccttttcttgccagggttaaaacaccttcgccggcgagagcatggcgatggcgtaccgtgttctggaggtcaccctgctgtctgtacatgacctcaagaaagtgtcgctcttctcccggactcgcatctacgccgtggcttacatctccggattcgacctccgcatcccttgccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacattggcgaggtgtttgtgcccatcgacgaccttctggccggcgccgacaagggtggcgatccgaggcccgtgagctaccaggtgcgcaggcccgac

SEQ ID NO: 11418 - DNA, 56 bp, Zea mays
  Clone ID: cC-zmpo148071d06b1
ccacgcgtccgaatatatttttataaaaaaaaaaaaaaaaaaaaaaagaataggtt

SEQ ID NO: 11419 - DNA, 492 bp, Zea mays
  Clone ID: cC-zmpo148071d07b1
ccacgcgtccgtcgactcgtcgccgtcaccgtcgccgtcgcgtccgtcaccgccctggtcgtcggtgtcaggcggaccaccacccggcaccaccgccagcagctccgtgcgctccgccgggccctccccgtcctcgacgccgaacagctgcctccggagcacgccgtggaggccgtcgaagagcctcctcttgacggcgcccagggcccagtcgaggcggtggagcagctcggtggagttgtcgttgtacatgaagagggcgttgtataggtcgaagctgtcgcggcacgtgttgtccaccagccggagcagcgtctcgtaccccctggtgtcgacgggcgtcgcgcggagcttcagcgccgccagcatcctcccgacggtgtgcgtcaggaactgcgtctcgggggcgtgcgcgttgggcttggcgcaggacattttcaccttccggcacccttccgggcgaacacgccgaggacgccttggcgcgggcgc

SEQ ID NO: 11420 - DNA, 437 bp, Zea mays
  Clone ID: cC-zmpo148071d08b1
ccacgcgttttttctgttcaaggcacacgattctaccgaggttgctcaacctaaagagggaaccagatggcttaggttcagtggcctgtccctcgtcgctaccgcttggcacaacttgatcagccgacaaagaagcaaacattcgccgcctcctgctgccgcaacctctcaaccatgaccaggcagcgctgtacgggatcctcagcttgtaaaaaacacgcacacacacgcatggctcatccatccatccatccatgctacatttgcagtcatttgctgttattttccaatcctggttagttcttgtaagctaaccccgcatccgataagctaatcctgtaaatggcgcaaggagcatcagctctggactgctcctgttgtagagaaaaaaaaatactacagcttagagttggggaaggagggcaatctggaaattt

SEQ ID NO: 11421 - DNA, 505 bp, Zea mays
  Clone ID: cC-zmpo148071d09b1
ccacgcgtccgtgtacattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgaccacgccgcgcgagctgctgctggcgtcgatgcgcgtcgcggcggagaaggccagggaggccaagagccgggtggacgagttcgcggcgaggaaccacgagggccggccgatggagtccatcctcggcgcctgcagcaacgggtacggcaacgttgtgcaaacgctcgaggaggcgcggaag

SEQ ID NO: 11422 - DNA, 498 bp, Zea mays
  Clone ID: cC-zmpo148071d10b1
ccacgcgtccggccgtggaagcacaagaagaggggcccgtgccgggcgacgaaccctatcgacaagtgctggcgctgccgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcccccacgcacatcggctcccgcaccagggccgacggcgac

SEQ ID NO: 11423 - DNA, 448 bp, Zea mays
  Clone ID: cC-zmpo148071d11b1
ccacgcgtcctgcagttgcttcgtcttcctcaagggcaaggtgtacggcgtcggggaggtgtacctgggccgcgtcaccgcgccggactcgcgcgtcatcttcgccgacacctacctctccaagaccatccacccggccggctggacaaccataggctacagcggcagcaccgacaaggtgacgctcgcggagttcaactgcactgggccgggcgctgacgtgacgaaccgcgtgccatggtcgcggaggttctctcccgacgacgcggccaagtacctcaccatcgacttcatcaacggcaaggactggctgccggcgtactactactgatccgacgatcgactgctggatcgatcaagcatgcatgcatgcatgtatacacatcttgtaacgctgaattttgattcatggcacactgtactggacgaggatcattttttcttgcct

SEQ ID NO: 11424 - DNA, 439 bp, Zea mays
  Clone ID: cC-zmpo148071d12b1
ccacgcgtcctgtgagtgccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcttcgtcgtcgtcgtcggaagaggccggcgagaaggagaaggagaaggagcaggagatggagaaggcggtcgcggcggagaaggctgcccagcaggagctgctcaagtacgccaaggagaagggcatcgggtaaccgaccaacggcacggggtggtacaagggcatcgcccggggaggtcgtggccccccacaacgagcttcgcgcgcg

SEQ ID NO: 11425 - DNA, 217 bp, Zea mays
  Clone ID: cC-zmpo148071e01b1
ccacgcgtccggcatttccttctgaggccgccgcctacacacccaaggttgcgttcgaggccactccaatctccgttgaggccgcggctgatgaacaggtcagctgagaaggtggtggtggaggagccggctgcggcggccgacgttgagcatccaaaggctaatgaggcggtcgctccagaggtggtcgttgccgagcccgatcaccaggaggagg

SEQ ID NO: 11426 - DNA, 350 bp, Zea mays
  Clone ID: cC-zmpo148071e02b1
ccacgcgtccggcaggtccttgtctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgtcgccgagaccacgacgaccgtggaggcgaagaagaaggacgtcgtggaggcctgga

SEQ ID NO: 11427 - DNA, 510 bp, Zea mays
  Clone ID: cC-zmpo148071e04b1
ccacgcgtccgcgcatttagttcgtcggggacgggggcaaggagcccctggacaagaagctgtcggaggcggagaagaagaaggtcacgtacgtggtggaccccagcggcaagggcgactacaccaacatcaccgtggcgctggaggatatcccggtgagcaacaccaagcgcgtgatcctggatctcaagcccggcgctcagttccgcgagaagctgttcctgaacatcagcaagccgttcatcacgttccggtcggaccccaagaagcccgccgtcgtggtctggaacgacactgcggccacgaacggcaaggacggcaagccggtgggcacggtggggagcgccacgctggcggtggagtcggactacttcacggcgtacggcgtggtgttccggaacgacgcgccgttggccaagcccggcgccaagggcggcccggcggtggcggggcgcttgttgggaccaagacccagatctacaactgcacatcgacggcggacaggacacg

SEQ ID NO: 11428 - DNA, 503 bp, Zea mays
  Clone ID: cC-zmpo148071e05b1
ccacgcgtccgcggactcgtgtgtgcgagcagaccgcggggcacgaggacctgtgcgtggagacgctgtccgcggacccgtcgtccaagactgccgacactacggggctcgcacggttggccatccaggcggcacagcggaacgcgtcggagacggcgacctacctctccagcatctacgacgacgacagccttgagaacaagacggcgcagctgcagcagtgccttgaaaactgcggcgagaggtacgagtcggcggtggagcagctgtcggacgcgacgtcggcgctggacacgggcgcgtacagcgagtcggaggagctggtggtggcgagccaggctgaggtgaggctgtgtcagcgtggctgccaagccgtgcccaaccaccgcaacattctctcggcgcgcaaccggaacggcgaccagctttgcagaatagggctcgccatcaccaagctcattcacggaccggcatcttgatacacaggacgtagtaaacattta

SEQ ID NO: 11429 - DNA, 510 bp, Zea mays
  Clone ID: cC-zmpo148071e06b1
ccacgcgtccggactgttctagcatgggaaagatatatgaacttgggggccctgaaatttacactgtccatgagctggctgagctgatgtacgagacaatccgcgaatggccaagatatgtcaatgtccctcttcctgttgcaagggctattgcttccccaagggagatgctgctcaataaagtgccgttcccgcttccaacaccatccattttcaacctagaccaaatcaacgcatttgctgtggacaacctcgtctcggaagatgctctgactttcgaagacctcagcatcatgcctcagaagctgaaagggtacccggtggagtacctggtgtcttacaggaagggcgggccgtcgttcggctcgaccgtgagcgagaagatgaggagcttggagatgtagggagcctcgtaccacctccgaagatactgtagattcctatgatcatttggctgcattgttccggccacctgacgccgtcttgccggttggagcagcaggaccaaat

SEQ ID NO: 11430 - DNA, 518 bp, Zea mays
  Clone ID: cC-zmpo148071e07b1
ccacgcgtccgcgcactttgcctcgcccttcttgacgacgcgcgccggccggccggataccatgccgggcaagcaggaggagggcggccaaggcccgccgggcagcagcgtgtgcttgtggctggtgacggtgctgctcctcctctccctgctcgccggcggcgcgtgcctcgcggcctacgtcctgctgccgccgcaggagacgccggcctggctccccgccgtcggcctggcgctcgtcgcgctcccgtgggcgttctggatcctcacttgcgcgtaccggtgcgccgccgcgcgggccgccgagcgcaggacgatggccgtggcgccgtctcctggtagcatgtgctcgcgctccggctcgtgagcagtaaccgtaagacacttagccgtgcgaattcactttcagtatttaaggatcgctgaagctgcacaacggcatgaagatgttcatgtcaagtggaggatgccaaaaatctgttcatggctcaatctacatgttcatgtcaagtggagga

SEQ ID NO: 11431 - DNA, 468 bp, Zea mays
  Clone ID: cC-zmpo148071e09b1
ccacgcgtcctgtttgttgggcacgcgacgtactacggcgggcgcgacgggttaactgacaccacggacagcggcgcgtgcggctacaagggcgagctggggaaagactacggcaccctgacggcggccgtgggcccgtcgctgtacaccaacggcaccgggtgcggcgcgtgctacgagctcaagggccccaagggcaccgtggtggtgacggccaccaacgaggccccgtcgccggtgagcgggcagaagggcgagcactttgacctcaccataccggcgttccttaagatcgccgaggagaaggccggcatcgtgcccatcacctaccgcaaggtggcgtgcgagaggaaaggcggcatccggtacacgatcacagggaaccagcactacagcgaggtgaaggtgaccaacgtgggcggcgccggggacgtggtggcgctgtgggtgaagggcaacaagcgcgtt

SEQ ID NO: 11432 - DNA, 499 bp, Zea mays
  Clone ID: cC-zmpo148071e10b1
ccacgcgtccttcggttacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgcccaaggacaagtggtgcaagccgccgcaggagcacttcgacctcagcatgcccgcgttcctccagatcgcgcaggagaaggccggcatcgtgcccatctcctatcgcagggtggcgtgcgcgaagcagggcggcatccggtacaccatcaccgggaacaagtacttcaacatggtgacgatcaccaacgtgggcggcgccggcgacatcgcggcggtgtcggtgaaggggagcaagcgcgttaagtggacggagatgaagcgcaactgggggcaagtgtgggagaccggggaggacctcacctgcgag

SEQ ID NO: 11433 - DNA, 431 bp, Zea mays
  Clone ID: cC-zmpo148071e12b1
ccacgcgtccgtcacttcgtccggaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgccccacctaacggccttgtccgggaggccaccgaccc

SEQ ID NO: 11434 - DNA, 435 bp, Zea mays
  Clone ID: cC-zmpo148071f01b1
ccacgcgtccggtttttgcttttggccaccgacgacaagggctcatgcagcagctgcgatggtggttttgtcagtgtcgacgcggatggtgaaggcaatgacaacggtggtggcgatggtagggcaagtattccaggcaatgcggatcccgtcgaagccgaatagaacggtagccggttgccgccatccttgcagtggctcaacagcctgttctcgccatcggcgcagtccttcggtagcggcagcggcagtttgcattattgggagaattgaaccaattatgcaatataagaatggatgattgttgctgtttgagcccattggtgccaattgtaccataggaagaacaggagcatgccggcatgaaaaatttggagcctttttttagtgggtcaatttggcttatgtaatggtctctttgatatagttggcatg

SEQ ID NO: 11435 - DNA, 487 bp, Zea mays
  Clone ID: cC-zmpo148071f02b1
ccacgcgtccgaaaatgttatatggtggaagtgttgatggtttacttcaggttcgagctgatcgaatccaatatcaattagaagagatggaaaaagctcttagtgaacgatgcaaacactttgaacttaaattcaaaccatctgcatcagttgagcttccttccggttgggaacctgggccacaagagggactcattgagtgggatgaagactgggataaatttgaagatgaagggtttagtattgctcaggataatggtacaatacaggaaaccccagtttctgctgaaaatggaaaagtgtcatctctttgggatgatggtgatatgtctcctgttgcatcctctactggtcatattaaggaagaaaggccgtacagtggaggtgattcaagtggctgggagggaaacaccatatgaattctggagatggatctgtgaggagacctgccatcgtcggagaagcgcctcagcgttgcccctttaaa

SEQ ID NO: 11436 - DNA, 314 bp, Zea mays
  unsure at all n locations
  Clone ID: cC-zmpo148071f05b1
ccggaccggaattgccgggtcgacccacgcgtccgcgccttgtttttcagcgaccgcatctccatgggcgacgtgctgtggaacctcgagtacgcgctggagctgcaggacgccaacccgcccgagggcgcgcggcagggcggcgacggggacgaccaggacggcgccgcggcggcgggcggcggnttttctgatccattttttacttaccccaccgacctcgacgtggtgaacccgcgccccggcacgctgcgctggggcgtcatccagcccggcccgctgtggatcatcttcgcgcggtccatgatcatcca

SEQ ID NO: 11437 - DNA, 264 bp, Zea mays
  Clone ID: cC-zmpo148071f06b1
ccacgcgtccgctctgtcgtttgcgcacgcaatggcaaagtcgtacgctcgggcaggtaccaggcctaagcgaagtggcgcccgctgggtctatatataacacacatgcattatacattggtgggcgattgtaactgactgcatggtaactgatggttcttgcctcgcaaatgtgaggagtataccgaaggatgcgggtcaactatatgatgatgaatgtataggtgtgacaaccaaatatgctgatgagaaaagtatattcat

SEQ ID NO: 11438 - DNA, 411 bp, Zea mays
  Clone ID: cC-zmpo148071f07b1
ccacgcgtccgtgtgctttagcttctcccctcccccccctcgtctccgcacagagagggctcctcgctgccgtgtgccggccttcactttcccctctcgtctcctctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgtctcgccgccgccgccctcctccttctcgtctccggcggtgctccagttcgacgaccagcagcaaaatccgaggccgtgtgcgccggcggcgtccgggcccacggaggaaccgcccaggccggcccgggcgtcagcgcc

SEQ ID NO: 11439 - DNA, 232 bp, Zea mays
  Clone ID: cC-zmpo148071f08b1
ccacgcgcccttttggtatttcccccagaccagcagcggctcatctttggtggaatgtacattgaggacgggcgcacgctagccgactacaacatttagaaggagagcaccctccacttggagcagagcctcacgtgaggcatgcatatccttatgaagaccctgaccggcaagactatcaccttctaggtggagtttttagacaccatcgaacaatgttaaggccaagatc

SEQ ID NO: 11440 - DNA, 500 bp, Zea mays
  Clone ID: cC-zmpo148071f09b1
ccacgcgtccggttcgtggatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgcccaaggacaagtggtgcaagccgccgcaggagcacttcgacctcagcatgcccgggttcctccagatcgcgcaggagaaggccggcatcg

SEQ ID NO: 11441 - DNA, 486 bp, Zea mays
  Clone ID: cC-zmpo148071f10b1
ccacgcgtccgtccgttgaagcacaagaagaggggcccgtgccgggcgacgaaccctatcgacaagtgctggcgctgccgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaggagctgctcatgagcagcgacaagaccatcgacgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgacttccccacgcacattggctcccgcaccagg

SEQ ID NO: 11442 - DNA, 382 bp, Zea mays
  Clone ID: cC-zmpo148071f11b1
ccacgcgtcctaggttcctcttctacgacatgggcaacgaccccgagggcggctactacgccaggggcgctcgcgcgtcggtgtgggagaacttcaaggacaacccgctgttcgacatctcgacggagcacccgtcgacgtactacgaggacatgcagcgcgccatcttctgcctgtgcccgctggggtgggcgccctggagcccccggctggtggaggcggtggtgttcgggtgcatccccgtcatcatcgccgacgacatcgtgctgccgttcgcggacgccatcccctgggaggacatcagcgtgttcgtggcggagcgggacgtgccgcgcctcgactccatccttacctccatcccggtgcccgacatcctgcggag

SEQ ID NO: 11443 - DNA, 422 bp, Zea mays
  Clone ID: cC-zmpo148071f12b1
ccacgcgtcctttgtttgctctcttcctcctcctcctcctctcgaattccgtctcttgtccctgtcgtcctcgcccggtttccccggtttttgagaggggaaagaggaggcggaggagagggatggggagggacgagaggttcccggtgtgggaggccgcgctcggcgccggaatcgccgccgccttcgtcgctggactcgtcggtgtctacctttccatgccggactccgactacagtatttctcaagttgccacgtaatctctaggaactccaaatcctcactggccaccttgagaactattcttagtgactacaccctacaggtgtcggtaggtttattggcctgtgtacattcttcatgcacacctttatgatcccagggacaatattatagtcactgcctttctggtgcctttgttt

SEQ ID NO: 11444 - DNA, 498 bp, Zea mays
  Clone ID: cC-zmpo148071g01b1
ccacgcgtccggttctttgactgagacgcagatctacaactggaccatcgacggtggacaggacacgctgaacgaccacaagggcctgcactacttcaagggctgcctcatccggggcagcgccgacttcatcttcggcttcggcccgagcttctacgaggactgccgcatcgagtcggtggtcaaggaggtggcggtgctgacggcgcatcagcgttccaagtccatcgagggcgccatcgacaccggcttctcgctcaagaactgcagcatcggcggcgtcaagggcggccagatctacctgggccgcgcctggggggactcctgccgggtcggctactcgtacacgaagatgggggaggaggtggaacccgtgggctgggactgatgcgcaatcgccaagccggagagtagtggcatctactacggcgagttcaagtgctttgggccccgcgcttgccccaatagaataacagggtggggtggccctggacctta

SEQ ID NO: 11445 - DNA, 504 bp, Zea mays
  Clone ID: cC-zmpo148071g02b1
ccaccgccacgcgtccatttgctctcgatgatgtattcaagcatgttggagataaagcgatatttgctagtggaagcccttttagtaatgtttctttaggaaatggtaaatctggttatgctaatcaagcaaacaacatgtatctatttcctgggtgcccggcatgtttcagatggcatgcttcaagcagcagctgagtgcctggcatcatacatcacagacgacgaaattcgaaaaggaatcctcttcccttcggtctccagtattaggcacatcaccgcacgtgtcggcgcagcagtcgtccgtgccgctgttgctgaagacctggctgaggggtgctgtgatgtgggtcctagggagcttgggagtatgtcagagtcggaagcagtggactaccgtccttggaagatgtggtaccctatttacagcccttttgtgagcgacaaataataaatccgaagatctcgatgcctgcgcagaagcagatgttccattgagggaatg

SEQ ID NO: 11446 - DNA, 458 bp, Zea mays
  Clone ID: cC-zmpo148071g03b1
ccacgcgtccgacctcttccttcgatgcaatcccctccaccgcctgctccagtcagtttaccaccaccacctataaaatcaccaccaccggctccagtaagctcaccacctcctctggcgcaatcccctccaccacctgctccagtcagctcactaccaccacctgtaaaatcacctcctccaccggctccagttagctcaccaccgcctcctgtgaaatactcttcaccacctactccagtcaactcaccgccaccacctgtaaaattacctcctccactagctccaatggtttcaccatcgtctcccatgaaatcccctccaccaacggcacccgttagctcgccaccaccgtctgtaaaatcaccctcctccaccggctcctgcgatttcaccatcaccttctgtgaaaatccttccaccaccggcacccagtagcttcaccttccccgccagtt

SEQ ID NO: 11447 - DNA, 330 bp, Zea mays
  Clone ID: cC-zmpo148071g04b1
ccacgcgttcgcgctctttcttttcaaataaggtcccgccctttaccgacattcacaggggggacaggaaatcagcggccatggcctcgattccggcgacgaccttcgccgtcattttatccgtcctattctgtgccgaggctggcaccgccgtcgacaacgacctccccgactacgtcatccagggccgcgtttattgcgacacctgccgcgcccgggttcgtgaccaatgtcaccgagtacatcgcgggcgccaaggtgaggctggagtgcaagcacttctggaccggcaagctttgagcgctccatcgacggggtgacacgatggga

SEQ ID NO: 11448 - DNA, 502 bp, Zea mays
  Clone ID: cC-zmpo148071g05b1
ccacgcgtccgctttattcctttcccacacacgccgccgccgccggtgcggctcgcttccgtcccccccggtccgcgcgggctgcctgcgggagcagggtggcagggcactccggcaaccacgtgggtggggaggcgacgacaccaccctatgctctgtcctcgcccgcagagtaagattgcagcagcagtgaatttgggagcttgaagcattcatctgagacatggaaaaagtgatctgctgggcatatctccttcaacgcaagcagttctcgaaagaaactcttgattgctgtgtcttagctcgtgggaacactcctctctcctctctcgtgaactacacatagtggttatatgttcctctatgctcaacaacaagcaggctgatgcgatattttgctgaagttattatatttcagtctatgccagacatctacatatggtgctcatataagtgggggttgatatatttgctgtgttcagcttacatctggtgcggccct

SEQ ID NO: 11449 - DNA, 72 bp, Zea mays
  Clone ID: cC-zmpo148071g07b1
ccacgcgtccgtggactcgtgggaaaaaaaaaaaaaaaaaaaaaaatagtaaaaattaaaaaaaaagaaagc

SEQ ID NO: 11450 - DNA, 86 bp, Zea mays
  Clone ID: cC-zmpo148071g08b1
ccacgcgtccgtttatttaaaaaaaaaaaaaaaaaaaaaaaaaaaaaaaaaaaggataaaacaataaaagggtctcagcttccaaa

SEQ ID NO: 11451 - DNA, 447 bp, Zea mays
  Clone ID: cC-zmpo148071g09b1
ccacgcgtccgtgctgtcgccgccgccaggggccgaagccgtagtcgccgcgaggagccgccagtgcgcgcccgcggaggctagctagggctgcccgtgtggccgccatgatcggttcgcaccggagcatggggcgcccgcacgcgcctacggaggctgcgtgaccgacctgcgtcggggctggggcacccgcccgcgaggttgcggcggcggcctgcctgtgcgcgtggctcgtccatggacacacagtacaatcatgcagacgccacgtagtacagttgtttcttggcgctgctcgatcgatcgcgctggctggatgcggcatgccgccgtggttctcggtggcccatcgtcgtccccgggccggggtattggtttccgggcttgcacgcaccacctcaaatcaaaggaccgcgaccacacatcgttgtaccttaaaggtcagga

SEQ ID NO: 11452 - DNA, 494 bp, Zea mays
  Clone ID: cC-zmpo148071g10b1
ccacgcgtccgtattttccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacatccctacttgatccagaggagggtattcgttttaggggccttttaattccagaatgcccaaaagtgcttgccaacagcagtta

SEQ ID NO: 11453 - DNA, 500 bp, Zea mays
  Clone ID: cC-zmpo148071g11b1
ccacgcgtccttccttatccctcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctctttagggcgatgttcctgtccttcggccggagcgacgacagcatgaagaagacagacgacgacaccacgagccccaagaagagagccatcgcggctgctgatgacgattgcaagcctgccggtgacgagtcaacgtcgtggaagcg

SEQ ID NO: 11454 - DNA, 436 bp, Zea mays
  Clone ID: cC-zmpo148071g12b1
ccacgcgtccgtgcgttcgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgtttttttccaaatataccgtcgatggaactccaaatgtaatgtcacccaaatgtgtggtttttcgattgaaggggtaataataaaaaggcattgcttggcagttactactta

SEQ ID NO: 11455 - DNA, 352 bp, Zea mays
  Clone ID: cC-zmpo148071h01b1
ccacgcgtccgcggtcgcgtggggcaccgtgttcaagtgctacgacagctgctcggacgacgtcgaggaggccgtcgcccacctcaacggcctcgtccgggagcccaccgacgccaagttcctggagctcaagtcgtggctctcctccacgctcggcggcacctccacctgcgaggacgcctgcaaggacctgcccaagaacggcgacaaggacgacgtcgtcaacttcagcctcgacttcgagaagctgcagcgcgtcacgctggacctcatcaccgaggcatccggatccatgtcccgcaggcatcgccctggcacccttcaacgccggagcgccctcctacggggcggc

SEQ ID NO: 11456 - DNA, 381 bp, Zea mays
  unsure at all n locations
  Clone ID: cC-zmpo148071h02b1
accggnnccggaacttcaccgggttcgactccaacgctgatccgctacgtgtatcgctttgtgatgnnngcggcgcatattggccgtcttctgtgtgtttgctgcatggccagcagtgccgtaggcggtctccctcaccattgtaatgacgacggcggctccggcaggcgaggagctgctgaaggacgacattggattcatgtggggcccggaccacagcttcttctacgacgacggcaacgcgctcgcgctgtgcctggagaagtcccacggctcggggttccgctccaacgccgacaacctctactcccattacgacattgacgtgaagctcgttgtcaacgacttggccggcaacgtcaccacggtctacctgacgac

SEQ ID NO: 11457 - DNA, 393 bp, Zea mays
  unsure at all n locations
  Clone ID: cC-zmpo148071h03b1
ccacgcgtccgttcctttcctctcctctgtccctctacggngcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcattacggaatatatgtgggcgatgataaggtgatccatttcacaagaggaagaggacaggaggtcggaacaggaacttgtcgccgatattattcttgggagttccaccccaaaaacgaagcaaccacgcccttgcccccggtgtgcacccgacgaaaaccagcgaccagcagcaacagaggacgaaacgggcgtgggtattc

SEQ ID NO: 11458 - DNA, 500 bp, Zea mays
  Clone ID: cC-zmpo148071h04b1
ccacgcgtccgctcactggatgttggtccgtgaaggggttaagatcatgctagatataatggagaactcatcgctctgtgctgagactggaacttcgcaggaaggagtgggagtgaaaaatccagatgaatgttcattggaggaaccacaatccatgaatttgttgccagaaccggcactgtattctccagatgacttcgttaatgaacaagagaaccatagtccgtcagaaattgttgaattagtcaaaccatctgtattgacatttccttactcgccggaaaatactaatgacaaagaggagaaattgagtccacaatccgttcttgatcccattgcagaagttaccagtcctagacacaaaacttcaaagcaagaagaattcttcatgcctactttcaaagtgctattcaaagaggttgacgccccttcagcatccccaggtttgtggaatgggccacaggtagccattttggatgacagagccacaagggtgtcct

SEQ ID NO: 11459 - DNA, 304 bp, Zea mays
  Clone ID: cC-zmpo148071h05b1
ccacgcgtccggaagatgccattatcggcgtcgccggcgaccccgcgcgcgtggggttccggcgtgcacccgaccgtggcgcgctgccactgccgcatccgcctcaacaagctgccctaccagacggggtccgcgccggtgctgccggccacggaggacggtccggccgtgtgcacggccgtcatcgacgactgctttcaagtttccaaggacgacctggaccgggccgccgacaggccggtcgaggaactgatctgtgacgcgcgcctgcgacgaagcgcttcgctttaaggtgggacgtgta

SEQ ID NO: 11460 - DNA, 402 bp, Zea mays
  Clone ID: cC-zmpo148071h06b1
ccacgcgtccgaaagatgtcgtctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactttgaccgtcacagatcccagcctagctctgaagctggaggtgttcgacaaggacacgttcagcagggacgacccgatgggggacgcggagatcgacgtggcgccgctggtggaggcggc

SEQ ID NO: 11461 - DNA, 433 bp, Zea mays
  Clone ID: cC-zmpo148071h07b1
ccacgcgtccgtttcgtttcggcggcggcggtgctgctgtgcctgctgctgctgctggcggcggggccgcagggggtctccggcgccgacgggaggaggaagacggcatcgccctacgataagttgatcagctgcagggtgctgggcaactgcgacaagaacaagggcccggaggccacccgccccgggaagccggtcaacaagtacaccccgcggctgcagcaagatcgacaagtgccgcgactgatcaaccgtcatctcatcgatgcaggcagccggagctatatatatcgtgtcgttctcgtcgtacgtttcttgcgttcaatcgattgatgatttgatgtacgtggcccagcttttcatgattaatgtacagttacagggactaaccaaaattttatacaaatatatggtataagtcaagcagactgct

SEQ ID NO: 11462 - DNA, 357 bp, Zea mays
  Clone ID: cC-zmpo148071h08b1
ccacgcgtccgttgcttctggacgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcagcctctgatgatgaattatatttcaaaagagctcacctggtgctcatgttagcaagacaatattttttctatggttattttgtggcaccaaaccacccaagaaatatgtgatgctacatgtcccttctgatgccttgttgtgttgggttgatattattacataaactaaataaattatttatttaagatttt

SEQ ID NO: 11463 - DNA, 514 bp, Zea mays
  Clone ID: cC-zmpo148071h09b1
ccacgcgtccgttcaatgataggaggtggtgcgtctggaggtgcaaaggttggctctgatgtaggaggatctgttggtgggggtgctgacgtcaatgctggagctggagctggtgctgatgccggtgtctatactgttgctaagggtaataaggcaggtggaagtgatgctaaggctgatatttcggggggtgctaaagctggtggtgatgctggagcagatgctagcgctggtaccggtgctggtgtaggcatctccaagagtttcacgattggcggtggcgttgcaggaaaggctggcgggagtggcaacgctgaagctggtgtcgatgctggtgttggaggaaaggcaggaaagagtggaaaggcatataccggagctgatgcctgtgtctccaaagacgccaaagttggtggtggcccttgaggaagtttgggaaggagtggcaatgctggcactagcgcttccgtatgtgctggtgttttaagagaccctaaaattggtggtgccttcg

SEQ ID NO: 11464 - DNA, 432 bp, Zea mays
  Clone ID: cC-zmpo148071h10b1
ccacgcgtccgtagaattcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgcccctggtggaggcggagaacgcgagcccggaggcgagcctgaagaac

SEQ ID NO: 11465 - DNA, 210 bp, Zea mays
  unsure at all n locations
  Clone ID: cC-zmpo148071h11b1
ccacgcgtccgtccattcgtncgcccacgcgtccgcggccgttgtgcgagcagtcttccaattccacccaatgaactaataacataccctcgaacgccaggttccttggaccactatatccaggagcgaccaatttgatccacccgccagccatgggcatgaagaaggtccttttgcgtcggccttgactccgctgtctctggcaccgcc

SEQ ID NO: 11466 - DNA, 265 bp, Zea mays
  Clone ID: cC-zmpo148071h12b1
ccacgcgtccgttgactcgtgggtcgcagcgctctacaccgggttcctcgaagcccgcgccgacgccggcgccagcctcgtctcgctggcgcgcgacaatgacaggtactctaagctcatcatagaggaagatggagtgccggcgttgctcaagctcgtcaaggaggcgcatctggaggggcaggagaactgggcgctcgacatcgggcttctaggccgcgatccggagtgcgtcgcgcagatggtccaagacggggtgtgcttg

SEQ ID NO: 11467 - DNA, 543 bp, Zea mays
  Clone ID: cC-zmpo148072a02b1
ccacgcgtccgcgtttccgcccatggggctgtcgcaccacgtcggaggcgccctggagcgcggcgagctgcaggacatgctggaccccgccgtgcccgactggcccctggaggaggcgcagtgcctcgccgagatggcgctccggtgctgcgagctgcgccgcaaggaccggccggacctcggcgccgtcgtgctcccggagctcaaccggctgcgcgcgctcggcgaggacaacatgcagtactgcggcgccatcatcaggggtggcggcggcggcggtggcatgcacagctcgtcgccgttccacagcaacatctcacggtcacacgccgagatgatgatcgattcccagtacccaagatcagtgttcagctcaagagcgggcgattcgcccatgccgccgagaaggtcgaacgcttgacgggcatgaaatggacttttattttcagcatcggtgacggcgtggtgtggatgtcttgtgcaggtgcattagctgcctagcacgaggggagcttgagcaggtgttgtttctagcttgagttt

SEQ ID NO: 11468 - DNA, 452 bp, Zea mays
  Clone ID: cC-zmpo148072a03b1
ccacgcgtccggacttttctgatgattctgatgtagctacgtctggggggaagaaggagaagtctgaggattctgaggtgtctacatcttataagaagaagaagaaatctgacgattctgatgaagatgcatctcttgataagaaagaaaagaaggcgaagtttgcagcatctgacaaaaaagaaaagaaggacaagtctgacaacacatcttccaagaaagaaaacgaggagagatccgccgattccgatgcatctgcgtatttcgacaaggaagagcagaaatccggcgattctgacgccgccacgtctgttgagaagcaaaagaagcagaagaaggagaaatccggtgattatttcgacaaggaaaaggaggagaaccccgaggaggacgctgcgcccgtcgacgtcttcgcggacggtgtggatgtgcctctcaagaaggagaaatcc

SEQ ID NO: 11469 - DNA, 245 bp, Zea mays
  Clone ID: cC-zmpo148072a04a1
tttaaatgagttagttccacatatatatatatatatatatttatatcaaaaaaacgtccatgcatagtgatgttggatggcgacaatgtacgtggctgtactaaaatacacagaagacagtgacattttgactcttgagcatgcatgcatcggatagtatcatcgtcacgcgagcgaatccgtacgttctttcctgggggatatggagcgagcacgtacatactgcagttcgtccggacgcgtgg

SEQ ID NO: 11470 - DNA, 303 bp, Zea mays
  Clone ID: cC-zmpo148072a04b1
ccacgcgcgctttttccgcctcgcctcgtccttctctccatgggggaccatgaagagagatcctgcacatctcgcgcggccagggccggaaccaagcaggcgctcacgatcagggaagagagtcactgactagcacggaatcgaccacagccacgtacattgtggcgattcaacactactatgcatggacgttattttgaaataaatatatatatatgtatatctgtgggactcactagttgatcaaaaggaaccagaaggggcgcccggtctagaggatccagactcacggacgcgggcatg

SEQ ID NO: 11471 - DNA, 156 bp, Zea mays
  Clone ID: cC-zmpo148072a05b1
ccgtgcgccactctgctgagtcacgggggggcattcgtacagcggagcgaaaatgtctcgcgccacatgaactgtcctgttctacatgatccgacctcctgctaatcacatgtatgcgtagagaaaaacaggtcaccgaaggtatgtactcctgcc

SEQ ID NO: 11472 - DNA, 362 bp, Zea mays
  Clone ID: cC-zmpo148072a06a1
gttcaccaaaaaaatcaatatatagcggggaaagtttgattttgtaatactaactctcacttgtacgtggcatatgcagtgcagcagattcaccactagcatatccatctctgccggaaagaagcaaaaactaaaacaaacaaaaaaaactattttcttcgtccttttcttatgtgccttcaaaaagggaaaaggaaaaaaaaactggcactaacatggcctgttagtatccaccttctgttttacctaatctgtaaactccaaacctgtaagaagagtctccaccattatgtattggacggatgaaaaaagcctctcatttctccattttctgaggaaacaaaaatagccagcagcaagct

SEQ ID NO: 11473 - DNA, 360 bp, Zea mays
  Clone ID: cC-zmpo148072a06b1
ttcccgcggcgacccacgcgtccgcttctttctatccatgagccgcagattgactgggggggaacatgccaatgtggaggcgggtgcatccgccatttgcttgtcaagctcttgagatactcgggaaacgactcagcagtttgcacatccaaatggcaggggtttgacaagatacctggaggtgactacgagtgcatcgatgtcataatgcacggtgatcactacagttccagagcgtctaatcgctgatatcgacttcagaagccactttgaaattgccagggaagttgattcttatggcaccctgttgaattcgctcccacagcggtttgctggtaccccggctagactaaagacggt

SEQ ID NO: 11474 - DNA, 524 bp, Zea mays
  Clone ID: cC-zmpo148072a07b1
ccacgcgtccgtttacgcgtccgggtggtgctgcagaactgccgggtccagccccggaagcccatggagaaccaggccaacatcatcacggcgcaggggcggcgggacaagcgctccgtgggcggcaccgtgctgcacaactgcaccatcgagccccacccggacttcaaggaggaagccggcgggaagatccgcacgtacctggcgcggccctggaaggagtactcccggacgatctacatccagaacgacattggtggcttcatcgaccccaagggatggctcgagtggaacggcgacttcggcctcgagacactcttctacgcggaggtggacaaccgcggcgacggcgccgacatgagcaagcgcgccaagtggggaggcatcaagaccgtcacctacgaggaggcacaagaagagttcaccgtagagaccttcatcccagggcagcagttcatccccaagttcgggggtgccgttcatcccgggattgctggcgcaggagcaaaaggccggacacactg

SEQ ID NO: 11475 - DNA, 448 bp, Zea mays
  Clone ID: cC-zmpo148072a08b1
ccacgcgtccgcctatcgcgtccggtcccgtccgtccgtgcgtccggccgaccatccgtccgtccgcagcaatggtcggcggcatgtcaccgccgcggcggacgctgtcgatggggagcggcggcgccatgggacgccgcgcggcctctgccggcgtgatgggcgacagccccaagcgcgggctgtcccgatcgatgaccatgggcggcgagcgcacggtgaagcggctgcggctgtcccgggcgctgacggtccccgagagcaccaccgtgctggaggtgtgccgccggatggccgcgcggagggccgacgccgcgctgctcacggactcgaacgcgctgctctgcggcatcctcaccgacaaggacatcgctacgagggtgatcgcgcgcgagctcaagatcgacgagacgccggtgtggaaggtgatgaccaggcaccccatctt

SEQ ID NO: 11476 - DNA, 519 bp, Zea mays
  Clone ID: cC-zmpo148072a09b1
ccacgcgtccgtttttgtggaggaagaatttcatcatcgtcttgggtttctacgtggtgttcagctgcatagagctggtctacctctcatccatactgaccaagttcatccaaggcgggtacctgccgttctgcttctcgcttgtcctcatggccttgatgatcacatggcactacgtccacgtgatgaagtactggtacgagctggaccacgtcgtgccagccaacgaagtgacaacgctgcttgagaagcatgaggtgcggcggatccccggggtgggcctcctttactcggacctggtccaaggcatcacccccgtgtttccacgtctggtgcagaggataccctccgtgcacgcggtcttcctgttcatgtccatcaagcacctgccgatcccacacgtggcccctgtggagcggttcctcttccggcaggtcggcccgagggagcaccggatgttccggtgtgtggcgaggtatgggtactgtgacaagctagaggagtcggggctgttcaaag

SEQ ID NO: 11477 - DNA, 404 bp, Zea mays
  Clone ID: cC-zmpo148072a10b1
ccacgcgtccttgtctcgcctcgcctcgtccttctcctccgtgcggaccatgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacacccgagggcgccgagctcatcgactccgtgctcgac

SEQ ID NO: 11478 - DNA, 451 bp, Zea mays
  Clone ID: cC-zmpo148072a11b1
ccacgcgtccttccacgcgtccggcactctgcagagcctgggctggttcgtcgtacgccggcgtgcctgctagtgcctgccgttgaactctccggccaccattgatccgacctcccctaagccatctatgagtagagaaaaacagtgaacgccacctctgtactcgccccaccttatggcgcgtcgctcctgcagtaccggcccacgctctgcgcggcgctcaagtgttacggctgccctcaaatacggcgtcggaccattggcactggggcaagcaaaagcacggacagggcgctcggcgtgctgcaacggcttccgatttgcccggctagatgaaagacggctggagagcatcttctctggggaacaccgcgcgtcatgggtgccttgccgaagttcagggacggcgtgattgctcatcgtcggtcatgctccaccgtgccgccaccca

SEQ ID NO: 11479 - DNA, 413 bp, Zea mays
  Clone ID: cC-zmpo148072a12b1
ccacgcgtcctctttgatcgacagccgtgctcatcgtaggcgcggcggcatccgggcatggacaggtgcggcggcggcgccatggcgtcgtacctggtggcagtcgtcctgctcgttgcgctcttcgcgtcgtctgcaaaatgtcgtcctgagccactcgacggcggcggcaacgttaacggcaatggcacggcgccgccagtcaacggcggcggcccgggccccggccccggcgccgtactgaagctgcagttctgcatccagaggaattgcgtgtacgaaggccgtggcaacgccccgtgcttctgctgcggggccttgaagcccaaccagtgctacgaaacgagggacgggtgcagcggcaactgcgtgtagcggtgtagcccgccccccccgcgaaggccagtgatggg

SEQ ID NO: 11480 - DNA, 286 bp, Zea mays
  Clone ID: cC-zmpo148072b01b1
ccacgcgtccggctacaaggacgacgtcgtcaacttcagcctcgacttcgagaagctgcagcgcgtcacgctggacctcatcaccgaggcatccggatccatgtccgcaggcatcgccctgccaccctccaacgccggagcgccctcctacggggcggcggcgccgttcggaggtgccgtggacgcacccgccggcacctccgagggccctgccagcgccagctggctctcagctggtgacgcgccctgctatggcgccagtgtcagcggctcgactgctgatgct

SEQ ID NO: 11481 - DNA, 435 bp, Zea mays
  unsure at all n locations
  Clone ID: cC-zmpo148072b02b1
ccacgcgtccgggctacaaggacgacgtcgtcaacttcagcctcgacttcgagaagctgcagcgcgtcacgctggacctcatcaccgaggcatccggatccatgtccgcaggcatcgccctgccaccctccaacgccggagcgccctcctacggggcggcggcgccgttcggaggtgccgnggacgcacccgtcggcaccttcgagggccctgccagcgccagcgggccatcagctggtgacgcgccggcgtatggcgccagcgccagcggcccgactgctgatgctccggcgacggcggcggcggcggcgtcgttccgggtcctttaacgcacccgcgccatcgtcggcttgagcctccggcgcaccagggcccgtcgtcgtctgatgggtcctccggcgccccggcgccattgttgtcttgatgggtccttca

SEQ ID NO: 11482 - DNA, 554 bp, Zea mays
  Clone ID: cC-zmpo148072b03b1
ccacgcgtccgcgttctcacgcgtccgcccacgcgtccgggagccggggatcttttgctgctcggtgctggctggagtcgtgcagaccgacccccgctgcctctgcatggtcctggacggcaccgccacgtccttcggcatcgccatcaaccagaccagggcactggagctccccggcgtttgcaaggtcaaggcgccgccgctcagccagtgcacaggcgtccctgcggcacctgcaccgacgcctcccgacgaaccagcagcggcagcggaggaagaagccgacacagctgcagatgccccttcagcaaatggagcctcaagctccacaaactcaaagaatgcagcgagcttactgcttctcatctgcgcattgctgtatgccttctaataagtggtgatacaacttcgctggccatgtcaccgtgcaggaattaggtctttccctgagtcctgactatgtacttacccatgattcttcgcaaattttttgtatggtatggattgggtttctgatgtgccacatcaacaacattgcttttcgcaaatgagaa

SEQ ID NO: 11483 - DNA, 224 bp, Zea mays
  Clone ID: cC-zmpo148072b04b1
ctggggtgcccctccggaatttccgggtcgacccacacgcgcgctatctttctttttttttattcttaatgatttggggggttttttaattaatctcggggtatgctactcttggggcccccctcaggcccccccttttaatatcaatattaaaaggagagagggttacaaaggggacctaagaggaatctaccctgcgactaatggttttctatcctttcaaa

SEQ ID NO: 11484 - DNA, 392 bp, Zea mays
  Clone ID: cC-zmpo148072b05b1
ttggtggcaggcggcgcttgaggaggagtcggggctctaggagtacagtagggacgagaacagatacaacaccggcaaagggacgcacctagtgctcaagcgagcggagaaagcccgctctcttgtcggcaaaatgccggcaatggcggaagctctggtggcgaaggttgttgcttgggagaaggagagaggcgccaggttcgagtacgacggtgaggtgctgctggacctgctggaggactactgcaacacgaggaaggagaaggagcatgagcggaagcggcagttggaccagcggcggcaggtgcagggcgcaacggcggcggaccgggacttgtcgttcccgggggcccgcccaccacccaagggccttaagaacgtcacgaggtttt

SEQ ID NO: 11485 - DNA, 520 bp, Zea mays
  unsure at all n locations
  Clone ID: cC-zmpo148072b06b1
ccacgcgtccgggttgaccaaagttcctcaaacaagtcagatgaggagaacggaatctgtgttggtgaagctgagcgcacgtcagatcacacttttgctgtcatccatttgggctcaatcaacatcccctgaaaatactcctgtgaactatgaagccattgctcatacttacagtttgcttctgttgttctctggatctaaggcatcaacttttgaggctcttactcagagttttcaggttgcattttctttgaggagctattcactcactgaagcagattcattacaaccatctcggcgccggtcattgtttactctgtccacagncatgattattttttcgtcagagcttacaatgtcttgccactcatcccgacctgtaaacaaatgatcaatgatcgtgcggccgatccgttcctttatttggtggatgagagcaaacttacagctgttaaggattcttcacatgatccttcatgaatatatggatcaccagaggacaacaataatgcactgaagt

SEQ ID NO: 11486 - DNA, 540 bp, Zea mays
  Clone ID: cC-zmpo148072b07b1
ccacgcgtccgttctacgcgtccggtcgtcgcagaatcgcacgtgggcgcgatcgagaagccaggaccaggacgacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccacctccgctctggcctgcacaggggcaaagttgtgataccggagaacaagcccttcatcttcgtgaggggcaacggcaaaggccggacctccatcttccacgagtccgcctcttccgacaacgtcgagtccgccgcgttcaccgtgaactggacaacggcatcgtcttcggcgtcagcttaggaacagcgcccgcgtcggtctggtgaacgacccg

SEQ ID NO: 11487 - DNA, 96 bp, Zea mays
  Clone ID: cC-zmpo148072b08b1
tcactatagtgaaagctagaaccccgcaggtaccgatccggaatacctgtgactacccacgcgacctataattccgccaaagcccccactggcacc

SEQ ID NO: 11488 - DNA, 556 bp, Zea mays
  Clone ID: cC-zmpo148072b09b1
ccacgcgtccgtttacgcgtccgcccacgcgtccgtgacgttcgggaacgttttcatgtggagcgtgcgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgatcgatcgcgcacggtgctgtacacaactaaaggagagcgagaggggactttttctcgcgtttccttctctagccagccttgtctgtccccccctcgtttattctctctctcttttttttcgttcgcttccgaggaataatacccaaacaaaaaaaacataggggctcaagacttcatcatgcatgcatgcataacacctcgagtaggagttgaagcacatgatcattgatggtatatatatagaggaagcatgtctatctaataagtccctcaccaaaatgttctttatgtatgtatatgaccgtccatatatatatat

SEQ ID NO: 11489 - DNA, 136 bp, Zea mays
  Clone ID: cC-zmpo148072b10b1
ccacgcgtccgttttagcatcagggagaaacttaacgatatgctgggacctataagcaatctcgggacccgctacctaacgacaccctctcagaccacctagaaggtgatcattgagatgacaaagtccctcatca

SEQ ID NO: 11490 - DNA, 477 bp, Zea mays
  Clone ID: cC-zmpo148072b11b1
ccacgcgtccgttttttttttttttttcctaaaactgtgttgatgggatatatcatcagtagccatataaatgaagttccgaacaaatgatacaaatttcagtggctcatcctttagtttcatcatccaaggctccaacacaacatctagctaattaatacaagcaacagtacatattgtatatagtaggagtaatgcttagcaaactcgatctagtgggatactgtaattaattaattgcttcagctagaggatccctcccttctctttaattatttggctttgtcatacgcatgcctatatatgatgctacttaccatcatatatatttaagttcttgtactgtgtgagtccttggagcaacaacaacagcaaccatcagcccgtctctgtgtttgagaaaccattatttttgcttatggtggttttggttggcccagccatgagcactgctagtgttcaagtcatggccggttt

SEQ ID NO: 11491 - DNA, 349 bp, Zea mays
  Clone ID: cC-zmpo148072c01a1
ttttatatgataattgtttttcttcgttggttttttttttcacttttctgcatttatttaccccactctattcccccttctcctttttttcatccggccgggggaaggggcttatatttacgaaaaaaaaaacccaattcaattggttataaaaaaatttaattgggggcccacaccccgctccctttaaaattaaaaaaagcccctttatcccagggtttcaaaaacatgccccccccccaagaggcccccccaaataaaagaccccccccctggccccataaaaaatcggacgcctcccatttttttccacggcaaacacacccgcccagattaaaaaacccttatt

SEQ ID NO: 11492 - DNA, 344 bp, Zea mays
  Clone ID: cC-zmpo148072c01b1
ccacgcgtccggtatttagctagcgatggctggagcctgggcactggtgcattttactcgcggctggcggttcggtcctggccgcgcggccggcgtttgcaggcgggggagccgcggcggtggcggagatctgcatgaagactccgtcccccgacctgtgcaccaggacggcggggaagcacgccaacaagtacaaggtggtggacgcggtgacggtgctagagatccaccaccgccccttaaaaaaccacgtctaggcgtgtcgaaagctcaccaaggaggaggttaagacagtcgaagacgaccgacgcgcagagagcgctaaaactttgcaagacctacta

SEQ ID NO: 11493 - DNA, 266 bp, Zea mays
  Clone ID: cC-zmpo148072c02b1
ccacgcgtccgccctcgcgtccgcggacgcgtgggaaaaaaaagggggaatttaaaaaaaaaaaggggtataaaaaaaacaaaatatgaaaaataaaaaaacttaaaggattgggcggccggtctagggggtccaaaatttactagctctatctgcgcatcgagtagcttgacagacctggtaactaaatttaattaactggccggcgtttcacatcgtagagactgggataacccatgtttttgctgaccttaaggaccttgata

SEQ ID NO: 11494 - DNA, 507 bp, Zea mays
  Clone ID: cC-zmpo148072c03b1
ccacgcgtccgcctttgcgtccgcggacgcgtgggccagccgaaggggtggaatcaatcagggaggggtttcagttgctggacacaaacaaggatgggcatcttacaatcgaagaactcaggaagggaatgcgattgataggccacaatgtccatgacactgacgtcgatatgctcatggaagctgccgacatcgacgggaacgggaccctggactgcaaggagttcgtgacagtctccattcacctgaagaaaatccgtagcgaggatcacctgcccaaggtgttcagctactttgacaagaacgggagcgggtacatcgagatcgaagagttgaaggaggccctctctccaagaggtgaccagaaggcgatcgaggacataatcctagacgtcgatatagacagggacgggaagataagctaccaggagtttgagcttgtgatgaaagttggagtggacttgaggaatacgttgcggcagtactcgagaagcgtgtacaacaccc

SEQ ID NO: 11495 - DNA, 349 bp, Zea mays
  Clone ID: cC-zmpo148072c05b1
ccacgcgtccgttttttgcattcgacgtgctgtactgcatagcgggggagatgatggacgcccagtggctagcaatgcgagcctcgtacatgcagttcaaagaggtgctggaggccacaaggcagcagctcgagagggagctctccctggaggatctcaatagcatccatgacctccctgcctgcaaccttttgtacaaatagtactaatggtagttagattactgtgatacagtcaaaaggaaatttcgatgatgatcaggttgcatgtaaccagaatcatcaatcagcctgtaaaaagagaatatgtgaaaatttgtttaaagctaaactgactactgttgacgtct

SEQ ID NO: 11496 - DNA, 464 bp, Zea mays
  Clone ID: cC-zmpo148072c06b1
ccacgcgtccgcattttggaacatcgtccatccgagctaagtaattgggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgccttagcagtgcgcgaaccctgttagcgtggaagaaggcttcccttggtctttccaaaacccacgccggtttggcctacgaccactgtatggcgtcgctgggcgccgacccgcgcagaaaggaggccgtcaacaagaacatgcacgggctggcggtgctggccaccaggatggccatcgaccacgccgtcagaaccgagtccaagatcgacgaccttgcggagctggaggcggcgttttct

SEQ ID NO: 11497 - DNA, 525 bp, Zea mays
  Clone ID: cC-zmpo148072c07b1
ccacgcgtccgttttattcgaagaagctaggaagttcggttgcgctgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaactttctgaacgaaaggaccctgaaggggaccttctttggcaactacaagccacgcactgatctgccaaatgtggtggagctgtacatgaaaaaggagctggaggtggagaagtttatcacgcacaagcgttccgttcgccgagatcaacaaggcgttcgacctgatggtcaagggggagggcatccgttgcatcattcgcatggagaactagatttcgctgtctagtttgtgatctggcctgcgcttggggtttataaagaggcaatgctagc

SEQ ID NO: 11498 - DNA, 545 bp, Zea mays
  Clone ID: cC-zmpo148072c08b1
ccacgcgtccttttaagcgaaggatcgacaaaggtggcatgtgaggcatcagatataggaagatcagccttgtttccagcttctgctttatcaaacacttttgggttcaagattcaggacaagcaagggagaatgcacagatttaactgtgaaacgagcagcttgacagacctgataactagcattcttcagagggtcggcgatgacattgacagaaaacacctgccacaaattttgtatgaagatgaggaccatgataaggtcatattgtcgtcggacagtgaccttatagctgccgtagaccacgcaagacaaatcggttggaagagcctaaggctgcacttggactacgcccgccggaagagaggggacggttccttagacttcgagtacgctggcaaggatgcatgggcttctgcatacagtgctgtcgtggcaggtgcggttttggttgctgggctcggcgtgatggcttacttgaaacggtcaggggaatagcttgaggcaagcacggcagggactagggagcacggttttgatcgtct

SEQ ID NO: 11499 - DNA, 553 bp, Zea mays
  Clone ID: cC-zmpo148072c09b1
ccacgcgtccgtcggcccggtcgcccggagtagcaagcgtctccgatccgatccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctgcgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggaggaggacacgtggtcctgcgacgtttgctgcaagcacgccccattcacgcccgt

SEQ ID NO: 11500 - DNA, 493 bp, Zea mays
  unsure at all n locations
  Clone ID: cC-zmpo148072c10b1
ccacgcgtccgttttaccccgctcaccttccaggtcggtaagggagccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccccctttgcatccgctttgctgtcaagtctggtgggtaccggattggcgacgaacgtaatccccgccgattcaaaggttggcaccacttataagacgacactcagcatctaatcagcatttggagatgaactatatttcaaaagagctcatctggcgcacgtgttagcaagacaaatttttttctttggttattttatgggcaccaaaccacccaagaaataagttatgctacatgtccatatgatgccctggtgtgttgggttgatattttacatanaactaataccatatttattt

SEQ ID NO: 11501 - DNA, 527 bp, Zea mays
  Clone ID: cC-zmpo148072c11b1
ccacgcgtccggttgatatgatggagaacctaagaatcaatagctggtaccaaagggaatggcaggaagattccactaatagtttcgatttcagtggctgcaagcttgctcctaccatgtatatatgtgttggtatggcataggcaaaaactggagttttttctatgcaagaagaccagcagtgccatagaagagaacattgaggccctaatattagcacatggatcactagctccaaaaaggtacaggtactcagaagtaacaaagataacatcttctcttaatattaagcttggggaaggtggttatggcatggttttcaagggaaggctagatgatggtcgtctagttgcagtgaaattcctgcatgactccaaaggtgacggtgaggagtttgtgaacgaggttatgagtattggcaggacatcacacattaatatcgttagcttatttgggttttgtttggaaggctcaaacgggccctaatatatgaatatatgtcaaatggttctttggataagtttata

SEQ ID NO: 11502 - DNA, 478 bp, Zea mays
  Clone ID: cC-zmpo148072c12b1
ccacgcgtccgttggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcaggggtacggcgtgcagacggtggccgtgagcacggtgctgttcggtgacggcacggcctgcggcgggtgctacgaggtgcggtgcgtggacagccctagcgggtgcaagcccgacgcggcggcactggtggtgacggtgaccgacctgtgcccgcccaaggaccagtggtgcaagccaccgcgggagcacttcgacctcagcatgcccgcgttcctccagatcgcgc

SEQ ID NO: 11503 - DNA, 503 bp, Zea mays
  Clone ID: cC-zmpo148072d01b1
ccacgcgtccgcgttttaccaccccgcgctcccgccccacgcacgcgggtcgcgctcaccggcgccccgcccctcccccacgctggccgcacccgcaatggggtgcgcggcgtcggccgccaacggggccgggccccggcggcgggggtgggcgcgggcgcggatgcggcggtacagcgaggcgtccacctcgggtctgccgccgccgccgccgccgtcgcaggaggcggcggagtcgtcgtccgggggcaggaggcgagggcgcaaggtggcgccggagcccaaggagccggcggaggaggggaccgccgcgctgccgccgatgcccggctcgcccagcttcaggtactactgccagaagaagacggcggccgtcgacaggatcgtggtcgacgccgacgccgccgacgccgatgacttcgtcagggtcagagcgacggcgcgtcagttgagcaacaggtgcgaaatcacggcgaccaagcacacgattctaccgaggttgc

SEQ ID NO: 11504 - DNA, 477 bp, Zea mays
  Clone ID: cC-zmpo148072d02b1
ccacgcgtccgctttctcgtccgcggacgcgtgggccagccgaagagctggatgcaatcagggagttgttttagttgctggacacaaacaaggatgggcatcttacaatcgaagaactcaggaagggaatgcgattgataggccacaatgtccatgacactgacgtcgatatgctcatggaagctgccgacatcgacgggaacgggaccctggactgcaaggagttcgtgacagtctccattcacctgaagaaaatccgtagcgaggatcacctgcccaaggtgttcagctacttcgacaagaacgggagcgggtacatcgagatcgaagagttgaaggaggccctctctccaagaggtgaccagaaggcgatcgaggacataattctagacgtcgatatagacagggacgggaagataagctacgaggagtttgagctgatgatgaaagctggagtggactggaggaatacgtcgc

SEQ ID NO: 11505 - DNA, 428 bp, Zea mays
  Clone ID: cC-zmpo148072d03b1
ccacgcgtccgcttttttcgccttgatctggccggtcgcgaccggagcgatttcctgatgaagagcctgactgagcgcggctactccttcaccaccaccgctgagcgggaaatcgtgagggacatgaaggagaagctcgcctacatcgccctggactacgaccaggagatggagaccgccaagaccagctcttccgtggagaagagctacgagctccccgacggacaggtcatcaccatcggcgccgagcgcttccgctgccccgaggtcctctcccagccaatcctttatcgggatggaagctgccggcttccaccagaccacctacaacttcaatattgaagtgcgacgtggttattaggaaggacctggaccggaacaatcctccttttcggcgggaccaccatgttttcctgggatcgctgaca

SEQ ID NO: 11506 - DNA, 574 bp, Zea mays
  Clone ID: cC-zmpo148072d05b1
ccaagcgttcggtttaacctcctcgcctcctccattgaccaacagggaagcttccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagatgagaaggtggaggaggacaaggaggaggcactaacagtggcggtgaaacaagagccagcagccaccattgagccttagcagattgctagtgaggtgaccactttggaagtggcggtcgtcgttggccagcctgagaacaaagaggaggaggaagttgtggagaagaccgtcatcgagaaggagaagccatcagcagtccatgcagaggaaaatattgtcaccaacaaggtggcagccgagcccacgacagaattgaagaaagacacccgggaggagatatagatggagaaggagaagccattgttaagctaatcgactgcatgtcaattggctgatgcctgatgaacaatgtgcaagaa

SEQ ID NO: 11507 - DNA, 473 bp, Zea mays
  Clone ID: cC-zmpo148072d06b1
ccacgcgttcgcgttactgccgggtgaccggcaccatcgacttcaggttcggcaactcccaggtggtgctgcagaactgcctgatccagccccggaagcccatggcgaaccaggccaacatcatcacggcgcaggggcggcgggacaagcgctccgtgggcggaaccgtgctgcacaactgcaccatcgagccccacccggacttcaaggaggaagtcgtagggaagatccgaacgtacctggcgcggccctggaaggagtactcccggacgatctacatccagaacgacattggcggattcatcgaccccaagggctggctcgagtggaacggcgacttccgcctcgagacgctcttctacgcggaggtggacaaccgcggcgacggcgccgacatgagcaagcgcgccaagtggggaggcatcaagaccgtcacctacgaagaggcgcagaaggagttcaccgtggagacc

SEQ ID NO: 11508 - DNA, 555 bp, Zea mays
  unsure at all n locations
  Clone ID: cC-zmpo148072d07b1
ccacgcgtccgttcacgcgtccggctccaggtcggcctggcctgctgcgacgccgacgtcgaccggaggtgggacctcaagacggtcatcgcgcgcatcgacgagatccgggagcccgagcccgccgccgccgccgccgacgagtcgtcattatcgtcctaggcgagcacccgcgtgtgtacttgaccaagcaaatcccaccgatcgatgagcaagtcgtcgtgcgtgcgtgcctgaggtacctccgagacgaggatctacatacgcggcggccatgcgcatgaatgaaccgtcatcggttgcttatttggttcctcaatcaatcaacttaagtcggatgcgttggtggtcgactcatcgatctgccgatctggtgaacaaattaaagcgtttgagacgggatggatcatggtgattcggtttctgatatgctcatggnggaatttcgaccgtgtaaattggtgtagcttaataatctgccaaggaaaaagaggtgctagtttagtagtgtgtaaggggctttacattcgtctgtcttggaactgcgtttgattc

SEQ ID NO: 11509 - DNA, 549 bp, Zea mays
  Clone ID: cC-zmpo148072d09b1
ccacgcgtccgtatcatctagctcggcggcctcttcaagccacgggaagacgatgcgctccgcttcgtcgtccgtgggtggtgcaagtgcaagcgcaaggcagacaaacgcggcgagaaggagagcagagaagcccggtgccacatccgtgtggcctgcggccggcggcgcggttacgaacgcctcgtcgtctaaggatgtggccagcagggcagcaaaatcgccatccaccgccgcgcagaagacgaggcctgctggtgtcgagaaggcagcagcgtcttcttctgtaaagctgaagacgaagcctcagaaaacaacggcaggagctggaaaaactcaagctgcacctcccgcccgtgctcctcctggcacggtaatagcaaagaagagtacgggagccgagaactatgtccccatccagaggacgacgagcgtgccggcggcgagaccaacagagacgctcaagaacgaggaacaggaggtcgacgagctgctgatgcagttcgacgagaaagagagcataagcacctcctccattgaggagcacct

SEQ ID NO: 11510 - DNA, 316 bp, Zea mays
  Clone ID: cC-zmpo148072d10b1
ccacgcgtccgtttacacatccgtgaaagaaacaagcacatagaggcaaatacatcgctagctcgccaccaacaatggcctcaaggtactctatcctgcttgccacaacgacactggctatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaagcccc

SEQ ID NO: 11511 - DNA, 512 bp, Zea mays
  unsure at all n locations
  Clone ID: cC-zmpo148072d11b1
ccacgcgtccgcccacgcgtccgcccacgcgtccggctggttcggggatggcggcgccacggcctctcctgctatcgctgctggtcgccgtgctagcggtggccgcggatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggcgacggcgcggcctgcggcgggtgctacgaggtgcgctgcgtggacagccccagcgggtgcaagcccagcgcggcggcgctggtggtgacggcgaccgacctgtgcccgcccaacgaccagcagtccgcggacagcggcgggtggtgcaacccgncgcgggagcacttcgacctcagcatgccc

SEQ ID NO: 11512 - DNA, 466 bp, Zea mays
  Clone ID: cC-zmpo148072d12b1
ccacgcgtccggtttcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttccttaaaggggccttttttaaccagatgccgggggccaaaccgagcgcaggtacaacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaaaaaaaaaaaaaaaagggcgg

SEQ ID NO: 11513 - DNA, 276 bp, Zea mays
  Clone ID: cC-zmpo148072e01b1
ccacgcgtccggatgtttacactctcgactggccacaccatgtaacagactaaccttcttcgatgtctcccattattttcctccacggagttcttctgatgaaacaacatgttctaattgggcttactgtggatgttgtctccattattaattaatcgctttgccatgaaaaaaaaaaaaaaaaaaaaaaaaaaaaaaaaaaaaaaaaaaaaattaaaaaaaaaaaaaaaaaaaaaaaaaaaaaaaaaaaaaaaaaaaaaaaaaaaaaaagggggg

SEQ ID NO: 11514 - DNA, 275 bp, Zea mays
  Clone ID: cC-zmpo148072e02b1
ccacgcgtccggtgagacactctcgactggccacaccatgtaacaagactaaccttcttcgatgtctcccattattttcctccacggagttcttctgatgaaacaacatgttctaattgggcttactgtggatgttgtctccattattaattaatcgctttgccatgaaaaaaaaaaaaaaaaaaaaaaaaaaaaaaaaaaaaaaaaaaaaattaaaaaaaaaaaaaaaaaaaaaaaaaaaaaaaaaaaaaaaaaaaaaaaaaaaaaaagggggg

SEQ ID NO: 11515 - DNA, 431 bp, Zea mays
  Clone ID: cC-zmpo148072e03b1
ccacgcgtccgatttgtccaggaggcggtgaggccacggccatagcgggactttaaggagcacgaaagatccttacgcgtcccgcgccccgcggcccgattgatgaaatgatgtgcgtggtgtttcgcatttttctcgctgaaaattgctcgcaagctgtgtcgctcgctcgcattacaggggagagaaagggaaaggggaagaaattctatatatctcgaatacaaatgacctcttttatagttcatcacatccaccacttggatgaccataaaaacaaaaacagatcaaaatttataacttaattatttagtaatttgttttttctatttatatagaccgggtggatgtgagaggtataaaagagtttctttgcatttcggatgtaaacaattttttttctgaaagggaaggcaggcacaatgagagga

SEQ ID NO: 11516 - DNA, 535 bp, Zea mays
  Clone ID: cC-zmpo148072e04b1
ccacgcgtccggcatgcatcgccctgccaccctccaacgccggagcgccctcctacggggcggcggcgccgttcggaggtgccgcggacgcacccgccggcacctccgagggccctgccagcgccagcggtccatcagctggtgacgcgccggcgtatggcgccagcgccagcggcccgactgctgatgctccggcggcggcggcggcggcggcgtcgtccgggccctctagcgcacccgcgccatcgtcgtctgagtcctccggcgcaccagggccgtcgtcgtctgatgggtcctccggcgccccggcgccatcgtcgtctgatgggtccttcagcgccccggcgccattcgccggcgacgacggatcagcttgagcgtgagcgatgacgcggagtttgggtcatttcgtgcctactcagagacgacgatctcttttttcaattacaaattggccgtccggttacctctcacaatgtgtaacgataataaccgatgctactacgtaccggtccgataatgggtactgagctac

SEQ ID NO: 11517 - DNA, 435 bp, Zea mays
  Clone ID: cC-zmpo148072e05b1
ccacgcgtccggtttgtctaagttcagcgggccgtgcagggcgacggaccctatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgacgtggtgaacccgcgccccggcacgctccggtggggcgtcatccagatcgagccgctgtggatcaccttcgccaagaccatgatcatcacgctcaaggaggagctcatcatccgcggcgacaagaccattgacggccgcggcgtgcaggggccgattaccaatggcgcgcagcttaccgtgcaggtcgtcaacaacgtcatcatccacaacattcacattaacgacattcgtttctccaacag

SEQ ID NO: 11518 - DNA, 454 bp, Zea mays
  Clone ID: cC-zmpo148072e06b1
ccacgcgtccgtttatacagccgagcgatctcctctccctctccgtgtccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggagttccccgagttcaagaccgaggacatggccaacatcatgaaggacttcgacgagccagggcacctggcgccgacaggcctgttcctcggacctaccaagtacatggtcatccaaggcgagcctggtgccgtcatccgtggcaagaagggatcaggaggcattaccgtgaagaagacagggcaggcactcggggttggcatctacgacgagtcgatgacgcctgtgcagtgcaacatggtggtg

SEQ ID NO: 11519 - DNA, 373 bp, Zea mays
  Clone ID: cC-zmpo148072e07a1
catgacatactattgaataaatagtgcaggtcaggaacaaatacatagagttactcaatatatataactcataatttcaatgaattcttaattaaatgaaaaatgaatgcaagcattccctgcatgcgatggcacctcacgctggggttgcatgcgtggttcatatcatgtttgcaagagccatgcagttgctggccatctggttgagctccttgtcaaacttccccatggggttggggacgccggcctgggtgaaggggcggtcgcacgagtcgaagtcctggacggcgagctgcagcatgatcttggcggtgccggtgtccttgaacgtgatggcccgctgcgccgcgccgatggtgtcctgcgtgttcat

SEQ ID NO: 11520 - DNA, 532 bp, Zea mays
  Clone ID: cC-zmpo148072e07b1
ccacgcgtccgttttcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcagcgggccatcacgttcaaggacaccggcaccgccaagatcatgctgcagctcgccgtccaggacttcgactcgtgcg

SEQ ID NO: 11521 - DNA, 556 bp, Zea mays
  Clone ID: cC-zmpo148072e08b1
ccacgcgtccgtttacgcgtccgggaccatggtaattggatcgagattctattcgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctaatcaaggacgtgaccgtgacggcgcccggggacagccccaacacggatggcatccacatgggcgactcatccgggatcacgatcaccaacaccgtcattggcgtcggcgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgttcgcatcaaggcgt

SEQ ID NO: 11522 - DNA, 549 bp, Zea mays
  Clone ID: cC-zmpo148072e09b1
ccacgcgtccggttagcacagagctagctagccagccagccaggggccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagactaaggggagagagagtgacatggctgcccgcattccgatgcgtgggcatgttctttgattcgacacacccttttgtcctctttttctttgttccctctctctccttaatttaacgaattgatgcatgccgctgatgttcttcccctgagagaggggataacacttgaatcatttcatcggttgccaattgttggaaccatcaacattcc

SEQ ID NO: 11523 - DNA, 438 bp, Zea mays
  Clone ID: cC-zmpo148072e10b1
ccacgcgtccgtttgaggtggatgccggcgccgccaatgcgggggcgctgtccgtgaagcccgccttgcagctggaggaaaagggggagctggagaaggaggtgtgggcgaggttctacggcaccggcttttggaggagcccgtcgcagctggacgacaacgacgacaggtgatcgggacaggcccgcgagcgagctatccacaagctcctccggcgatgcgtgggcttccttcgttttccgcgggaagaagagaggatcgaggaaagggaaacatgattgtgtgttcgatactacgattacgaacttcgctttcccttcttttttgtttgtttggaaggggaaatacttctcttctattctacaacaatgtcacgtacatgcaatgtaataataaaaaatgtatgtgatatatttaacaatgtgattgatgattgat

SEQ ID NO: 11524 - DNA, 565 bp, Zea mays
  Clone ID: cC-zmpo148072e11b1
ccacgcgtccgttgacgcgtgggccgagccaccggccggctggggctggttcatcaaccaggccaggtcgttccgctggaacctgacggccagcgccgcgcggcccaacccgcagggctcctaccactacggccagatcaacatcacccgcaccatcaaggtcatggtctcccgcggccacatcgacggcaagctccgctacggcttcaacggcatctcccacagggaccccgagacccccgtgaagctcgctgaatacttcaacgtcaccgacggggtgttcagctacaaccagatgggcgacgtgccccccgccgtgaacggtcccctccatgtcatccccaatgtcatcaccgccgagttccgcaccttcatcgagatcgtcttcgagaaccccgagaagagcatagactccctccacgtcgatggctacgccttcttcggcgtcgggatgggccccgggaagtggtcgccggaggtgaggaagacgtacaacctgctggacacggtgagccggcacacgatccaggtgtacccgctgtcatggacggaattatgctgacgt

SEQ ID NO: 11525 - DNA, 533 bp, Zea mays
  Clone ID: cC-zmpo148072e12b1
ccacgcgtccgttcacgcgtccgagaagggcgaggaggagaagctgcgcatggcgggcatcatcgacatgcagttccgaagggttaagtgcaagtacgactccaaggtcaccttccaccttgaaaaggggtgcggccccaactacctggcactgttggtcaagtacgtcgacggcgacggtgacattgtggcagtggacgtcaaggagaagggctccgacacgtacgagcccctgaagcactcctggggcgccatctggaggaaggacagcgacaaaccgcttaagggacccctcaccgtccgcctcactaccgagggaggcaccaagtccgtctacgacgatgtcatccctgccaactggaaggccaacaccgcctacaccgccaaataattaactttagtgctgacaatactttaagctgacctatgctagctatactagattgggttggatcctaagcaatgcattacacatgcatgcattgaaccgtgatatctatttgctaccactaccctattatgacagtgatgct

SEQ ID NO: 11526 - DNA, 355 bp, Zea mays
  Clone ID: cC-zmpo148072f01a1
ttcacagtgctgatcattatgcttctattggtgaaaggaacaggagttccatgcccaacaacttctgctacaagaagaaaactggcaaaagatgatcacaaagagccctacagcctgatgctcagtcgagcaaggtcctagctctttgagaaaggggaaaagaaagagaggatggactgtaattgcatctccgaagagactgcacttaaataacaatcgactaagaggggtgagtaaactgccggagacggtctaagaggatggctccaattgtgatggctgaaccactgaaggagccacgttctcctcagatcggctgctccagcagatgtcgctgagtgaaggtcttaggccc

SEQ ID NO: 11527 - DNA, 377 bp, Zea mays
  Clone ID: cC-zmpo148072f01b1
ccacgcgtccggatttagaagctggtcgagcacccctggttcaagaaggggtacaggccggccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaaaaaacaggacgggct

SEQ ID NO: 11528 - DNA, 405 bp, Zea mays
  Clone ID: cC-zmpo148072f02b1
ccacccgtccggtttgagaagctggtcgagcacccctggttcaggggggggtacaggccggccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaaaaaacaggacgggctggtgaagcttgaggggttcaagcaaggg

SEQ ID NO: 11529 - DNA, 557 bp, Zea mays
  Clone ID: cC-zmpo148072f03b1
ccacgcgtccggtattcgggcttcttccggcgcgagggcggctggagcacggagtacggggagttcttcatgagctggtactcgcagatgctcctggagcacggcgagcgcatcctgtcggcggcgacgggcgtgttcacggggtcccccggcgtgaagatctcggtgaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggcccgcgtgggcctggccggcgagaacgcgctgccgtgctacgaacacacggtgcacgaccaggtgggggccactgccgacgacagggaccgccaggaccgcatggcggccttaacgtacctgcgcatggggcccgacctgttccagccgacact

SEQ ID NO: 11530 - DNA, 456 bp, Zea mays
  Clone ID: cC-zmpo148072f04b1
ccacgcgtccggttttctaattctttcgatcgaattaggcgccttgttcgttccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcggcctacgacttggcaagaagaaacttaagacgagcgtgaagaagagatctgtgaaccccatctggcacgaggagctaactttgaccgtcacagatcccagcctagctctgaagctggaggtgttcgacaaggacacgttcagtagggacgacccgatgggggacgcggagatcgacgtggcgccgttggggaggctgtgaacgcgagcccggatgcgagcctgaggaaccggtcccttattctgtccgtgcggccgacg

SEQ ID NO: 11531 - DNA, 91 bp, Zea mays
  Clone ID: cC-zmpo148072f05b1
ccacgcgcccggttttagatctcccccttatatcaaaaaaaaaaaagggaaaaattaaaaaaaaaaccaagggggcggccgttctagagga

SEQ ID NO: 11532 - DNA, 550 bp, Zea mays
  Clone ID: cC-zmpo148072f06b1
ccacgcgtccggtttgaaaacagtgggatcgagttgtttcactgcgggagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcattccccgagttcaagcccgaggagatggctgccatcatgaaggatttcgacgagccggggcacctcgccccgaccggcctgatactgggaggcaccaagtacatggtcatccaaggcgaacctggagctgtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacaggggatgtaatgacaaccccttcccctggaatgcatgttgatgatgt

SEQ ID NO: 11533 - DNA, 536 bp, Zea mays
  Clone ID: cC-zmpo148072f08b1
ccacgcgtccgttttgcatcgccctgccaccctccaacgccggagcgccctcctacggggcggcggcgccgttcggaggtgccgcggacgcacccgccggcacctccgagggccctgccagcgccagcgggccatcagctggtgacgcgccggcgtatggcgccagcgccagcggcccgactgctgatgctccggcggcggcggcggcggcggcgtcgtccgggccctctagcgcacccgcgccatcgtcgtctgagtcctccggcgcaccagggccgtcgtcgtctgatgggtcctccggcgccccggcgccatcgtcgtctgatgggtcctccagcgccccggcgccatcgtccggcgacgacggatcagcttgagcgtgagcgatgacccggagtttgggtcatttcgtgcctacttcagagacgacgatctcttctttcaattacaaattgcccgtcctttactccttacaatgtgtaatgataataacggatgctactacgtaccgtacggataatggttacgtagctacc

SEQ ID NO: 11534 - DNA, 515 bp, Zea mays
  Clone ID: cC-zmpo148072f09b1
ccacgcgtccggttgcatctgctcaagatgaggctgcagaatgggagaagaaatatgaaatggctggcgtgcaggctaaaactgcattggagagactagcatcagtgcaagaacaaattaacaaaattgcacaagaaagggaaagttctataagggcagaatttgcctcacatttggagggaaaggaagaggaaataaggaaattagttgctaagattagagaagcggagagtgaagaaagtgtattgactgaacgcttgctggttgtggaatcaaaaacacaaggccacaacaaggaaactacaggcttgagggatgaaatcaaagaactaacaagcaagttagagtatctaagagatagagcagtatcatatgaaaagcaagctagaatgctcgagcaagaaaaaaaccatcttcaagagaagttcttatctgaatgtaagaaatatgatgaggcagaacaaagatacaagtctgcagaagggatgcgaagaaagcctgtgagtggctgatgc

SEQ ID NO: 11535 - DNA, 522 bp, Zea mays
  Clone ID: cC-zmpo148072f10b1
ccacgcgtccgtttcccccacaccttgagacctgcgttgtcacccacccatcgaggttggggccgccagcaggttcagccgttcctgttcttgataaaacgagagaaggatggcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttcaattaattgatttgatgggtctcatggttaccagaaacaaaactactttttgata

SEQ ID NO: 11536 - DNA, 380 bp, Zea mays
  Clone ID: cC-zmpo148072f11a1
ttgtggtataatatatttatattgcagtcggtccatccatgattgaccgtatcagggattgacaatttggcagcacatcgacgtggttaaggcacaatttgatgcaacaagggaacaaaaaagaagaatgaaagaacatccttatgtgttacactcagaatcgcagcttgctggcatacgcaagcaccagctcgcttccatcacacgcaaaaccttttttctcgtgggcgtgaacaattcactgctgtttgcttctaccaacgaaagaaacgcttgcttttcttcttcttctcaatgtatgcaacgatctccaactgacgctcaagagtctcctgcaaggtcttctttgtagctgcaagctcctcttccagtgcactaac

SEQ ID NO: 11537 - DNA, 566 bp, Zea mays
  Clone ID: cC-zmpo148072f11b1
ccacgcgtccgttttgctgttaagttcccagcttgctcaatcggggcgaagcaccatattgaccagagcacaacaattcttgacgtgcaaggagtggggatgaagcaattcagtaaagctgcaagggagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagacacaagctttgtttgatggggaaacacaattagcttgagacgagcattt

SEQ ID NO: 11538 - DNA, 380 bp, Zea mays
  Clone ID: cC-zmpo148072f12b1
ccacgcgtccgattaagtcgcctaattctttcgatcgaattaggggccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctttgaagctggaggtgttcgacaaggacacgttcagcagggaccacccgatgggggacgcggagatcgacct

SEQ ID NO: 11539 - DNA, 380 bp, Zea mays
  unsure at all n locations
  Clone ID: cC-zmpo148072g02a1
gttcacaactggttaagatgtcatttgaatttgcacattgatttacatttttttaactccggcaccgtatcggagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccggtctgccacacttgcccccagttgcgcttcatctncgttcacttaacgcgcttgctcccctttaccgacacc

SEQ ID NO: 11540 - DNA, 515 bp, Zea mays
  Clone ID: cC-zmpo148072g02b1
ccacgcgtccgcttatctcgtccgcccacgcgtccgccgccgcgggagcacttcgacctcagcatgcccgcgttcctccagatcgcacaggagaaggccggcatcgtgcccatctcctaccgcagggtggcgtgcacgaagcagggtggcatccggtacaccatcaccgggaacaagtacttcaacatggtgacgatcaccaacgtaggcggcgccggcgacatcgcggcggtgtcggtgaaggggagcaagcgcgttaagtggacggagatgaagcgcaactgggggcaagtgtggcagaccggggaggacctcacctgcgagtcactgacgttccgggtgatgaccagcgaccaccgcaaggccacctcatggcacgttctccccgctgactggaagttcggcgtcacgtaccaggcgtccaaaaacttctaagtagccactttcccttctttttcttaacctgcatgccagcaagcagccatacggatgataacatgcatcatgcatgcata

SEQ ID NO: 11541 - DNA, 392 bp, Zea mays
  Clone ID: cC-zmpo148072g03a1
ttttaatggagacaacatccacagtaagcccaattagaacatgttgtttcatcagaagaactccgtggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttttccttcctggccttctcgacgtccttcttcttcgcctccaccgtcgtcgtggtcttggcggcggtggcgaccttttcctctgcattggcggctgccgttggcttct

SEQ ID NO: 11542 - DNA, 570 bp, Zea mays
  Clone ID: cC-zmpo148072g03b1
ccggccaattcctgccgggacccacgcgtccgcatgttcctcctcctcccccgccggccaacaactcagccgccgtaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgtcaatgcagaggaaaaggtcgccaccgccgtcgagaccacgacgacggtggaggcgaagaaaaaggacgtcgaggaggccaggaaggagaagcaggcgcagcaaagctgaccgactggtcgtgcatgcgcgtgccaactaatataattattggctgatgatacctgatgatcagtgtgtgatcgag

SEQ ID NO: 11543 - DNA, 383 bp, Zea mays
  Clone ID: cC-zmpo148072g04b1
ccacgcgtccgttatattcctctctcggccttcttcgcgtgtttccgggtttttcttaggccgccctctacacttctcgacataaccatcgagagggcggtcgagagaaacgagagcggcagacaccatggggagctcgaggaccatcgttgcgtcccccctgctcctcctcgccctccttctcctggctttcgcggccaccgtcgaggcccgcgttgtcccagagctgtttggcgaggaccaattccagcggacatgcaaccaggtgcacttcaggaagatgtgccagagcttgacgaggctcccgagggtgaccacgccgagcgagctgatgctggcgtcgatgcgcattgtgtctgtgaaggccagggaggccaagagcc

SEQ ID NO: 11544 - DNA, 410 bp, Zea mays
  Clone ID: cC-zmpo148072g05b1
ccacgcgtgcgctttttgttcgtggtcgacgacaccctgcatccggggctggttcggcgacatgcagattctgactacaacgatgccttgagcaagaccatcatattcctggcggcgcatggctgcgggaagctggcgagcagtaacagcggcaagagacgcggcaactacagactatactactgaaagctcgctgacgtggagctgaccggcggatactacgacaccgtccacaacgtaaagtacagactcccgctggcgataacggtgactacgctggcgaggacagcgctggcgacaacgcacgagctggacgctgacctacgagcatcaagcacgtgcgccaggccatgaagggtagcactgagtacatgattgaacgcggcatcctgaagaacaagctgggtgtg

SEQ ID NO: 11545 - DNA, 68 bp, Zea mays
  Clone ID: cC-zmpo148072g06b1
gtaccggtccggaatccccggctctacccacgcgtctgatctcgcgtccgcaccccggagcccttcat

SEQ ID NO: 11546 - DNA, 394 bp, Zea mays
  Clone ID: cC-zmpo148072g07a1
tatcaatcatcaatcacattgttaaatatatcacatacattttttattattacattgcatgtacgtgacattgttgtagaatagaagagaagtatttccccttccaaacaaacaaaaaagaagggaaaacgaagttcgtaatcgtagtatcgaacacacaatcatgtttccctttcctcgatcctctcttcttcccgcggaaaacgaaggaagcccacgcatcgccggaggagcttgtggatagctcgctcgcgggcctgtcccgatcacctgtcgtcgttgtcgtccagctgcgacgggctcctccaaaagccggtgccgtagaacctggcccacacctgcttgtacagctcccccttttcctccagctgcaaggcgggcttcacgggcagcg

SEQ ID NO: 11547 - DNA, 483 bp, Zea mays
  Clone ID: cC-zmpo148072g07b1
ccacgcgtccgtctacgcgtccgccgatccatcttgggcgggcgccgcgcgtcgagggccagccaaagcttgccatggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccgcgggaccgcggcgggctgcgccgctgtgtgctgctgctttcccctgcgtcatggtggaggtcgcggtgctcgccacggtgcgcgcgcccgcgc

SEQ ID NO: 11548 - DNA, 390 bp, Zea mays
  Clone ID: cC-zmpo148072g08a1
agtcataaaaaatatgtattctattaaaatgtagccacacatgataaagttaggattgcgtaggaggtacatggacaacacaacattcatggattcttttgtaaaaaatgaaggcgtatcaaatatttcattaggcacttattatataacttgtcaatccatttcttaactattctcttttaaacaacaacgaagtctcactctagctatatatggagatggagaagatggagaaggaggatgacgccattattgttggcgccagcatcactgtcgcaatagggtagtggtagcaaatagatatcacggtccaatgcatgcatgtgtaatgcattgcttgggatccaacccaatctagtatagctagcataggccgacttaaagtattgt

SEQ ID NO: 11549 - DNA, 546 bp, Zea mays
  Clone ID: cC-zmpo148072g08b1
ccacgcgtccgttttgatccaagacaaaacatggctgtgaatgtaagcaccatgtggtcgtcgatgcaggcacaggtggcgatggctatggcgttggcgttcttggtgagcggcgcctggtgcggtcctcccaaggtcccccctggcaagaacatcacagccacctatggcaaggactggctggacgctaaagcgacatggtatggcaagccgacgggtgccggtcccgatgacaacggcggcggctgcgggtacaaggacgtgaacaagccccccttcaatagcatgggcgcgtgcggcaacatccccatcttcaaggatggtctgggttgtgggtcctgctttgagatcaagtgcgataagcctgtggagtgctccggcaagcccgtggtggtgcacatcacggacatgaactatgagcctatcgcggcgtaccacttcgatttggcaggcacggcgttcggtgccatggccaagaatggcgaggaggagaagctgcgcatggcgggcataatcgacatgccagttccgaaggttaagtgcaag

SEQ ID NO: 11550 - DNA, 386 bp, Zea mays
  Clone ID: cC-zmpo148072g09a1
gatcttagaaagacacgtttcaaatcaaactacaaaccatttgcagtgtcgcgtgatacatagaaacatgccaaattgccagtatacactgcacgtacttgttcttcctccgtaaaaagaatcccccaatttaatccgctatactgagacatagtcgtagtataaatgtacaggtacaaaactcacatagcagccagtatacataccaacgcgaattaaaactggacagtatcgttttccactcttgtatgcagtgctcggtcgccttgcctccgactccgacacccaacaatcgtagtgccaccgcgccagcctcctccgatcccccacatcgtgaacaagctaagatgcatcctccggtccgatccccgggcgctcatgtgaac

SEQ ID NO: 11551 - DNA, 497 bp, Zea mays
  Clone ID: cC-zmpo148072g09b1
ccacgcgtccggcgacggccaggaggaagcggtcaatagaagacaaaattttaccctaaaaaagactagaaaaaacatctccgactatgtcatcgtcggcgttcggcgacttcggtccgctcaccgagcgccgccgcgctgagaaggcgcggcagcagcgcaggcgcatcatgatcgccgtcgggactgtctccataatcgccatactcatcgtcattggctggtacgcggtcatgaacagcgggaagaagtcgtccagcgacggtgaccacaaccacaagtcttcgtcgtcgcgggccaaaggcaagtccagcggcggatcggactcggaagcggaagcggaaacggaaacggaatcggggtcggattcgaagacggatctgaaggctgtgtccaagagcatcaaagcgatgtgctcgcagacagactacacggacgcgtgcgagaagagcctttgcaggcccgcgaacgccaggctcgtcggcgcccaaggacat

SEQ ID NO: 11552 - DNA, 547 bp, Zea mays
  Clone ID: cC-zmpo148072g10b1
ccacgcgtccgtgcgctccccgtccttcggtaggtgcattgcttgggtggtccaccatggcgcagcgagcggtggccacgatgacgactaataagcccctcctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggatctcaagcccggcgctcagttccgcgagaagctgttcctgaacatcagcaagccgttcatcacgttccgggtcggaccccaagaagcccgccgtcgtggtctggaacgacactgcggccacaaccgtaaggacggcaagccggttggcaccggggggag

SEQ ID NO: 11553 - DNA, 437 bp, Zea mays
  Clone ID: cC-zmpo148072g11b1
ccacgcgtccgttcacgcgtccggtgccgggagcccttcagcgacgagacggtggagtacgtgcggtccctggacgcggaggaggacgtgactatgctgaggctccacgggtgggaggtgtcgcgcgagtgcgcgcgcacgctgcgcgtcgccaccatgctgctgaagaagggtgtggagaggggcctcaccgccttccacatcgggagcatcatgtgcagagagaccctgaccaaggagtccgccatcgaagagatcgtccgtgaggcggcggaacggggaggaggatgcgagactgtcttcttgcaggctgtctcggagatcatggaccgccgtctcgacgacatcaaagaacatgttagcctctagatatgcacatggctgacaaaataacgatgtaatcaactcaatggctaatgcaaagaatggtgtactat

SEQ ID NO: 11554 - DNA, 229 bp, Zea mays
  Clone ID: cC-zmpo148072g12a1
gggcccaaaaggggggggtctttttattcggggggggcctcctttacgggcaaaaactgaacaaaccggggaaaaaagtaatttgaatacccccattgaattttattcttttaacccccgccccctattgtggggctttagccaaaaaaaaaaattggccgcagggggccaggtattattcgcatgggtgcttgcgggcctgccgggtgaaaaaaaggggggaaagggg

SEQ ID NO: 11555 - DNA, 382 bp, Zea mays
  Clone ID: cC-zmpo148072g12b1
ccacgcgtccgttttggcgacggcgcggcctgcggcgggtgctgggaggtgcgctgcgtggacagccccagcgggtgcaagcccagcgcggcggcgctggtggtgacggcgaccgacctgtgcccgcccaacgaccagcagtccgtggacagcggcgggtggtgcaacccgccgcgggagcacttcgacctcagcatgcccgcgttcctccagatcgcgcaggagaaggccggcatcgtgcccatctcctaccgtagggtggcgtgcacgaagcagggcggcattcggtacaccatcaccgggaacaagtacttcaacatggtgacgatcaccaacgtgggcggcgcctgcgacatcgcggcagtgttggtgaagggggagc

SEQ ID NO: 11556 - DNA, 357 bp, Zea mays
  Clone ID: cC-zmpo148072h01a1
tccacctaacaatagaacacatatatatttatggttttttaaaacaaagttcactcgtgtgatgaaaatttcaaagaacgaacgttttgtgtgcccctacacttgataatttgcacaaaatagatcctccattatccattcacatattaattaattaatttgtaatagatttctgttgagttgtttggaaattcgtcgtcggtggtgtgcgatgaaatctattcccagtccatgtcgatcgtcagttcagttgatggcaacgtcgttgaagtcctcgttgttcaccgtcgagtagaaggcctgctcctcgtcgggggcggggcgctccttcgccttgagcttcttgatcttgtcgat

SEQ ID NO: 11557 - DNA, 384 bp, Zea mays
  Clone ID: cC-zmpo148072h01b1
catggacaagggctgggagcttaagactttcatacacaagatcaaggtgcatcaaggaaaaggaccgcccctgccccgacgagtagcacgccttgtacttgacggttaacaacaaggacttcaacgacgttgccatcaactgaactgacgatcgacatggactgggaatagatttcatcggacaccaccgacgacgaatttccaaacaacttaacagaaaatctattccaaattaattaattaatatgtgaatggataatggaggatctattttgtgcaaattattaagtgtaggggcacacaaaacgttcgttctttgaaattttatacaccagtgaactttgtttaaaaaacccataatatattttggtcttatgtaggggg

SEQ ID NO: 11558 - DNA, 384 bp, Zea mays
  Clone ID: cC-zmpo148072h02a1
tttctcaagcatgccctttattcatcgaatcaacgagacaaaaaattaccgcaaatgcttatttgcgggacgttacattaattgggctgctatatatgtgtatgaagcagtcgacgaaactatacatcgtcggtcatcaaattggtaggtatacccatgcatgcatgcatcaaatcgtcatcgcatcccatgcatgcatgtatatatgatgtatcagtgattcagtgtcacgcaagcaggcagaagacgacgaccggcgggcgtgctctgcgttcaggaaggaggaggggtgcaggacctcctgcagttttcgctgagcagaggctgcttcttcttggcgcatgtggtgttgcaggccttggtgacctcagccgccttgaccac

SEQ ID NO: 11559 - DNA, 320 bp, Zea mays
  Clone ID: cC-zmpo148072h02b1
ccacgcgtccgctttttcgatccatcaacaatcgccgagagcgatcgagagattaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttttgctcgacgctgtgcaagggcaggaaggggatggacctgctgttgtgcaaggagtcctgcgacctctcacagcgcttcaacctggtgcttgacggtcggatccagtgcaagggcaagtgca

SEQ ID NO: 11560 - DNA, 398 bp, Zea mays
  Clone ID: cC-zmpo148072h03a1
tttttggaccttaaatcatctattcaatatatatatgcgtcatccttacatacatggataataattctctgaaaatgaaaaaatactagctctggctcagcattccaacaaaaagaaaagaacacggtcgatctcaaagatcagcgaagaagtggtaggtgctggaatcacgcatgatgagccttattgcggagaccgccgctgcaacagccagcgcagtgaacccaagaacattgagccagtgccatgatttctggatggcacccagcttaggccccttcaccatcaggtacatgtgatttgcgagcacaaacgtcagcgggaaggtgctgagggcgcccgtcaggctcatgaagtcgccgaggaatgggagcaccgcggccaccagcgtgttcacc

SEQ ID NO: 11561 - DNA, 494 bp, Zea mays
  Clone ID: cC-zmpo148072h03b1
ccacgcgtccggctcttgctctcaaggccacgtgtggactgttcagggacgatggagtgctgaaactcccttactgcattgtgatatcaggatctagctgcgctgtgttcgccatcggaatcccttatttatctgccctcaggagcggggtggggttctccacgcatctcagcctcatgtatatcgtgatgctggtgtgcgctgtcaacatgagatgggataaccgcacccacaacgtattgcagcatccccaaatcatcgcaggcaactcgaggcttcactacgataggctccatagcagaccttgcgtttgcttacaacaccaccttggtgacagagacaacatgcagcatgaggcctgctcgggtgaataacatggagaaagctctacggttccagttcaccattggctccttgcctctctatgctgccagtcttgggggctactgcgcttatgggagctcaacatcaggctaccttcttaacagtgtcac

SEQ ID NO: 11562 - DNA, 479 bp, Zea mays
  Clone ID: cC-zmpo148072h04b1
ccacgcgtccgatttttccatctccactagtgagtcttgttggtcgaggggattatgaaagatgtgctcatgatatctatttctttcttcagtccccggtttgtttgaagcagttagcgttcgaactccttgagctgcttgttctttcttcatttccggagttggatggcactgtgaggaagtggcacgaagataaagagcaattctgcgcccagtaatgtttatcaaacgtttgaatttgtcacggggcggtgtttgtttccaacacatatcgtctttccagagtggtgtggcctgtgaattctgcgaaaataaggtggtggcttcagaggagtgcccgtggatatctcagtttgaagtgtgtggtggctttgtgcagtgtgaatatggttagatagtgcgaggatatggtccctttttccaccgggccatggcagaaccggtttttgggcccgatagagctcatttttccccccttc

SEQ ID NO: 11563 - DNA, 553 bp, Zea mays
  Clone ID: cC-zmpo148072h05b1
ccacgcgtccgatttgtattagaaataaccgaacaaggatttgtgggcaccttgtgtgttcttctgctaacccgtttacaacagcgcgacagagacgacgaatttggtcaatatgatgaaagaaaggcgtgtcatttgagcgatggatcaatctcggtgtgagaagggatgcggctcctgcttactccaggacgtctgttggccacagctgcctccacttggagatgtcatccttgccgcggagcttccttatgccgccgtagaacccgtcgccctcgttgccctcctccctatgctccttccgcttcaccaacgcttgcctccaccttgagcccggcgtgtactgattaaactccagcaccacggtatcactaagatggcaccgacaaaagtgttcgcttccatcacatgactccaagtgcccaacaactccataccaccagccgtatgggaattctttgttccttctccactgaatctcgatgtggtcgccgggccggagctcatgcaggcagtcagaggtgtgcaggtcatgcgcaagggtgtcaacagg

SEQ ID NO: 11564 - DNA, 533 bp, Zea mays
  unsure at all n locations
  Clone ID: cC-zmpo148072h06b1
ccacgcgtccgctttcgcgtgggcggacgcgtgggggaagagttgggtataagcaacaatcagattggggtgcttcctgattcttttggaaacctgcagcgtctccgtgtgctccgcgcagaagagaaccctctccaagtgccaccaagagatgtagctttaaagggagctcaggccgctgttcaatacatggctgaatatgttgccaagaaagccacaaggtcacaaccgatgaagacaaagaagacctgggctcagttctgctttttctcccggcctaacaaaagaaagcacgaccgaatagacaccgcgtcgtgattcactgtgagactgatgaacattaagctgctgtttcctcaactctacacttctgaagagaactatcgggtgcatcgccttcgatcgctaccattgtgttgtatgggtcaacaagatgtgatgcccagaagctnttccttggacaatgctgcaacctgcagcttctaacctgtagaaccaagatggtcaggtttcaccgaacctactcactcttg

SEQ ID NO: 11565 - DNA, 392 bp, Zea mays
  Clone ID: cC-zmpo148072h08a1
tttgcgacgagattattatgagtatcattataatcttggacgtacagaaacaatagcagagtgagagatttggatggatcccccgcacgcgcccgcagacgtcgacctaatataatgaacaatgcgggggcggccggaatcaatgaatcatcagtaacggagtagaaatcatgtcatgtcagggaagaaacgaaacagcgggacacacacgcatggccatggggatagatcactgcgtggcgacgagctgcacgcctcggacggcgagcgcggcgagcgggccgatggcgagggagttgatgtaggtgcagggctcggtgtaggaggagttgccgcgcttgtccacgaagccgtcgttcttgtcgggcccgccgacgatggcgccggtgagc

SEQ ID NO: 11566 - DNA, 355 bp, Zea mays
  Clone ID: cC-zmpo148072h08b1
ccacgcgtccggtttagtgccccttctactgctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttccccggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctccgcgacggcgccaactcgcagtacgtgac

SEQ ID NO: 11567 - DNA, 126 bp, Zea mays
  Clone ID: cC-zmpo148072h09a1
caggaaagcggcaagattatgcatacacatggctacaaatcatattcagacaagtttccacgatcctcctgtagtcctgtttacaacgaaagttagctccaagatgcagcgcatccggacgcgtgg

SEQ ID NO: 11568 - DNA, 126 bp, Zea mays
  Clone ID: cC-zmpo148072h09b1
ccacgcgtccggattcgctgcatcttggagctaactttcgttgtggacaggactacaggaggatcgtggaaacttgtctgaatatgatttgtagccatgtgtatgcataatcttgccgctttactg

SEQ ID NO: 11569 - DNA, 530 bp, Zea mays
  Clone ID: cC-zmpo148072h10b1
ccacgcgtccgtttacgcgtccgggagaaacctaacgggcggctggtgacctttagggaatctttgtaaaggctacgtagtgataccctgccggaccacctaggaagtgatcaatggggagtcatgatccccgggcaaaacgggaatcacgactcatgggtaaagtgtgcgacctctgcagagggtaatgaaactgatatatcagccgtgctcacggttaagagcagccttgggatcctctttgattagagatacttgatcagagatgtatggtttacaggtggtgatgaggaggatggttatgattatgactatgataatggtaagtggtattctttccgtttggaaagggtactttgggttaataacttgggttaacgctaaaacatggctttctactagtaataataacctgaccaactaaaagcaactgcttaacttaactccatataaagctagtccactacagccaaacaggacatttgctgagtacgtttatgtgtactcacccttgcttttacaaaacacca

SEQ ID NO: 11570 - DNA, 474 bp, Zea mays
  Clone ID: cC-zmpo148072h12b1
ccacgcgtccggtttggcgacggcgcggcctgcggcgggtgctgggaggtgcgctgcgtggacagccccagcgggtgcaagcccagcgcggcggcgctggtggtgacggcgaccgacctgtgcccgcccaacgaccagcagtccgcggacagcggcgggtggtgcaacccgccgcgggagcacttcgacctcagcatgcccgcgttcctccagatcgcgcaggagaaggccggcatcgtgcccatctcctaccgcagggtggcgtgcacgaagcagggcggcattcggtacaccatcaccgggaacaagtacttcaacatggtgacgatcaccaacgtgggcggcgccggcgacatcgcggcagtgtcggtgaaggggagcaagcgcgttaagtggacggagatgaagcgcaactgggggcaagtgtggcagaccggggaggacctcacatgcgagtcgcttgacgtccgggtg

SEQ ID NO: 11571 - DNA, 106 bp, Zea mays
  Clone ID: cC-zmpo148069a01b1
ccggcatatccgggtcgacccacgcgtccggtgtttctccgccaagggccacggggccaaccgggggggatacttaaaataggcctcgggggccgcactggaagga

SEQ ID NO: 11572 - DNA, 442 bp, Zea mays
  Clone ID: cC-zmpo148069a02a1
tgtatgaactctctctcttcttatgaagcgcttgttccggatcttaaaggtaaaaaagcaagaccattaaaaaggatccgcaactatttgtcccaaatccaggataaatcacatcgaatcgatacacagatcaattcaccgcacaagccgaaaagaaccaacacctatcctagatacgctgctccatctacacagccgacgacattgcagtttcagcagcgcgagtcactcgacgccctcggtggatctctgcaccagcacaacgcccagggtgatggcggaggcgtagagcgcgttgggcaccttgcgtaccaccttgcccacgccggggacgccctccgtcgcccgcttggtcgccatcgccagcgccggcgccgccaccagcgtgatcagcagcttcacgctgatcgagcacagcgagtccgcggtcagcttccggatg

SEQ ID NO: 11573 - DNA, 346 bp, Zea mays
  Clone ID: cC-zmpo148069a02b1
ccacgcgtccggtgttcttccgccgtcggccatgggtcaagcctggggtaatctccaagataggctccaagggcggcggtggaaggagcaccaggtgaggaagatcaccgacaaggtgttcgaccgcctcacggtggacgcccagaagcgcgacatggaggccctcagattcgaggaggtctacatcgccgtcctctgcgtctacaatgacatcaacaagtacttgccggggccacaccacgaccccccgtccaaggagaagctcaaggccatgatggaggagtacgacgtgaacctggacgggctcctggaccgcgaggaggtcgcggagttcatccggaagctg

SEQ ID NO: 11574 - DNA, 340 bp, Zea mays
  Clone ID: cC-zmpo148069a03a1
ctctctagagcgcgcgccctttttttttttttttcaaactgaaggataaaggcaatgaaaggcgctctattttgtttcatgacatactattgaacaaacagtgcaagtcaggaacaaatacatagagggactcaatatatataactcataatttcaatgaattcttaattaaatgaaaaatgaatgcaagcattccctgcatgcgatggcacctcacgctggggttgcatgcgtggctcatatcatgttagcaagagccatgcagttgttggccatctggttgagctccttgaaaaacttccccatgggggtggggacgccgggctgtgtgaaggggcgg

SEQ ID NO: 11575 - DNA, 192 bp, Zea mays
  unsure at all n locations
  Clone ID: cC-zmpo148069a03b1
ccacgcgtccggctttttttatctcacagaattataaacatcttggggggagcctcacgactagtcctcctcgccgtcgtggcgctgctgggcggcggactactccagcaggcactggctaagggtnngggaagaaggggacacggtggcgccgccaacccgcatgtggccggcatgtgccctcgcaccccg

SEQ ID NO: 11576 - DNA, 438 bp, Zea mays
  Clone ID: cC-zmpo148069a04a1
tataggagatattcgctgactttacgtcaactgcatatatcatgtacaatttaactccttggcaggaaccatcaaggttggttacatctacagttacaggcttgctcctactttctgaacaaccaccatatcacatacaagagatggttcgtgtctttcagcacttgttttagagttccatctgcttcagtagtctgcaaatgtcgatgaggaactcaaagtgcaaaagatggaaaattttggcctgctgttgagcccgatcagaagcgaagagcatgggtatttcctgcaacggcatccatcttcagatagatgggattgtgggcactcagtggaagcaccctcgttagtctgctgcatgagaagacctcatgatgacctaacaatttggactcggggcaaaaccatttttcttagcgagtcacaactttttgcaac

SEQ ID NO: 11577 - DNA, 195 bp, Zea mays
  Clone ID: cC-zmpo148069a04b1
ccacgcgtttttgttgcagtgcaaaaggaggccacggggtacatggggatgttggaacagcaggctgaccacgaccacgtggcgattcaggacctgcacgatttgcttacggagagggagaaagagttgcttgacttggacgctgagctcgggcactgcaggaggctcctgcagaacgatccgttcaacggcgac

SEQ ID NO: 11578 - DNA, 307 bp, Zea mays
  Clone ID: cC-zmpo148069a05a1
ttaaaaaaggaattggtttggattgccggttggacactccaggggatcctataccttgatccatccatttacaccactttgagattacattacataatgttaatcagtcttgtctgctcgacatgttaataatacatctaacaccagcacgtatcatccggcatggaagctagtattggttccccggttactggggcccggcgtgtcaacgtccaccgctatgtcggccacctcctcgacgaagtcgtcgtgcttcgccatcggatcgtactgtttcatgaccagcacagatgccaccggcgagaat

SEQ ID NO: 11579 - DNA, 223 bp, Zea mays
  Clone ID: cC-zmpo148069a05b1
ccacgcgtccggcgtgctgcgctcatcgtgctccccttccacaagctgcaccagatcgacggccacatggagtcgcttggcgaccagtaccagcacatcaaccagcgcgtgctccaccacgctccctgctccgtaggcatcctcgtcgaccgcggcctcggcggtgtcgctcaggtggccgccagcgacgtgtcatacaccatcgttgtcatcttcttcgggg

SEQ ID NO: 11580 - DNA, 323 bp, Zea mays
  Clone ID: cC-zmpo148069a06a1
ttaaaaaaaatcagatctggttgttgcagaacttgagaatgagctgttgtttccctcgtacaagagagagaactgcagcaccgctgctgctgttacagaacccggaaaaccaagttgtgaggcagctagagctagggctggtggtccgcactggcaccgggacggatggagattacggaaagcatgacggtatggtgaagccgcgacacatgtaggcgagcaggacgtacacgattacggggaggatgaatatcactgcatctgggagcttgacgttcctccaccacatggtgttcctgaagcggcgagcttggcgcttgaag

SEQ ID NO: 11581 - DNA, 146 bp, Zea mays
  Clone ID: cC-zmpo148069a06b1
ttcccgggtcgacccacccgtccggcttgttcacataactagccagccagccagccagggggtgttctagctggtcgctcccggtttccctccatctctttcgccacacgcgcgagagggaggagaggaaacagctagcatcgagc

SEQ ID NO: 11582 - DNA, 388 bp, Zea mays
  Clone ID: cC-zmpo148069a07a1
agattcacagcaagtctgctggtacacgagttatacgttcatcaaacaacctggacatacatccttccagacacaccaagaaaaaaaaaagagaacttgcaaatccgagcaaagtgtgtccttatttcagatgtgacaagcaggtcaaatgcaaagaaaacatagcgaccgagaaatagcaggagcatgcttcacttggtccaccagtgaaggaaatccttacgcctgttgatcttcttttggagctgaagaacgccgtacagcagtgcctcagcagttggtgggcacccagggacgtagatgtccacagggactatacggtcacatccacgtacaacagagtaggagtaatggtagtatccaccacccgtggcacagctgcccattg

SEQ ID NO: 11583 - DNA, 371 bp, Zea mays
  Clone ID: cC-zmpo148069a07b1
ccacgcgtccgggttatttcaatgggcagctgtgccaacggtgggggatactaccattactcctactctgttgtacgtggatgtgaccgtatagtccctgtggacatctacgtccctgggtgcccaccaactgctgaggcactgctgtacggcgttcttcagctccaaaagaagatcaacaggcgtaaggatttccttcactggtggaccaagtgaagcatgctcctgctatttctcggtcgctatgttttctttgcatttgacctgcttgtcacatctgaaataaggacacactttgctcggatttgcaagttctcttttttttttcttggggggtctggaaggatgtatgtccaggttggttgatgaac

SEQ ID NO: 11584 - DNA, 260 bp, Zea mays
  Clone ID: cC-zmpo148069a08a1
aagccccccatccaaatcccatgtttataggaaggggggtttgtgccccaccgggccgttttatactaacacgggtggcccacaatgcacttgggggggcccgcaaaacgcgggagcttacccacttaacggccgggcttgggcgggaagaaaacaaacctggggaacttgcgctcgttctggcccccggactttttgaaaaaggggccctttattatgacggtcccctgggacttccacacccactttttggagccctt

SEQ ID NO: 11585 - DNA, 368 bp, Zea mays
  Clone ID: cC-zmpo148069a08b1
ccacgcgtccgcgcgtccctcgctcctgcgccgcccgtccgatccggtcactggccggggagggctcagaaacctttcatccaatacatacatctatctgagccctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcaagcatccaataacgtcaccttcgacgaggagtactgggcggagcgcgccgaggtggcttggtcgggcaaccctcgcggctacgtcagcgaccccgtggtcggcacgaaccggttcaacgcggacgtgctga

SEQ ID NO: 11586 - DNA, 382 bp, Zea mays
  Clone ID: cC-zmpo148069a09a1
gtggggacagccacgcagttacatttttgttttcctttcctttctcagttacatatttgtaatccaggtgaagaggatttggggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcatatgggcagcggcacgtccttgaggtagccgagcgggttggcggggcgcaggttgtcgctgatgccgacgttcctggtgagcaggacgccggcgcggtccctgtccgcctgcacctggtcgcagtccttgcgcgggctctccaccaagaccacctcgcagatgt

SEQ ID NO: 11587 - DNA, 466 bp, Zea mays
  Clone ID: cC-zmpo148069a09b1
ccacgcgtccgccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgagggggtctctgtggagagccccggcaggactgcgaccaggtgcaggcggacaggga

SEQ ID NO: 11588 - DNA, 480 bp, Zea mays
  Clone ID: cC-zmpo148069a10a1
atataagcactctgttacatttttttatttccttttcttccttttctttcagtggatactgctatccatgccatgcgcgcgttcgctctgtatcatcgttatagttttgtgcagcctgtccgcgacgccggcgtggtacagtttactggtcgttgtcgtcgttcgagttcagctggttgagcagcgcggcgcaaaccgggaggggcacggtcttgaagttacccaaccggtttggcgggccccagctgccgaaatgccaacgttcttgggagcaggacgccggcgcggtccttgagcgcctggacctcgtcgcaagtccttgcgcgggctggccaccagcaccacctggcagatgtcctcctcgtggctgtccttgagctcgatcgtgtaggtgccggtcgcgtcggtgaccccgtcgatggcgcgctcgagcttgccggtgcccgagtgcctgcactccagcctcaccttggcgcccgc

SEQ ID NO: 11589 - DNA, 406 bp, Zea mays
  Clone ID: cC-zmpo148069a10b1
acccactatgtgtaatgaagctggcacgcctggagcagccggggcataactggcgggaccgacgacgcgggcttgctgcctcgctcacacaaataataaggaaaggtgcggtccttttcctccgacatggacaagggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggggaggcttgagtgcaagcacttcggcaccggcaagctcgagcgcgc

SEQ ID NO: 11590 - DNA, 465 bp, Zea mays
  Clone ID: LIB148-008-Q1-E1-D12-SP6A
aaaaaaaagggccccatttggggtttttttccgggccggggaaaatttgggggccctttaaagggggccaaagggaaaagggggcccggttttttaaggggccccaccgggggggggccggggttttttttagggaaggggggccaaaaaaaggggcaaggttttaggggggggaaacccggggaaatttgggtgggttccccaaaggggggaaatggggggggggcttccggggggattggccgggggggaaaacggggtggggagccccagagggggggggggcccccgccccctttttttaaataaaaaaaccggggggccggggggggttccctaaaaaaaaccccgggggggggatttgctttaaagggccgggtgggccttgaaaaaacccccggggggggggggaaagggttttttggggggggggggcgggcgggggaaccgggaaaaaggggaggg

SEQ ID NO: 11591 - DNA, 204 bp, Zea mays
  Clone ID: LIB148-008-Q1-E1-D12-T7A
ccctctgcctcgctgctccccttcctccccgtccccacccacatgccctgcctccgccccgccccgccctgcccaagctgagttcccccaccccccaacaaacaattactagagtagctgcattggcggggaaattaaagcgctagaagctcagcagcaatggcggcagaggcgggcgccggaaggtactggtgccacatgtgc

SEQ ID NO: 11592 - DNA, 547 bp, Zea mays
  Clone ID: LIB148-048-Q1-E1-F3-SP6A
aaggacaacattgttaggaacaatatatagcagttctgcttacacagttacagtttttccgcgagctaacacaactccatgccaaaatcgccattgtcatgagcctcatcagacgtaacgaaggcatctggtacacttacagccagctggacgacaaaccgagttcacggagagatagatgaaaggagggaataacgaagtcgtagagaaaaagaaaagaaaaatggcaaacgcagacttgagtgtgagaatgtgtgagtgtgtgtgtgtgtgtgtgatatatattggtggcggtcccttcctcctagttgtcctctccttccccgtcttgcggtggcgccggttccgggattagctcgtcggctgccatgtccggcagcgtatcctgggacgggctcttcttcatcatgtggctgtagctccccttctccatgaacagctgcgcgaagtggatcttgcagtacagaacgccgttgagcccggcgatggaggaggtggtgaggatcagcccccgtgcgagcacttgaagcagcttttgtgggaggac

SEQ ID NO: 11593 - DNA, 298 bp, Zea mays
  Clone ID: LIB148-001-Q1-E1-E3-F2A
aatagtccgatccacatacgtattgaattgcatttagttcttgaataaaaggaaagaaaaatattacatctgacaagcagggaaaaatatgtaattatggaaaataaattccccaagagaaatttgttgttgaagccgaagagggattgagcaaagtgcgagcgagatgacaacacaaaaatgactgtgaaagcagatcagggagatcactagaagctagcggaagcctgcttggcaaagcggcctttcactcgccatctcgtgtctgctctggccttacgagaagcatacatgatct

SEQ ID NO: 11594 - DNA, 137 bp, Zea mays
  Clone ID: LIB148-001-Q1-E1-E3-R2A
ctcttcgccgcggcggcggatggccctgccgctctacggctgcaggtcctgcgctgtgcatgatgccatcatcttctgccactgctgggacgccaggctgtgcctgcactgcggacgcccgccgtgcaacggggctt

SEQ ID NO: 11595 - DNA, 274 bp, Zea mays
  unsure at all n locations
  Clone ID: LIB148-002-Q1-E1-B11
tgatttgcgtttccagagccatgcggtgcttgctctccaggaggctgctgaggcataccttgttggcctgtttgaggacaccaacctgtgcgccatccatgctaagcgtgtgaccatcatgcccaaggacattcagctggcaaggaggatccgcggcgagagggcctaatcgccacctcaaacatcgtgacaaaaaaatgaagtcctgnggttattgttaatctggtgccattgtaaggacatatgagtagggtttgttttgtggatcgcagaa

SEQ ID NO: 11596 - DNA, 321 bp, Zea mays
  Clone ID: LIB148-002-Q1-E1-B12
tgtagttgtacatatatcaacgcaagaccacggcatcgaaggcgctgctgatgcataccttgttggcctgtttgaggacaccaacctgtgccccatccatgctaagcgtgtcaccatcatgcccaaggacattcacctggcaatgaggatccgccgcgagagggcctaatcgacacctcgaacatcgtgacaaaaaaatgacctcctgcggttattgttaatctgatgccattgtgatgacatatgagtagggtttgttttgtggatctcaggtcaaaacggcggtccaccagtccaggtcgattcgggaaggcactctca

SEQ ID NO: 11597 - DNA, 138 bp, Zea mays
  Clone ID: LIB148-002-Q1-E1-B12-F2A
tgtagttgtacatatatcaacgcaagaccacggcactgcaggccttataacttcgaaatctgggtgccatctccaagcagcgggggagcatgagttgcgtcgttgctcgcctgtgataggcgctctactactcttttg

SEQ ID NO: 11598 - DNA, 277 bp, Zea mays
  Clone ID: LIB148-002-Q1-E1-B12-R2A
acatatgaaaagaataggcatctcataactgccagataggtaacatgtagtaaggcagtgatagatcagtaactgccaaatagttataaaaatataatttatgtttaaggaaaaagtagcaaagacatacaccaaatgagaaattttctatgtacaactacagatatcaacgcaagaccacggcactgcaggccttataacttcgaaatctcgcttccatctccaagcagctagggagcatcaattgcgttgtttactgcctaacacaggtatgcag

SEQ ID NO: 11599 - DNA, 527 bp, Zea mays
  Clone ID: LIB148-002-Q1-E1-F11-R2A
gccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctggaccatgctggcg

SEQ ID NO: 11600 - DNA, 369 bp, Zea mays
  unsure at all n locations
  Clone ID: LIB148-003-Q1-E1-B2
cgtgnccggccgcgngagcttcgccgacggcatcaccaccatgtcgacagccaccttctccgtcgaagcgtccgggttcatctgcatgaacatggggttccacaacacggacggcgcggagcggcaccatgcggtggcgctccgggtgcagggggacctcgcggtgttctacaactgccggttcgacgcgttccaggacacgctgtacgtgcacgcacggcggcagttcttccgcaactgcctggtctccggtaccatcgacttcatcttcggcaactcggcggcggtgttccagaactgcctcatcatcaccctgcgtgccatcgtcaaccagcagaactcggtgcacatgcacgggcgcaccgaccc

SEQ ID NO: 11601 - DNA, 296 bp, Zea mays
  unsure at all n locations
  Clone ID: LIB148-003-Q1-E1-C7
acggacgcgtgggttcacttcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtangggaggcaggggacacggtggcgccgtcaacccgcaggtcgccggcatctgctctcggcacccgttcccggaagttttcacgttcaacggcgggccggaagcgttcaagttaccggtc

SEQ ID NO: 11602 - DNA, 378 bp, Zea mays
  Clone ID: LIB148-003-Q1-E1-D1
gcgaacgcgtgcatgcgcagacgttgaggtcgagggacacggtatctctgagcttcatcggagagcgacccgccaccgccacgcttggccgcaagccgagaagagtgccgggccgggagaccggacgattattgatccgtagcagattcgctaatggcggatacggcggacatggagcggatcttcaagcggttcgacaccaacggcgacggtaagatctcgctgtcggacctgacggaggcgctacggacgctggggtcaacctctgccgacgaggtgcaacgcatgatggccgagatcgacaccgacggcaacggctgcatcgacttcaacgagttcatcaccttctgcaacgcaaccccggggctcataagggac

SEQ ID NO: 11603 - DNA, 417 bp, Zea mays
  unsure at all n locations
  Clone ID: LIB148-003-Q1-E1-G10
acggacgcgtgggttcagaagggtgcggtgcaagtaccccgctgggcagaagatcgtgttccacatcgagaagggctgcaaccccaactacctggccgtgctggtgaagtttgtggcggacgatggcgacatcgtgctgatggaaatccaggacaagttgtcggctgagtggaagcccatgaagctctcttggggcgccatctggaggatggacactgccaaggcgctcaagggccccttctctatccgcctcaccagcgagtccggcaagaaggtcatcgctaaagacatcatcncggcgaactggagacncgatgccgtctacacttccaacgtccaattctactagactttgaattgccttcgattcatccggcgcggcgggctatggacctgcagcagcaagctaattaaagg

SEQ ID NO: 11604 - DNA, 320 bp, Zea mays
  unsure at all n locations
  Clone ID: LIB148-004-Q1-E1-G12
agtnngnnggggannangtcaggcgcngcgtgcgccacatcagccatgggcgcctgcgcaaccaagcccatgacgcttgaggggcaggccccagctgaggccgtcgtcatccacacccaaggttgcgcccgtggccactgaagtctccgttgaggttgcggctgctgaacaggtagctgaaatggtggtggttgacgagccggatgcggtggccgacgttgagcatcagaaggctaatgacgtgctcgctccagaggcggacgtcgcggagcccgaccacaaggaggaggatgctgtggagaagaccgtcgtcgacgagg

SEQ ID NO: 11605 - DNA, 208 bp, Zea mays
  Clone ID: LIB148-005-Q1-E1-A3
gaggccgcgtcaaacgtcaacgcatgctggcagttactactatccattcaatcgatgaaaaacacacatttgcgtgacattacatttggagttccatcgacggtatatttggaaaaaacacaattagcttagaaaatgtgtgtttttcatcgattgaatggataataataaaaaggcatgctggcagttactactaaagaaagaaaac

SEQ ID NO: 11606 - DNA, 410 bp, Zea mays
  Clone ID: LIB148-005-Q1-E1-E6
tatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcatgcgctcacgttctgcgacaccatgtacatgaacacgc

SEQ ID NO: 11607 - DNA, 428 bp, Zea mays
  Clone ID: LIB148-005-Q1-E1-F8
aagcaataacccctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaacggctgctgatgactccgccggtgctgctgcccttggaagtggagctgccatcgc

SEQ ID NO: 11608 - DNA, 336 bp, Zea mays
  Clone ID: LIB148-005-Q1-E1-H7
tttctttaaaaaaaaaaaaaaaaaaaaagaaaaaaaaaaaaaaaaaaaaagggaagaaaaaaaaaaaagaaaaaaagaggaaaaaaaaagaaaaaaaagaagaaggaaagaacgaagaaaaaaagaggggagaggaaagagcgaaagaaagaaaggtggggggggaggggtgggggggaggagcttttccgggggtttggtgtcccccgtgtgtgagacgtcgggggggggggttgttggagggggggtttcggggggggcggcgggggttttgggggggagagtttgtggccgggtgcctctgggctggtgtttttgggggggggtggcggcgcg

SEQ ID NO: 11609 - DNA, 414 bp, Zea mays
  unsure at all n locations
  Clone ID: LIB148-006-Q1-E1-A5
acccacgcgtccgtccgtccatcccatccccgctcgcctctccagtctcctctcctcgccccgctctagacgatcgatggccgcaacggcggcggaggaaatggaaaggatgttgaaggcggattggaagaagggaataagaaaaggaaccgtaccggctggtggaataacgggcgctgccggcttaactgcgggacaacgagtacatccaccgccactaccgctgcgaatggccgctcccgcacgttctgctctccgccttctccatccacaacgagaccctcaacgtctggacgcatcttatangatttttcatctttctcgctctgaccatatacacagcagcacaagttccaaatgcagtagatatccggagcttgcagcatttgccagatgtactgagaaaggctgata

SEQ ID NO: 11610 - DNA, 346 bp, Zea mays
  Clone ID: LIB148-006-Q1-E1-D4
tggacgtcaccggcgtcatcttcgtgaacatcaacggcacatccatcacgccggaggtcatcacgctcaagtgcgctaacagcctgccatgtcagggcgtgcacctcgtcaacgtcgacatgtagtacaatggatacggtaacaagaccatggacgtctgcatgaatgacatcggcaagtccatcggattggcaaacgagctggcgtgcatttgaaccaattgactatcattcatatattatgtactatgtttgtgcacgtgcgttgacactgaagttatacattagtatcaccctcatctacgtaacgatagatatcactatgagattcaaagtaagatacaaag

SEQ ID NO: 11611 - DNA, 405 bp, Zea mays
  unsure at all n locations
  Clone ID: LIB148-006-Q1-E1-F10
acccacgcgtccggacgtctgacaataaaatgaagcttattgccttcgcatgcagttagcatcatcactggacgacaacattgttggttttattagaacacttaatttgtgatgtctcgacataattgccggtcacttaaaggaggagtgggctgctgcatttctatgaaaactcatatgtgagcaaatgctactctcctagtgacatctttaatcattatggtctcaaaaatattggacgtaagctatgacaacatttttcttttgaagatagacactgtcgtcatttgatcaaccctatctacatgtgggttgcgatatttccatattatgtggacagcttacacacagttaaatcagactggatcaccaatngatgaatcataagcttgctctgaacgggaa

SEQ ID NO: 11612 - DNA, 409 bp, Zea mays
  Clone ID: LIB148-007-Q1-E1-C5
acggacgcgtgggttatcaacgcttctcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaacaagtgggccttctgtggctgctgaatcgaagctcgct

SEQ ID NO: 11613 - DNA, 247 bp, Zea mays
  Clone ID: LIB148-007-Q1-E1-E8
aggcgccgacgaggaagggtctgtgcgccaccgcgacactggctggggatgatgatgcgccgtggatcgttggatcgattgcggagggcacacattagatctaggcgtataacccatcgggccgtcgatcattgaatcgatggctgcgatctcgttctggttcggtggtaagaaaatttaatcgtggcccttgttgcaggatccaactgctagacttaaccgataccctttcgaagacatccatccc

SEQ ID NO: 11614 - DNA, 94 bp, Zea mays
  Clone ID: LIB148-008-Q1-E1-B11
aaaaaaaaaaaaaaaaaaaaaaaaaaaaaaaaaaaagaaaaaaaaacaaaaaaaaaaaaaaaaaaaaaaaaaaaaaaaaaaaaaaaaaaaaaac

SEQ ID NO: 11615 - DNA, 466 bp, Zea mays
  Clone ID: LIB148-008-Q1-E1-D12-R2A
aaaaaaaaaggcccaatttggggtttttttaccggccaggaaaaaataaaagacccaggggggggggcaaaacgaaaaaaggggccaaatttttaaaggggcccaaaccggggggggccgggccccttcttaggaaaagggggccaaaaaaaggggcaaagtttaaaggggggaaaaacaggggaaatttggttaagtcccccaaaggaggaaaacgggggcccccctaccggggggagggccccccggggaaaaaaagggggggggcccacggaaggggggggggaaccccccggccactttttaaaattaaaaaaacccggggggccccggggggggttcccaaaaaaaaaccccggggggggaaacggctttaaaaacccggttggacccggaaaaaacccccgggccccccgtggaaaaagtttttgtcggggggggccggcactggaaaccggaaaaaggg

SEQ ID NO: 11616 - DNA, 540 bp, Zea mays
  Clone ID: LIB148-008-Q1-E1-D12F2A
gccgggccgaggccatgatcgatgcagggaggaggatgctgccgctgctctggcctaatcactagtataaagcaggcggagacagccggcccctctggcctcgctgctcccccttcctccccgtccccacccacatgccctgcctccgccccgccccgccctgcccaagctgagttcccccaccccccaacaaacaattactagagtagctgcattggcggggaaattaaagcgctagaagctcagcagcaatggcggagcaggcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacgggcgacagcttcccccgtcgccgcccgaaccggcggcagcaggagg

SEQ ID NO: 11617 - DNA, 326 bp, Zea mays
  Clone ID: LIB148-009-Q1-E1-C5
acccacgcgtcagctaacgcgtcagcccacgcgtccgctgatgcgtccggcggaacgtctaccgcctcgtcgacaaagttcttaacatcttcgacgtcgtcaaccagccggagcaagcgcacaagcacgggtactatccgcgtgcgcgctggccggcctggcagttgtaatagccgggatggtgttgtatcgatctcctttctgcacttgaatatatatgtgaataacgcttgagataaatctgtattgctaggtgtagtgtaacttgatcaggttactgctaacacggaatttcaggtttaggacaggaggccgaagaaagagac

SEQ ID NO: 11618 - DNA, 357 bp, Zea mays
  Clone ID: LIB148-011-Q1-E1-A12
acgcagcagcagccaccggaggagcaggaggagcagcagccaccggagctggaggaggaggagcagcaacagccgcatcagccacagcttccatggttcctgcagaggcagcgcccgcccgttcttcttccatggctccggccccatccacggccgcgtcgaccgttccggaaacatccggtggccgacctggttaacggatttttccgtggttttcactgaaggcgagcactatgctcgggacgtagacctccaaaatatgcaatggtacggtacatatcaatggacgtaaaccggtgtatccatgagcttaattaacatgaacaatcctgctttgcctaaaaagaaaaaacaaaa

SEQ ID NO: 11619 - DNA, 351 bp, Zea mays
  Clone ID: LIB148-011-Q1-E1-B8
cgcgtccaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaatgccatcggcaagtccatcggcttggcaaaggagctggcgtgcatttgaaccaattgactaacatgcatatattatgtactaggtttgtgcccgtgcgttgacacggaagttaaaaattagtataaaacaaagatacataacgataaatatcactatgacattcaaaaaagaaac

SEQ ID NO: 11620 - DNA, 405 bp, Zea mays
  Clone ID: LIB148-011-Q1-E1-E7
acccacgcgtccgaagcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaatgtggtcagaaccgagaactaattaagggctcgatcgtgtgtcaggctactactgttcttgccataattatatatagatacgcaaag

SEQ ID NO: 11621 - DNA, 299 bp, Zea mays
  Clone ID: LIB148-011-Q1-E1-F4
cccaggcctccgaccaacagaggctgcgccagcgagatgttctacgtcatcatgacacgcggcaggctgcggccgggcctcttctcgcagctgtgcgtcgaaggcccgctgggcctccagtgctgatcaacactggcctgctgccgcccaccgcccggaatctatctatctatctatctccttggaaacatatatcagacgatgccccagcgcgtgccgctgatttgatgcaagtatgcggttttcatttgtaaatcggagtcgatccatactaagcgatacaggaaaagacaaaaacc

SEQ ID NO: 11622 - DNA, 353 bp, Zea mays
  Clone ID: LIB148-011-Q1-E1-F5
cgcgtccaagaggtggtccccgtgggctgggacggctggcagatcgccaagccggagagcagcggcatctactacggcgagttcaagtgctttggccccggcgctgacgccaagaagaagaagagggtggggtgggcgctggacctcaccgaggcgcaggccaagccattcgtcggcacacactacgtcctcggcgacacgtggatccagccaccgcccaagtagcgacgcatgccacacgatatatctatttgagtacgaagcaaaagcgagagacacgaatctctaatctctttactgatgagatgttttgcttatatatatatatagacgagctaatgaaaaaaataaaa

SEQ ID NO: 11623 - DNA, 174 bp, Zea mays
  Clone ID: LIB148-012-Q1-E1-D11-R2A
ttcacgcgtgggtccatcggaggcagcgagcaatttcttggacgatgaggtgttataaatactgaaatttgatgctatacagtatgctaatgtactcaaggtactgatcggtagacctagtggacgcaacggcactagagggtgctcaagctacaaaaaggccggcaggagaga

SEQ ID NO: 11624 - DNA, 615 bp, Zea mays
  Clone ID: LIB148-012-Q1-E1-E4-R2A
accggccaatctggaaacttgcagcgaactggaacttgtgaggtatcccatccgatatatttttcatctgtcgtaacaactaccactatacagagaccattgctctagggttgctttatcgtaagctcggctctcagatgcagcatcccatccacgaagaagaggctgtcatcggccaagaacttctgccatgggattgcaaagagattcctgtacccaaccgcctttccaccggtgaatgtgtagttacccttgtacttgctcacaaactcgccggatggtctcgtccttgcagcgaactcgtagtccactgtcacactcgtggagcccttctcttgcatccccaggaagagcccgaagcagtagaacgcgctttgctgctccatgttacagtgagctgagaggaagaaaccctgccctgcaaggtggaaggcttgcgagtatatccgccctgcaggaaagagtcgagagcactcgtcgcgcttgagatccaagtatgctatgcactgtgggtagggccgatcaaactcaacaactttgagtggtctgtacttgtaagcccgctcggcgaatttccggcaggttattgcgtccgctgcaagagctcgttgccgg

SEQ ID NO: 11625 - DNA, 539 bp, Zea mays
  Clone ID: LIB148-012-Q1-E1-E4-SP6A
accggccaatctggaaactttagcgaactggaacttgtgaggtatcccatccgatatatttttcatctgtcgtaacaactaccactatacagagaccattgctctagggttgctttatcgtaagctcggctctcagatgcagcatcccatccacgaagaagaggctgtcatcggccaagaacttctgccatgggattgcaaagagattcctgtacccaaccgcctttccaccggtgaatgtgtagttacccttgtacttgctcacaaactcgccggatggtctcgtccttgcagcgaactcgtagtccactgtcacactcgtggagcccttctcttgcatccccaggaagagcccgaagcagtagaacgcgctttgctgctccatgttacagtgagctgagaggaagaaaccctgccctgcaaggtggaaggcttgcgagtatatccgccctgcaggaaagagtcgagagcactcgtcgcgcttgagatccaagtatgctatgcactgtgggtagggccgatcaaacttaacaactttg

SEQ ID NO: 11626 - DNA, 579 bp, Zea mays
  Clone ID: LIB148-012-Q1-E1-E4-T7A
gggcgcgcacattcgcaaggcgccgacgcgagggagctctccaaggagaaagaatgtacaacctacatgccagaccaaacaaattttaatgaagtcgaagcagaagagtgcgatgcgtatgaagaaaatcaagaggaacctgtagcaatgatggaaggatctccacctgatgttggtcaagatggtgatgatgagcaaggtattgatccatcttgggctgctgtagttacgccggttttacgagtcaagacaatttatatcagttcggcgattcttgctgcgaagagtcctttctttttcaagcttttctcaaacggcatgaaagaatcggaccagagacatgcaacccttagaattactgactcagaggaaattgccctcatggagcttttaagctttatgtatagtggaaagttgacaactactgagcccactcttcttctggatatcttgatggctgccgacaaatttgaggttgtttcatgcatgaggtactgcagccagttgctcacaagcttgcagatgaccacagaatctgcacttctctacctagatctcccttgctcagtttcaatggca

SEQ ID NO: 11627 - DNA, 620 bp, Zea mays
  Clone ID: LIB148-012-Q1-E1-E4F2A
gcggggcgcgccatcgcaagcgccgacgcgaggagctctccaaggagaaagaatgtacaacctacatgccagaccaaacaaattttaatgaagtcgaagcagaagagtgcgatgcgtatgaagaaaatcaagaggaacctgtagcagggatggaaggatctccacctgatgttggtcaagatggtgatgatgagcaaggtattgatccatcttgggctgctgtagttacgccggttttacgagtcaagacaatttatatcagttcggcgattcttgctgcgaagagtcctttctttttcaagcttttctcaaacggcatgaaagaatcggaccagagacatgcaacccttagaattactgactcagaggaaattgccctcatggagcttttaagctttatgtatagtggaaagttgacaactactgagcccactcttcttctggatatcttgatggctgccgacaaatttgaggttgtttcatgcatgaggtactgcagccagttgctcacaagcttgcagatgaccacagaatctgcacttctctacctagatctcccttgctcagtttcaatggcagctgcagttcaacctctgacagatgcagctaaggattttctc

SEQ ID NO: 11628 - DNA, 500 bp, Zea mays
  Clone ID: LIB148-012-Q1-E1-E9-R2A
gttcctggacgccaacccgtccgaggtggtcaccgtcttcctcgaggactacgcggcgccagggtcactcagcaacaccttcaatgccgccggactgtccaagtactggttccccgaggctcaaatgcctagccctagtaagggcggcggtgactggccgctgctcagggacatgatcgccgataaccaccggctcatcgtgttcacatccaagaaagggaagcaggggacggaggggctcgcgtaccagtgggactacgtcgtggaaacccaatacgggagcgagggcatggcggatggcagttgcccaaagcggaccgagtcgaagcccatggactctaaggcccagtcactagtgctgctgaacttcttcaccagcaacccgagccaaagctgggcctgcagcaacaactccgcgccgctcatcagcaggcttaacgcctgctaccacgcctccgccaaacgatggccaaactacatcgccgtcgatttctacatga

SEQ ID NO: 11629 - DNA, 174 bp, Zea mays
  Clone ID: LIB148-012-Q1-E1-G9
taattcctcacaggctgcgtcctgtgcctataaatagtgaacagtattccgttactgttcacgcattctgatttttgcaatcgcatctctcggaatacaacctttgtcaaggcataggtattattgtatttaatgattcaatgtattaagtgaatatgatataatgtatctgtg

SEQ ID NO: 11630 - DNA, 430 bp, Zea mays
  unsure at all n locations
  Clone ID: LIB148-012-Q1-E1-H12-F2A
acatgttccgtatgagcgcgtcgtccaacttgcgccagtattattgcaccgtgtgggttggcttgcttatgagcatacggaggcaggacaggctcacaatctgtgccgacccagtctcgatgtccgagccctgcatgctcgttacgagacgcaagtgcagggacttgggtgaagaccgctcggaggtgttcagcttgctgcatgcagggagcagctcccggatcaatggcttcctctcttctcaaacgccataatgctaaacaggaccacngtgatcgtgctggcgaacattatcgcgttgacaagcagctcagtgtgagcagatgtcgtgaactcgttgcacgctaaagcaatggagacggcttctatcatcagaccagtccaccatattacaatttgctgtctaaatgttattttctcaaatggagac

SEQ ID NO: 11631 - DNA, 373 bp, Zea mays
  Clone ID: LIB148-012-Q1-E1-H12-R2A
gccaagcgttcgctgtggctctatgcagacacgcgtgaactattcatccagaacctggagttatgccctgacagaacgagtccactccattgaatgatgctcaataatgctacgatcgcttttaacagggacaacctcattcgctctctcatacacggcaccgtccacactgactaccacggccggatcgtagagtacagcgatagcacggccatattgtgatatcgacgacgcgaactgaatacacgtgccgtttacattgctgttcatgaccacaagctcacgagagctggtcacactgaactgcacggtaatgcagattgcgcaacagcatggccatcactgagcaccatgtacatcactcatggagtac

SEQ ID NO: 11632 - DNA, 64 bp, Zea mays
  Clone ID: LIB148-012-Q1-E1-H9
aaaaaaaaaaaaaaaaaaaaaaaaaaaaaaaaaaaaaaaaaaaaaaaaaaaaaaaaaaaaaaaa

SEQ ID NO: 11633 - DNA, 466 bp, Zea mays
  Clone ID: LIB148-013-Q1-E1-A2-R2A
atcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcattttatttgctttgccatttctcccctttctgttaatttcgatatgtaaagaggggagaatgggagacactattcgtttggacatgacaattggaaattaatcaataccccattggtagtt

SEQ ID NO: 11634 - DNA, 232 bp, Zea mays
  Clone ID: LIB148-013-Q1-E1-D11-R2A
cgcacgcgtgggtcgagggctcccacggtcacctataacttcatcagatggtttatctattctgagccccgaccaaaaaggcaaggctgactgacgactggctggacctgggctatagaggacgcaaggttctctacgcgatcacggacggtacatgcgcacgctatggacaccgaaacggagaaagacctcatacagacgctgctgtacgggaagaagaacacggtgacgg

SEQ ID NO: 11635 - DNA, 488 bp, Zea mays
  Clone ID: LIB148-013-Q1-E1-D8-R2A
cccacgcgtccggtgacgacgctggcgtggacggcgctggcgttcaagcccgagctggagtcgaccaaggagctgaagcacgtgcaccaggccatcaagtggggcaccgactacctgctgaaatgcgccgccaggaagaacaagctgtgggtgcaggtcggcgatcccaacctggaccaccagtgctgggtgcggccggagaacatgaaggcgccgcgcacgctgtacgagatcgactcgaagacgcccgggacggagatcgccgccgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacgaggcggcaggtgta

SEQ ID NO: 11636 - DNA, 559 bp, Zea mays
  unsure at all n locations
  Clone ID: LIB148-013-Q1-E1-H8-R2A
cccacgcgtccgcccacgcgtccggcttgcgcgagcgcagaaggcacacacgtacagccatggcgaactcgtcgtccggcctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaggttcaggagggagctggacggcatccagtgcgagatccaggccaccgaccccagcgagatgagcctcgacatcgtcaagagccggaccaactgatcgtcatcgtcctactatcatcacatcaagcaacacgtcgattatatatgcatcattataggatcgnttattaatttcag

SEQ ID NO: 11637 - DNA, 397 bp, Zea mays
  Clone ID: LIB148-014-Q1-E1-E11-R2A
gcgacgagggaggccaggagaagcagtgacaagtcgatcgcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaacatgcaaatggagaaggaattgtttctgcctttctaggattcttcttagcacaatgtgcaaaactttttcataatgtaagagagttctggcgtcaaaaaaaaaaatataaaaaaaaaacaaaatgatgctgaacggaaaaatccacaaaaagctcgaaaccaccgagaaaaacgccatcaccgaggcacaccattctaggaaagccggggggggcgcttttaagg

SEQ ID NO: 11638 - DNA, 466 bp, Zea mays
  Clone ID: LIB148-014-Q1-E1-E2-R2A
cccacgcgtccgggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcggttacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagccaccgcgggagcacttcgacctcagcatgcccgcgttcctccagatc

SEQ ID NO: 11639 - DNA, 424 bp, Zea mays
  Clone ID: LIB148-014-Q1-E1-E4
acgcgtccgaaagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtgcttacgtacgcgcgcaaggacgaccat

SEQ ID NO: 11640 - DNA, 336 bp, Zea mays
  Clone ID: LIB148-014-Q1-E1-F7
atccgcatgaccatctcactggctaagaaggagtacgtctagaacatcatcaaccgaggatgtgaatccaagccgtctaagctcgttgagcgtgtccactctacatgtcctcgtggtgtctcagcctcttgtgttttacactctagagctcctagtaccgccgatgtaagatttgctatctgcaatgtgctcatgcaaccagcgtgtgtgcgagttaatagtttgcacgaaacccgctatcaatcttccctagatattttgttgtaccaatgaatgacatgtgggtctatgataaatgatgacacgatgatggttcacatcatgatacatatactc

SEQ ID NO: 11641 - DNA, 370 bp, Zea mays
  Clone ID: LIB148-015-Q1-E1-D2
aagcgatttcgaagcgaagccaatggtcatgctgttgggtcaatactccacggggaaaacaacatttataaagcatttactaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgaccttcgtggacactccaggagttttatcaggggagaagcagcggacgcagcgcagctacgatttcaccggagtcacg

SEQ ID NO: 11642 - DNA, 351 bp, Zea mays
  Clone ID: LIB148-015-Q1-E1-E11
caacgccgggtacctgatgaagcggatcctgtgcaaccgcttcacctcctcggcggccggcgacgacaagcgaccgccggcggacgccgccgaggaggagccgctgccgccgtggctgacggaggaggacgtgggccacttcgcgtcggagttcgagcggacgggcttcacggggcccatcaactactaccgcaacatggaccgcaactgggagctggcggcgccgtgggcggacgccaaggtgcgggtgcccaccaggttcatcgtcggcgacggcgacctcacctaccactacccgggcatccaggactacatccacaagggcgggttcgaggccgacgtcccggggct

SEQ ID NO: 11643 - DNA, 389 bp, Zea mays
  Clone ID: LIB148-015-Q1-E1-F4-F2A
acatacatagatatattcgcccgcatcttttgtagaatcacaagctgacggtggtggaggccgacggcaactacgtggacccattcgttgtggacgacatcgacctctactccggcgacagctactccgtcctgctcacgacggaccaggacacgtcctcgaactactgggtcagcgtgggcgtgcgcggccggctgcccaagacggcgccggcgctggcagtgctcaactaccgccccaaccgcgcgtcggacctgccagcactcgcgccgccggtcaccccggcgtgggacgactacggccacagcaaggcgttcacgtacaggatccgcgcgcgcgccgggacgcccccgccgccgccgacggcggcccgccgcatcgagctgctc

SEQ ID NO: 11644 - DNA, 237 bp, Zea mays
  unsure at all n locations
  Clone ID: LIB148-015-Q1-E1-F4-R2A
gtgttccgcagcggcgggncccggagggagagcgctgcctcgtcggcggcgggggggcggnacgagccgacgccgcagcccagnannnagaagncgnggccggggaggngccacgggngcaccncgcngacgnngcgcgacagcgcgnaggcgnncnggagcagcacgncgacggnggagnagagcgccaggacgnacacgaagncccccaccggcgagaaggggnacggcggcagg

SEQ ID NO: 11645 - DNA, 242 bp, Zea mays
  Clone ID: LIB148-015-Q1-E1-G2
tgttgatgggtgcttcattaattagcaagaccgatgaactagcaaggcttcttgcagaagcacttgcgcgtggccacgacctgcttgcactcgccaccgggaaagctctccttcatgcacacatcggtcttgctaattgttgatgggtgcttcattaatttgatttgatgggtctcatggctacgagaaacaaaactacttttgataaaatgcagggcatgaaaagcgtttctgcagtcctt

SEQ ID NO: 11646 - DNA, 334 bp, Zea mays
  Clone ID: LIB148-016-Q1-E1-B3
caaattaacgaatgaatggcatacatatgatagatcgcgatccataatcaaacatatcttgttggagttagatattatttatagagaagctacgccacagcgacaatagaactggtagtatggttggtcattggtgtttgtatatactatcgtcgcgccgccgcctcctcctccgtcatcgtccgaccccaccgtccaacggcatggcggccggccgcgacgacgtcaatgcatggtgtgcgatcgagccaggccagctgcgtgccccctgcccagccagccagcaggcagatcagaccgccggccgccgccttggcgctcagttcaagctgcg

SEQ ID NO: 11647 - DNA, 369 bp, Zea mays
  Clone ID: LIB148-016-Q1-E1-C7-F2A
caccatcagtaccatttcatcttggtttaaactatacatacagtcgcagctgacacaacccaaggcatgcctattatatacacacccttggctttgcttggctgctgttattctgtaagcacgctagctagcttctccagctctccgggctctaacacgtagatgtaaaccatctgctacacatacgtacatagcgtggtggacagaaatggatggatcagggtcttcaggcgtgcgccagctccttggagacgccgtcctggtacggcgcctcgcagaactcgccgccaaggtcatcgcacgcctcgcccgggaacaccgtctttggctcgtcgtaggacaggtagtccctgtccaccccgaccacac

SEQ ID NO: 11648 - DNA, 371 bp, Zea mays
  Clone ID: LIB148-016-Q1-E1-F7-F2A
aactctgaatctcttatatgtgtagtttacttgtttacatcatattatcccttaggagctcaatacatcgtcagatgccaatttgtcataaactaagattcttgaggtttcatgacaaaaggcataagagagcacatttaaaataggtgcatggacaatatactgttttaaattcagtatattgtttgtgttagtttgtgtctataggctatttagtaagtgtctctttgttaaaagctactattatatctacctatatcttgtctgatagagtcctgctttaaaaattgctggcttttgcatgtgcccaagtcctctgagagcgtctcacacaactttttgtacaggggagcagtctccagatgactttt

SEQ ID NO: 11649 - DNA, 549 bp, Zea mays
  Clone ID: LIB148-016-Q1-E1-H9-F2A
cgtataaaatggtgaagcgattttattgcacagcagagcatcagtctcctcatcttcaacagcccaggaaaacaacccatattcatattgttcagttacatagcagccttgctagatagcggcatgaactctttgatagttgagaccgttgagacaactctctgatagctgagatcgttgagactccggagaactgatgccaagacgtgttggctcagggaagtgccggcagaaccttcccggtgcaggttccaaaaccaatgttgtagccttcacccttgcaacatcctgtcaagatgacttcatctccatcttctaggaacttgcgggtcaaattccccaccggtatctccttctgcccgttccatgtcagctccagcagacacccgagggagtcccgttcaggtccactcagtgtgccagtcgcaaatatatcccccggcctcatgttgcatccgttgatggtgtggtgtgctagctgctgtgtcagcgtccaatacagatgcttgaaattagtttttgtgacaattgatgcgtcattttgatctt

SEQ ID NO: 11650 - DNA, 423 bp, Zea mays
  Clone ID: LIB148-017-Q1-E1-A9
ctggggccgatcccgagcacgtattctggcgttcatcttcctagctatctgctaaggaatgtcgaccggtttagataccttctaccgggcaactgcaggagagaaagtggctaggttttatggcccactaccctgcaacctgttgtgcgtgggtgggtgggtgccagtgccacactgccccgctgcaaagctgctgtccatgggatatctgtggcagttcacctggtacggttgcctaacgtagttgaacaaatgctttggggaagaattggttcatggatgggggtgagcacatgattctctaatgtgtaatagaacatgggaggaggatctaacggcatagcgcacgcttggtcctggctgggtgtgcatgagctgagcggtttgtcattgtcattcattacttccctgattgatatatat

SEQ ID NO: 11651 - DNA, 329 bp, Zea mays
  Clone ID: LIB148-017-Q1-E1-C8-F2A
gattaagggctttaaccgggggggaaaatcaagctatatatttatatataacataggggttcacactttttatgcatgggaacaccaggggcgttattttatgcattgatatttgttacagggaggcaagaagtatgcattcttattttggatgtctgcagaaaacccgacccactggtttagatattaaggggggttcacgataagcccgatagggttcaggcaatattaagagcgggcaaaaaaaccaagaacttggcccggttttaataacttgacaaggaaggggggtgcctatgccctattttaaggtcctaaaaaacattttt

SEQ ID NO: 11652 - DNA, 374 bp, Zea mays
  Clone ID: LIB148-017-Q1-E1-E3
cgacccagttcaaactccaaccacaggtgccgattcaccgaaacccgagcctagcgtcccatcactccctggagccgaaggggtggacaagatggccatcgacgaggccagtggtgacgccccagagggcgcagaagagcttgaccctgcgctcgaagaggagacgccgatggaggagacgatccgtgtgacgcgtgccaagctaaggaggcgcacgaccaccgaagatcctgctgggaattagctgcaggccatcgtttttcctttccctgcacattgtgttgatcttttattttttttggggggggggggtttaggctgtcatgttgtttggtggaatggagatgtgatgttgaattggttctttgtgacac

SEQ ID NO: 11653 - DNA, 403 bp, Zea mays
  Clone ID: LIB148-017-Q1-E1-E6
aagaagtcgtctaattcttggatcgaagtagacgacttcttcgtccctctcttcattaccacgctaacttgtaatctgcaggatctaagcaaagacttgatttagttatggacggattggtacgcctcttgagagttcgcgtgggccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcagaggtggacgtggcgccactgatggaagcagtgagcat

SEQ ID NO: 11654 - DNA, 382 bp, Zea mays
  Clone ID: LIB148-017-Q1-E1-G3
tgcgaattttcatgtaaaaagagctgatcagacatggctgcgaaggacggctcagggtcacaggaccaggggcacaggttgtggcccatgctgtcctacgcttgcggcgagctatgtgtgatcatgctgctctacgtggctgcctttgcatcccatgcagccacaaggctggcgcgcatctgcgggctcaggccaccatgcatcctgtgcacgaggctggaccgcgccctccatggaaacttgccatggttctccgcggacctggtctgttccgtgcatcggtccgaggtctcgtctctggctcactgcaagagccatggccggcttgcacggtccggcgatctctgcaaatcatgcctcctttcatgcacggcggtaggtg

SEQ ID NO: 11655 - DNA, 391 bp, Zea mays
  unsure at all n locations
  Clone ID: LIB148-017-Q1-E1-G5
ttcgcctcccgctctacctcctacgatccgcagatacacaggcccgcgcttcccctcctctcgcagttctcgcgtccactgtaccggagctccaccacggcctccggaaagaaacagatgaaagacagcgacggcgagggcaccggcggtggcgtcgcccgctcgcacccctccaatctcccgcttccgactccacagtccgacccgaacctccagttctcgggtgggacggacgatgagtcctcgagccggaatagcagctcctctgccaccggcggcgcgagccccgggtactactcggactacccgtctagcttcagcggcgagtgttcgccgtacaacatgtcnccctggaaccagaccatggcgttcccctggtcgcaacacaacg

SEQ ID NO: 11656 - DNA, 78 bp, Zea mays
  Clone ID: LIB148-018-Q1-E1-A8-F2A
caatcactacaacaacacgaatcatattaaccacatcctcatatcttccaaaaaaaaaaaaggagaaaaaaaaacaac

SEQ ID NO: 11657 - DNA, 418 bp, Zea mays
  Clone ID: LIB148-018-Q1-E1-B4
ttcgctctcacgatccctcggcagtcggcgacggctgggcgaccgccacttccgccttctcttcctactgagcgtctccaggcacgcttctgaattcggagttgccagcattcgctcgaggtgccggaccagatctcaccatcatgcaggctagcgatagattcaacataaactctcagcttgagcatcttcaagccaaatatgttggtacagggcatgctgatttgtctagatttgaatgggctgtaaacatccagagagacagctatgcctcttatattgggcactatccaatgctagcatattttgccattgctgagaatgaatcgatcggaagagaacgttacaatttcatgcagaaaatgctgcttccttgtggcctccctcctgagagagatgaagattgaagagctgttgc

SEQ ID NO: 11658 - DNA, 276 bp, Zea mays
  Clone ID: LIB148-018-Q1-E1-C8-F2A
caatgtctacatttcatacctttttttttgtttcctccaccccgaggcaaaagcgaaatggaaccctttatttaacccaatttttccaaggctccgtgccatggtcctaatagggaacgcgtcaaacccccacccccacccaaactgtgaaaaggacccctagggatcctccccgttgcctcaaatccatcgaacaagttgaaagtccccatttttctataagggcttaccaccagcaaagctcactttaacaacagggtcattaaagaaacctgc

SEQ ID NO: 11659 - DNA, 727 bp, Zea mays
  Clone ID: LIB148-018-Q1-E1-F109B-F2
attggtacaggtacagtgaaaactagccaatcgccggggagattaaaaataaacaataatctatacacacttgcaggcagtctcgctcgccggccaggaatccacttctaaaacacgtgtaacacgcgccggaatcccattactgatgaaaggcagaacgctgggagggacggtcaggtcagtccagccggagcccggcagaggtcgtcgacgtagctcctggggcgcggcacgggcgtggcggcgacaacgctggaggcgtcggcgagcgccgtggcgtcgtcgtcgaagtccccgccacggacgccgttgaagaaggggtcctgcaggagatcggcggccgagggccggttccggggctggccgatgcagcgctcgatgaagccccacagctcggcgtccttgagccgcttgagcgccgcgggcgggacgccccgggtgacgttgtggaagatctgcacgacgctgccgaactcggcgtaaggcaccttccgcgtgaccatctccagcacgcacatgccgtacgagtagatgtccaccgactcagtgtacgtctccgtgtacagctccggcgccatgaactccggcgtgcccaagatggagtgcgccacgggcatatagagcacgattcgcgtcagcccagggtagcgatcttgacctagccggtgttgccattgatgaaaacgatgctgcagatgaggtcgagggggatgatgcaggggtccgg

SEQ ID NO: 11660 - DNA, 612 bp, Zea mays
  unsure at all n locations
  Clone ID: LIB148-018-Q1-E1-F2-F2B
gccaaccaacctctgtttgaaagaatcagcacgcaaagtcaaatacagcgcttcatctggcgcaaagccaacaacaattattggtacaggtacagtgaaaactagccaatcgccggggagacgtaaaaataaacaataatctatacacacttgcaggcagtctcgctcgccggccaggaatccacttctaaaacacgtctaacacgcgccggaatcccggtactgatgaaaggcagaacgctgggagggacggtcaggtcagtccagccggagcccggcgaggtcgtcgacgtagctcctggggcgcggcacgggcgtggcggcgacaacgctggaggcgtcggcgagcgccgtggcgtcgtcgtcgtcgtccccgccacggacgccgttgaagaaggggtcctgcaggagatcggcggccgaagagcggtttcagaggctgnccgatgcagcgctcgatgaagccccgcagctcggcgtccttgagccgcttgagcgccgcgagcgggaccccgggtgacgtgtggaaatctgcacacctgccgactcgcgtaggcactcccggtacatctcagcagcaatgcgtacatagagtcacgactcatgtactct

SEQ ID NO: 11661 - DNA, 285 bp, Zea mays
  unsure at all n locations
  Clone ID: LIB148-018-Q1-E1-F94B-D9
cacganccggccggcacaaccgggcgcncggggcaaccgggcaaccccgggggcgcgggctccggcgggagcgccggcaccgttgctccaacccgctgacgttgtggacccgccgctgcctccagttaaagctgtgatcgccgccgacgcgccggcgccaggggcggctgacaacaccttctcggcgttcagcttcagcgcggggaacggcctcttgtgggctggcatcgctgccctcttgtccctgacctttctggactgatctttccttggcgtgggtttcat

SEQ ID NO: 11662 - DNA, 516 bp, Zea mays
  Clone ID: LIB148-018-Q1-E1-G8-R2A
ggaagccaaatgtttacacccatttactcatttcatcggcatgaatccaaagcctcataatacataacagggaattcaacatgcggggggtacaatcccagactgaaccaagctgccaagggtacaaaataagaacatttacttgggacgactacttactgatgcagggttcgtttttttaggggggatagacacgtacgggtttatttctttttgggtggctgctaatctttggacgttctaccccgattgggcgggtgcttccggtttaaccgcgcctgggtccgccggtggctccggtccggcctccggggccttgttttttttggtctgcgccctctcaatgagggggttgtagctgcccttctccttgaacagctgcgagaaatggatcttgcagtaaaggacccccttgagcgcggcgtaagaggacctggtgaggatgcaccccccgggcgagcatttgaagcagctcttgtgggaggattcgccttccagagtcattttttccaatgg

SEQ ID NO: 11663 - DNA, 480 bp, Zea mays
  Clone ID: LIB148-018-Q1-E1-G8-SP6A
gggaagccaaatgtttacacccatttacttatttaatgggaatgaatccaaagccttttaatacataacagggaattcaacatgcccttgttacaatcccagactgaaccaagctgccaaggttacaaaaaaagaacattttcttgggacgactacttactggggcagggttcgtttttttaggggagatagacacgtacggctttttttttttttggggggcgggtaatttttgtacgttctacgccgattgcgcgggtcttttcggttaagccgcgcctgcgtccgccgggggtccggtccggcctccggggccttgttttttttggtctgccgccgcttgatgagggggttgaagctccccttttttttgaacagctgcgagaaatggattttgcagtagaggaccccgttgagcgcggcgtaagaggacctggggaggatacagcccccgtgcgagcatttgaagcagcttttggg

SEQ ID NO: 11664 - DNA, 576 bp, Zea mays
  Clone ID: LIB148-018-Q1-E1-G8-T7A
cctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacgggg

SEQ ID NO: 11665 - DNA, 576 bp, Zea mays
  Clone ID: LIB148-018-Q1-E1-G8F2A
gcgcctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattgggaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacg

SEQ ID NO: 11666 - DNA, 515 bp, Zea mays
  unsure at all n locations
  Clone ID: LIB148-018-Q1-E1F3AA-F2
ggctggcggcgaacggggacaagacgcacgaggtgttcaccanccagggcacgccggagagcagggcgccggagcgggacacggagacgcacactgaggcggnggacatcnacacgaacggcatgagcgcgcaggagaaggacacgcgggaggagcccaacgccgagagcggaagcgtcgagcagagcgaccacaacgacacccggggcgagccgcccgcggcgcacaagcggcgcaaggacgccgagcggcggggcagcaacgagcgcagcaacggccagccccggaaccggcccacggccagcgagcacctgcaggaccccagacacaacggcggccgaggcggggacgacgacgacgacgccacggcgcacggcgacgcccacagcggtgacgccggcacgcccgggccgagccccaggagctacggcgacgaccgcgacgggcaccggctggacagaccagaccgacccgcccagcgagaggccggagaaaagaaccgggaaaccggcgcg

SEQ ID NO: 11667 - DNA, 397 bp, Zea mays
  unsure at all n locations
  Clone ID: LIB148-019-Q1-E1-A7
atacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgcagcagcagagcgatccggactgtgatttcncatcgctgcgacaactttgggttcacgaaaaaggaccgtcttg

SEQ ID NO: 11668 - DNA, 252 bp, Zea mays
  Clone ID: LIB148-019-Q1-E1-G3
caatttcatcaagtgttttgtactactccatttgagatcatgcactattatttccacacctacactgtagcaagggactggtttagtcttctgtactttggttattatgttggaattgcaacgattacagtaaatgagaatgacatcacctggtgcctacgacataagacatgttgatttattcacaaccaacagcggcagaaaaggcatcaggaaacatcccaatcttcaaagacggaaacggctacaaaa

SEQ ID NO: 11669 - DNA, 367 bp, Zea mays
  Clone ID: LIB148-020-Q1-E1-A8
acggacacgcggggcaggccggggatcagcgacgtcgtctcggcgctctcgttcctcgccgatccgcaatacgaccctccccaaggcacgggagccgagcagaaggccacagccacaggtcgagagagtaaacccaaggaggatactacagacaaggatagcagtcctcataaggccgaaatgatcagggcagacgacgaaacgaagcatagatgatgaccgtagggggaagctaaccacgggaaagggaggaacactgcagagctgtctgtctgctctcttgaatcttctttttgtaaagcgtacaccacgtaggcaggatgtaacaacaacattcaaggagttatcttgactgacaaagaacaag

SEQ ID NO: 11670 - DNA, 298 bp, Zea mays
  Clone ID: LIB148-020-Q1-E1-A9
actacactcgtcgtcgtctcactcacggcgccttcagacctctctcgagcagataagtctcgtccgtgtccgacattcagaagggggacatgaatttcgctgccatagtctccattcctgcgactaccttcgccatcagcttcttcgtcctcatcagtgcctcgattggcaccgcagtctacaccaatctcctcgactacgtcatccagggatgtgtctactgctacagctgactcaccggattcgtgatcaatgtcagcaactacatcgctggcaccatcgttaggctgtactgcat

SEQ ID NO: 11671 - DNA, 433 bp, Zea mays
  Clone ID: LIB148-020-Q1-E1-B5
tgcaagcccgacgcggcggcgctggtggtgacggcgaccgacctgtgcccgcccaaggacaagtggtgcaagccgccgcaggagcacttcgacctcagcatgcccgcgttcctccagatcgcgcaggagaaggccggcatcgtgcccatctcctatcgcagggtggcgtgcgcgaagcagggcggcatccggtacaccatcaccgggaacaagtacttcaacatggtgacgatcaccaacgtgggcggcgccggcgacatcgcggcggtgtcggtgaaggggagcaagcgcgtcaagtggacggagatgaagcgcaactgggggcaagtgtggcagaccggggaagacctcaactggcagtccctgacgttccgggtgatgactagcggacaacgcaagggcacctcatggcacgttctccccgctgactgga

SEQ ID NO: 11672 - DNA, 401 bp, Zea mays
  Clone ID: LIB148-020-Q1-E1-C11
caaccacatcatcatcgaccagtacttctgcccccaaaaagtctgccccgggcagcgaagcaactcctcgcatgtctccatcaagaacgttaactttcgcaacaactccgggaagttgttcaagcccgaaaccgttcagctgctctgctccgagacgcagccgtgcagcggcgtctcgctcatcgatgtcaacgtcgagtacgccggcaagaacaacaagaccatggctgtgtgcagcaacgccaaggggaaccgccaaggggaagcctccaggccctggattgcctcgtctgatcgatgaccttgcatttgcatgcattcttcttccgtttcacttttccatattctattgcgttccagccaagcatcctgtttcctttataaatatatatatatatata

SEQ ID NO: 11673 - DNA, 402 bp, Zea mays
  unsure at all n locations
  Clone ID: LIB148-020-Q1-E1-D11
ggacgacgtccggacgctggcgtccgtggacctcgcgggccacgtggtggcggcgcccgagtactgccacgccaacttcagcaactacttcacggacgccttctggtcgcacccggcgctcaacggcaccttccacgggcgccgcccatgctacttcaacacgggcgtcatggtcatggacgtcgacaagtggcgcgccggcgggtacacgcgccgggtggaggagtggatggccgtgcagaagcggcggcggatctaccacctcggctcgctgccgccgttcctgctcgtcttcgccggccacatccgggcggtggaccaccggtggaaccagcacgggctcggcggcgacaacgtcgagggccgctgccggggtctccatccgggccctatcancctcct

SEQ ID NO: 11674 - DNA, 421 bp, Zea mays
  unsure at all n locations
  Clone ID: LIB148-020-Q1-E1-D6
tcgccgcgaagcaccatattgaccagagcacaacaattcttgacgtgcaaggagtggggatgaagcaattcagtaaagctgcaagggagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaacgtggttgcatgaaggctgacaaanggccttggaaggaccccgaaatcatgaaaatggttcaaagtggtgatgggaggtgtggatcactcggtac

SEQ ID NO: 11675 - DNA, 345 bp, Zea mays
  Clone ID: LIB148-020-Q1-E1-D9
agacgacggctactggatcgacattgtacgtgtgtgctacttggacatcatcggctacgtaagccatgacaggcaagcgccagcagtgtggagcaaaaactcatgcacaccgaagtacgacagtatcatcatgctcatctcgctgaagatggacatcatcaaccacggagacgtgtccacggtcacgcagtccaagtcgaagttcttcgacatgaacatgtagcgctacaatgacatgccaatcaaagacgtcaccataacggcacccggcgacagatccaacagtgctggaagtcatatgtgcgactcatccgggatcacgatcaccaacacagtctttggcat

SEQ ID NO: 11676 - DNA, 350 bp, Zea mays
  Clone ID: LIB148-020-Q1-E1-E11
cacaagcctccgggctgggcgactacctgcttgaacagggcatgtaactactacgtaccagctggaatgcatgtcgacgacgatggcttccagtttcgacgtccaataatagtaacaacaaagcaaagggcctcctcccggagtaattgctttggctcttctcctccaagccataagatatctaacaattggtgactcgccttaattagttcgctttgcttttgaggttgactcgaccattttgctgtagcgtgaattgcatggacatgcaacgctccaatggactttggaatgtggaatttttttttcccgtttctgtacttttcctagaagatgaagtaatgaactgg

SEQ ID NO: 11677 - DNA, 394 bp, Zea mays
  unsure at all n locations
  Clone ID: LIB148-020-Q1-E1-E9
caggggtccaagcaagggaagaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtccatcctctctttcttttcccctttctcaaagagctaggaccttgctcgactgagcatcaggctgtanggctctttgtga

SEQ ID NO: 11678 - DNA, 424 bp, Zea mays
  Clone ID: LIB148-020-Q1-E1-F8
tccaagtcggcatgggccccgccggcgagctgcgctacccgtcctacccggagagcaacggcacctggaagttcccaggcatcggcgccttccagtgcaacgacaggtacatgcgtagccgcctgcaggcggcagcggaggcggccggcaagcctgagtggggccacggtgggccgaccgacgctggcggctacaacaactggccggaggacaccgtcttcttccgcggcgacaacggtgggtggagcaccgagtacggcgacttcttcctgtcgtggtactcgcagatgctgctggagcacggcgacctcatcctgtcgggcgccacgtccgtgttcggcgccgcgcccgtggaggtctccgtgaaggtggccggcatccactggcactacggcagccggtcacacgccccggagctcaccgc

SEQ ID NO: 11679 - DNA, 352 bp, Zea mays
  Clone ID: LIB148-020-Q1-E1-H3
tcgagaacctgtccatcaacggccacggcaccatcgacgggcaaggagccctggtgtggagcaagaaccagtgccagcattcttacaattgcaagatcctcccgaatagcttggtgctggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagat

SEQ ID NO: 11680 - DNA, 346 bp, Zea mays
  Clone ID: LIB148-021-Q1-E1-C2
tcggacctccgcaagctggcggtgaacctgatcccgttcccgcggctgcacttcttcatggtggggttcccccgctgacgtcccgcggctcgcagcagtaccgcgcgctgacggtgccggagctgacgcagcagatgtgggatgccaagaacatgatgtgcgcggcggacccgcgccacgggcggtacctgacagcgtccgccatgttccggggcaagatgagcaccaaggaggtggacgagcagatgatcaacgtgcagaacaagaactcctcctacttcgtggagtggatccccaacaacgtcaagtccagcgtgtgcgacatcccgcccgtccggttgcccat

SEQ ID NO: 11681 - DNA, 267 bp, Zea mays
  Clone ID: LIB148-021-Q1-E1-C8
tccgtcggtacagtctaccatcaggcagtcgttccaggcgtgcaacggcgacgcgatggcgagtacgaggcgtagcacgcggggcagtcgggccaagacacggccggaaccaagaaggacagcgcgcagctgcaggagcacggcgccaccggcaccgtggaccaggtggcccaggccggcgagggcgtggcgacaagcgtcagcgacaccgcgtccgccgccgtcggtggcgtcatgagcacggtggtgggcgtggtcggcggcgtc

SEQ ID NO: 11682 - DNA, 335 bp, Zea mays
  Clone ID: LIB148-021-Q1-E1-F2
tttgtttttttcaaacgagtgggcaaaactgataacggccaaatggcagagcccaaattgctggctccaacaacagacgaggccaacacagttcaaggatccccaaagtaacagtggcttcagcagctctggaaaccaggcacgcttcagcacaggtaaagaatcatttcggatgcatttcttccacgggcaatctatttttacaagtttgagcaacatctccctactaccaagtgtcaccctcccctgagcacgttttgtcccctttaaaaactacgaacagaattagaacctattctcttcttgcgggtttccacggacgggcgacgaatatg

SEQ ID NO: 11683 - DNA, 73 bp, Zea mays
  Clone ID: LIB148-021-Q1-E1-F7
aaaaaaaaaaacaaaaaaaaataaaaaaaaaaaaaaaaaaaaaaaaaaaaaaaaaaacaaaaaaaaaaaaaaa

SEQ ID NO: 11684 - DNA, 359 bp, Zea mays
  Clone ID: LIB148-021-Q1-E1-G7
acggacgcgtgggttagcagcttgctgaaagcacaatatgtgaagaagggagactacgtcactcttgttcagagcggagtgacttcaatctggatagaggaatccactcaccacatccaaatgaggaaagttcaggtctgatgtgccggtgggaattggtcgtctgagaaattttgatagcgccgcctgatgtgttatcatcattatatgtgtaattttactgttttaccaagagattgcgacgtcgagttaaatgttgtgtcgaattcacgtgtacgctctgaatcttgactgtgtacgttcattttcgcttgtttcacactgaaatgttataagctcaactttactgcttttgtttt

SEQ ID NO: 11685 - DNA, 416 bp, Zea mays
  Clone ID: LIB148-021-Q1-E1-G8
acggacgcgtgggtgggcacctacggctacgccgcgccggagtacgtagccaccgggcacctgacggtgatgagcgacgtgtacggcttcggcgtggtgctgctggagatgctggtgggacggcgcgcgctggagccgagccgggcggggggccgcgacggcagcctggtggactgggcgcggcccatccttatccggcccaaaaagttggagcggatcctggaccggcggatgggcgaggtctgctcggagatgggcctgcagcgcgtggcccgcctcgcgtacgactgcctcagccagaaccccaaggtccggccctccatggccagggtcgtcaccacgctcgaggcagtcctcgccgccggtgccggtgccgccgacgccccgccgcggtgagacgggaggttgatgtaggt

SEQ ID NO: 11686 - DNA, 340 bp, Zea mays
  Clone ID: LIB148-022-Q1-E1-A12
ccatggaccctggcctcgtgtgcaacatgacggtcatgggctacgtgccggagctgtgggggctcaactacaaggacgatcaggtgaacaggatcatctacccggagcatacggtgtcgttcgcgaagctgtcaaggatcaaaaaggacgacctcatcgagacgtccatcaacgtcatcctcaagcagccgcccttcatcgcgacggcgaaccggtctgtcgcgaacgtcagggctgtgagctcggcgtagaccgtggtggtgtacgtccatgcgacggtgacagtggcagtgaccccgtcgaagaagatgttcagagtgtccaaataggtcgggtactc

SEQ ID NO: 11687 - DNA, 418 bp, Zea mays
  Clone ID: LIB148-022-Q1-E1-C2-F2A
caccaaccgccaacattgcaatgggcaacaggtttttataagcgattgggcctcaaccaggtgggatggaccgcccaaaaacagggccgtccaatatactaaaaccactggagggttaacaactctggacaccctgcaacgaagaccattcctgaggaaccttaaaaccaaaccactcaggaatgccctacggcattgcagataattagactcaggctatacagttgccagatttaaaacataaaggacgcaaaccctagagagtagcctgctaaaaaacccagactcatgttcgacgattatggcccggttacagaccctgcaatactgatatccatgacagcttagggaataaggctaaccactctcccttgaaattttgaatttcctggaccaaccacaaacctttttcccatat

SEQ ID NO: 11688 - DNA, 53 bp, Zea mays
  Clone ID: LIB148-022-Q1-E1-C9
aaaaaaaaaaaaaaaaaaaaaaaaaaaaaaaaaaaaaaaaaaaaaaaaaaaaa

SEQ ID NO: 11689 - DNA, 399 bp, Zea mays
  Clone ID: LIB148-022-Q1-E1-D1
gacggaaccagcccaacccgagcccatttctgctcgggtcccggccgatccggcagctcctcatcagcacaacccggggcaacgtcccccagcggatgctagcctgatcgggtccccacggtcgatgggttcgcccgggtccgccaatggcagacgcggcgagtacgtgaggatccctgaggaggtggaggtggcgtccaagggggaggcagatgccgcggcggccatcaaggcggccgtggcagcggagtgcccgagggtgctgcggtgccgcgcgatccggtggtgggccaaggtcgccgtgcttgggatcttccttgcaggggccggagctgctgccgtggtcttcctcggcccgctcgttattaagaaggttgttgcacctattctttactggga

SEQ ID NO: 11690 - DNA, 235 bp, Zea mays
  Clone ID: LIB148-022-Q1-E1-D12
ctccgtcaggcaccacggctgggcagggcagctgctccacgtcatccgtgaggttcacagtgtggctcctctggtgactcgcggcttgctgggggtcggagccatcatcgacgctgaccgcagatgccaaatcttgtgctaacaccatgaacgtgacaacgtgggcgctccactcggatcatcacctctcggctgcggtggcacacctacgctctggcgattgagggtctgagac

SEQ ID NO: 11691 - DNA, 402 bp, Zea mays
  Clone ID: LIB148-022-Q1-E1-E11
ttcgaataacacaggtgagcgcgacgatgggatccctcgttaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcg

SEQ ID NO: 11692 - DNA, 374 bp, Zea mays
  Clone ID: LIB148-022-Q1-E1-E2-F2A
aaagaagaagataaaatcactccctacaaatactcgtcaggaattacaggagaccagcaccaccagtgtgaagcctactttgacccattacagtagttacattacagtgcccgcagtcgaagcacaggcgcaaccccagcggaagcttaaccaattaccaatccatgacgcaagccacgagaagcagagaaaagaaacaaacaaactcattcacagagacacaacctgtcggatgcggtggccctgaaaaagggcaccggaggtcatggctattctgccacgttctcctcttcctcttcgtcctcgtactcctcgtcggcggtggcgtcctggtactgctggtactcggcgaccagatcgttcatgttgctctc

SEQ ID NO: 11693 - DNA, 340 bp, Zea mays
  Clone ID: LIB148-022-Q1-E1-F3-F2A
ggtcaaacattcaaactttataaggattcaagccatactgctgcataagagatttgggtacaacacagaggacacaacaggtccatttaaccaacgaagccacaaccacgattcatgacacacaaaccacagatgtttattagacgacgacatccatatagaggtacaccagagggcaccagacgacgcagatacccaggtacagcagcagcttaaatgaaccatggcttactgaccaccacggaggcggagcaccaggtggagagtgctctccttctggatgttggagtctgctagggtgcggccattctccagatgcttgccaggaaagatccaggac

SEQ ID NO: 11694 - DNA, 78 bp, Zea mays
  Clone ID: LIB148-022-Q1-E1-G7
aaaaaaaaaaaaaaaaaaaaaaaaaaaaaaaaaaaaaaaaaaaaaaaaaaaaaaaaaaaaaaaaaaaaaaaaaaataa

SEQ ID NO: 11695 - DNA, 212 bp, Zea mays
  Clone ID: LIB148-023-Q1-E1-A5
tttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatatacatgccatttttggaggcattttt

SEQ ID NO: 11696 - DNA, 341 bp, Zea mays
  Clone ID: LIB148-023-Q1-E1-A8
acgagcaccatgctcgacaccgtgcgcaccgacgttgacacctgcgaccagggcttcgaggagcgcgaggagctcacgccgctcatggctaagcaggacgcggagctcgccaagctctccagcaactgcctcgccattgccaccgctgccggcttgcgctagaccccctatgtatcgttcggtcatccatagctgtgcatgtgctagctcctaggcagcagcaacaacatatactgcccctataattaactctccacgcatcagagaagcttcactcatgcaacacacttgtaattgtatatcgaggaagaagatgtagttagtgcaatcgttccggttct

SEQ ID NO: 11697 - DNA, 257 bp, Zea mays
  Clone ID: LIB148-023-Q1-E1-B8-F2A
agacattagctgctggacacggaacttatttataccataccctatataatatacaaaggggttacatgatcaccccatgtgaccttccggcacatgtaacattcccttcaagtgtgggatcaaatacaccagcaacactgcggaccgaccaagatcggtattaatggatggcagcattgtctctttacaacaggatatcggacgctattacttcacaagaggacatgacctcatggcatcagaagggttaacatctg

SEQ ID NO: 11698 - DNA, 226 bp, Zea mays
  Clone ID: LIB148-023-Q1-E1-C7
tttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcagaaggttagatatacatgccatttttggaggcatttttaaaaaaagcaaaac

SEQ ID NO: 11699 - DNA, 411 bp, Zea mays
  Clone ID: LIB148-023-Q1-E1-D1
tggagattttacaatatcatggctaccgttttactcagaagcaaaggtgttgttctttgtatatttgtggtaccctaagacaaagggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacgttttaaaatatgttgctgcccagtccccttctcggaaatcaaggctgcaccctcatcaggtttggtcgaatgtattctcttttttgtccaaaaaaaatccattgaataatttgttgttaagtgttcatcatgtttacacagatactcaaaaccttttttaaaggtc

SEQ ID NO: 11700 - DNA, 383 bp, Zea mays
  Clone ID: LIB148-023-Q1-E1-D10
tctgaatctgatgcccgggaattcgccaattttctttgccctttactcgactttgcaccagagaagaggccaacagctttagattgcctaaagcatccatggcttaaacatgacgaggataaaacatgtgggtctcttaacaataatgatgccaagagcattgatctggtccaaagcacagggagtatcaccaccgttgactgtacaaatattgatttgacgagcaaaaaaggcagctccactggaacttgtgataagactgttgatgcaaaatacaacacaagaagcattaccagcaatgctaccatgaacacttatgtacaacccacttctggaagttttgccaacagacttgcgaaaaatgttgatgtaaatccgaacat

SEQ ID NO: 11701 - DNA, 440 bp, Zea mays
  Clone ID: LIB148-023-Q1-E1-E1-F2A
aaaaagggaaaaaattttttgttgggggcatttgtttggttaaaggggagaaaaaggtttatggggtttgttttgtttttaaaaaaaggggaaaagttcctggccaggttttgttgttttgaaaacctaggggcggtcaaaattttacaaagccctttaaagaaaacaagacgggggggggaaaccactgaaattcagcaagggtaaaaaaaaaaggggtttaagaagttttttttgaaaaaaataatctgtggggaggaaaaaacctaattttttaaaaagggttgaactgaactggaccatgatttttaagatgtgggggatggcattagatcttgaaaaattcttcacaaacaattttgatgggggtcgggttgatttgttttttaaaaggggggataaacctcccaaagaagatggggggttgtatccctttttgt

SEQ ID NO: 11702 - DNA, 58 bp, Zea mays
  Clone ID: LIB148-023-Q1-E1-E5-F2A
tctcgatctataatttagttctagatcgcgagcggcagctcttaaggatctttgcaaa

SEQ ID NO: 11703 - DNA, 360 bp, Zea mays
  Clone ID: LIB148-023-Q1-E1-F5
tctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggagaggtgtttgtgccc

SEQ ID NO: 11704 - DNA, 84 bp, Zea mays
  Clone ID: LIB148-023-Q1-E1-F8
aaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11705 - DNA, 68 bp, Zea mays
  Clone ID: LIB148-023-Q1-E1-G11
aaaaaaaaaaaaaaaaaaaaaaaaaaaaaaaaaaaaaaaaaaaaaaaaaaaaaaaaaaaaaaaaaaaa

SEQ ID NO: 11706 - DNA, 230 bp, Zea mays
  Clone ID: LIB148-025-Q1-E1-G5
acacgtccgcccaagcgtccgtctcaccctcgctcgttcacacatctaataacgaaaggtctcgcccttttcctccgacatccacaggggggaggggaaaacgactgcattcacccggcggcagtactggcctcggttccggctccggcgacgacgaccgccgctgtaatcctactcctatgcgtcgtcctctcactgtccactgctgacgaccccaacctctcagacta

SEQ ID NO: 11707 - DNA, 211 bp, Zea mays
  Clone ID: LIB148-026-Q1-E1-A8
gacgcgcgtttcgatacaagactctacagtgagtcgtattaaggatggcacgatacatacaagattcgcacggtccctgcgcacggaagacaagcataactcgagagctggtccatagtgttagtgtgtctgtctggcaatcgatgaatccccatgacgacgtccccgccgcgcgcacgcctgctcgccatggcacggggggctgccctgc

SEQ ID NO: 11708 - DNA, 310 bp, Zea mays
  Clone ID: LIB148-026-Q1-E1-B8
aggcaggcactcctgccagcgcaccggccgactcaccgaaggcacgcagtcctgcagctcctgccaaggatctcgaatctgctgccacgagaactgcacccgctaatgcacctcaagccgcctccatctcctccgttgctgctgctccatcgtcgtcgtcgtctatgaagtctggtccacctgccgcacctatcagctccgcctctacaccgtcttcttccaccgacgaagagttgagcccttccccgtcggtatccatcgacgaagttgcgtcccctgtgtctgatggggcagcttatggatcgggagc

SEQ ID NO: 11709 - DNA, 305 bp, Zea mays
  Clone ID: LIB148-026-Q1-E1-D12
agagctggtccagagcgcccgcccaaccatggcggcggcggcgcccgtgcgcgcctgggtggtggcgctggcgctggtgctggcgtgcgcgctgctctagccgcggccgtccgacgccgcggggcagtccgccccgcagtcgccggcgacggcggtgtcgtcgggcgccgccaagcccaagtgcgtggccggcgccaggaacgaccaggcgtgccgcgtcggcgccgtgcacgacgcggacagccaggaggacgagggctccagcgtcagcatcgaagcgcccgccgccgcactcgacgacgtcg

SEQ ID NO: 11710 - DNA, 315 bp, Zea mays
  Clone ID: LIB148-026-Q1-E1-F6
ccttcccacggtggctggagctactgattcagaagtgcaaaggcctgcgacggtttgagttgcagtgtggtctgtcattgctcacgagctgcctcgacggtggcaataactggcatctcgtgcagcagataccggaggtgcgcatcataagctgcgagggcaagagatactttcagtataacacgagccgacgcatctacgaaactaatgcacagtcagaagaatgaagccatttctgaaaaccttggcacgacactggtttgttttgggtcatccacacgtttcagttgtcgctgtccctaccttggtcccgga

SEQ ID NO: 11711 - DNA, 260 bp, Zea mays
  Clone ID: LIB148-026-Q1-E1-F7
ctctataatgagtcgtaatattgagattagaaaggagtggccaggaactcaatgatgtgtggaccagcatggctgactcgtcggagtatgttagagctcatagctaagccaagcacaagatgtggactcatcttcaagaatgattttcattcgctacttcatcgttaatcgcattttaatttgttttgaattgtcattgtacgtcgtttatgacataaaactgtttattcatcacatatataattcatgtatcgagatat

SEQ ID NO: 11712 - DNA, 253 bp, Zea mays
  Clone ID: LIB148-026-Q1-E1-F8
tgccgatgagcatggactgcctagtaactcgatgatgtgtggagtaccatggctgactcgtcagagtatgtgagagctcataactaggccaggcataaaatgtggactcatcttcatgaatgattttcattcgcgatttgagcgtatatcgcattttaatttgttttgaactgtcattgtacgtcatttatgacgttcaaccgtttagtcatcacgtatataattcatgtatcgagatataggggatttcggg

SEQ ID NO: 11713 - DNA, 105 bp, Zea mays
  Clone ID: LIB148-026-Q1-E1-G12
gatccacgcgtccaaaataaatcataataaaaaaaaaaaaaaaaaaaaaaaaaaaaaaaaaaaaaaaaaaaagaaaaaaaaaaaaaaaaagggagaaaatacaaa

SEQ ID NO: 11714 - DNA, 360 bp, Zea mays
  Clone ID: LIB148-027-Q1-E1-B2
gccgagcgcttccgctgccccgaggtcctcttccagccatccttcatcgggatggaagctgccggcatccacgagaccacctacaactccatcatgaagtgcgacgtggatattaggaaggacctgtacggcaacatcgtcctctccggtggcaccaccatgttccctgggatcgctgacaggatgagcaaggagatcactgccttggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccac

SEQ ID NO: 11715 - DNA, 353 bp, Zea mays
  Clone ID: LIB148-027-Q1-E1-B9
aaagggccgcctccgcaagcagagggtcagctacggttcacgcaagatggcgtgacattatcgttctaccctgggttactgggtggcagcgggggcgtgggtcatctaggtattcgcgttgcgggacgtacgcctcatgagcgtagccatcctgcagggggggagatttcaggtttcacctggaacgcgcacgcaccgtctggtaggtgaagcagcagatcaggaaggaacagcccgcgtcggcgcgccccgacgtagcaagagggcgtgctcgagggtgaggacctcgacgacagccacctcatccagtatatgtgcacggcttagggcggcgtgagagacagtgacgggtg

SEQ ID NO: 11716 - DNA, 364 bp, Zea mays
  Clone ID: LIB148-027-Q1-E1-D11
tcccaccgttctgggcagagactgatgagggcatagcacacgctatcatccggtccaacatcgacttccgcagagagccttggtcaaaggtgtcggaaaatgcaaaagatcttgtgaggaagatgcttgatccaagcccctactgtcggttgactgcccagcaggttctagaacatccctggatacagaatgccagtgcagctcccaacatcccacttggagaagcagtgaggtccaggctgaagcaattcactgttatgaacaagttcaagaagaaggccctgcttgtggtggcagagtacctaccagccgaagagctggaagcaatcagggagttgtttcagttgctggacacgaacaagga

SEQ ID NO: 11717 - DNA, 326 bp, Zea mays
  Clone ID: LIB148-027-Q1-E1-D3
ggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcacctattcatcaagactgcaataactgtcgctacctatgcttctcacctgtgattttttggacacaatatgttaaggtccattcaattctaatgagacgcctgatgaggctactagcataaaacataaaa

SEQ ID NO: 11718 - DNA, 343 bp, Zea mays
  Clone ID: LIB148-027-Q1-E1-D9
acagtacctactttggagctgcagttggagaggtttgggcatcattatacacagcgcgagcactcgttagccgtcgagcagccggtgtacctgagagagacgcagagatggcggttctcgtgcaggaaatgctgcatccagatctctcatttgtgcatcagacaattagcccagttgaccatgatcccaaattagtagaggctgaggttgcccctggtcctggagaaaccctcgcttcaggtacccgtggcactccatggagacgctcacgtcacaagcttgatggcaaagtcacaactctagcttttgcgaatttcagtgaagagcttatggtgctcaactc

SEQ ID NO: 11719 - DNA, 415 bp, Zea mays
  Clone ID: LIB148-027-Q1-E1-E10-F2A
tttttatttttttttgtattctgttttttttttttttgcaagatcaaaccaggatgctttggtctcctcccagagggtatgtgctgttgtttgccaaaattttccccatccaaacaaagacctaataactgtgaaaggccggtgtctttactttcattaacttacaaatcctgagggccaaaggggggttttttttatttacatacaaaaggtgggaggcttgtcatgcacaaactcaatgcccccgccctaattaccagggtggatttttttgatcgtgctaatccaaaccaagtgacacctgcttgcgtttgttaacgcaccataagaagctggcaacaaacaaaaacttaatgttctgtcctttagcagccaaaagcgtgtcctgctcgttttttggggacaaacccggttt

SEQ ID NO: 11720 - DNA, 282 bp, Zea mays
  Clone ID: LIB148-027-Q1-E1-E10-R2A
cgatcactgtggtcctgtttagcactatggtgtttgggatgatgacgaagccattgatccggctgctgctccctgcctgcagcaacacggccacctccgagccgtcctcacccaagtccctgcactcgcctctcctgacgagcatgcagggctcggacatcgagacggggtcggcacagattgtgaggccgtccagcctccggatgctcctaagcaagccaacccacacggtgcactactactggcgcaagttcgacgacgcgctcatgcggcccatgtttg

SEQ ID NO: 11721 - DNA, 300 bp, Zea mays
  Clone ID: LIB148-027-Q1-E1-E12
aaggccgccgtgcccgttcttcccagctgcagcaaccggccagtgctcacggttgcgttgcatttgcatggctgcgcgctgcgctctgggagcttgcactagcgggtcggcggcctatgcgcggggcatctttcgagtgcgtgcgtgtctgttcaagctctgatcgtctcgccggcccattcgccggaggaaactgacggcgccttctcgctctcgctctcgaccctattcccggggctgagaggggaggagaaaaaggcacgtccacaccataaagcaggacgtacagacacgtttacg

SEQ ID NO: 11722 - DNA, 317 bp, Zea mays
  unsure at all n locations
  Clone ID: LIB148-027-Q1-E1-G6
aaancgcggtccctctaggcgcggcgggagttcatgcggcgcggcggcggcggcgggaggggcgacgccagctatcgcaagtcggtggtgggggtgcggaggcgtggtcacggcatcgaggtgttcttgcaggaagcagcatcatcagcccgacgacgccggctgcggcagcagcgacgaccactaccagcacgacgtgatcatgctgaggacaacgaagagcgggcgggcgttcccgccgccgatatccgtgatctgcaagggcgggcgggcgtggctctgcctgctggcgcaccgcgagggtggacgcctcgtgc

SEQ ID NO: 11723 - DNA, 337 bp, Zea mays
  Clone ID: LIB148-027-Q1-E1-H12
agagagaagatttatacccgaccttccatgcgaaactgacaatatgggtcagattgtgaacctagtagatgtccatgacttcgttcctgacagcgtggaaagtgtatctgagctgatggcccctccctccccggactccagctacggtttccatgttcccggcgagaaggagttctccaaggagcctcctcagctgccgtcccagctctatctcggcgtgctgaattcccggagcaccgaagaaggctgcgcgaggccgaggcacgtcgtcctcgaccatctctacatcgagaagggctggggcgcacagccgctggtggccctcggctacacccac

SEQ ID NO: 11724 - DNA, 338 bp, Zea mays
  Clone ID: LIB148-028-Q1-E1-B1
tcgggcagcccgcagacggagggtaggacgccaccgacttcagcgtgctgctgcatggggtgaaacacagctggcgcactcgcattgcggtggacaacgggttcatcgggtccaaggaccacctcgcgctccagctggtcgtggaggtcaccgtgcatgtgcacgtcatcgcgctcggagttcgggcagacgacgctatccgtggactgctggatcaccggcgatcggctgagcaacgacgtgcacattgcgtcgcacagttgcaggagcagcttctcggaacgacgacggtccagagcgcctgtggtctggaactctggatcgtgggggaatggcaa

SEQ ID NO: 11725 - DNA, 60 bp, Zea mays
  Clone ID: LIB148-028-Q1-E1-D2
cccacgcgtctgcggacgcgtgggaaaaaaaaaaatgactcaatcagcaacaacataaat

SEQ ID NO: 11726 - DNA, 360 bp, Zea mays
  Clone ID: LIB148-028-Q1-E1-E10
aacactaacgcctacacggagggggacatggacacgatcccaaagctccgtgctgcagacggccaggcggacgacgcagtcactgctgcaccggctcgcgagaagcacacagtcatggcgacagagcttctcggcggtcgccgcagccgcgcatcaggatgcggggcggctgctgctgcaggtgcagtgattagcgtttaacggagagctcctgcatgaagttaaccacaagtccacacggtatacacgacggaacaagtgtttccatcagacgatcatcactgaagaatcaaccatctcatcactgtatgtgtgccgtgttcttgtcatttcatcgttccaatgcaacagaaacgggtt

SEQ ID NO: 11727 - DNA, 253 bp, Zea mays
  Clone ID: LIB148-029-Q1-E1-A1
aaaagcggaagcggcagatacaacggcagaggagcagcatgcgcctgagcgaagccgacgacagggcaggtggcagcactgctgtctgtcctgttgacggcgaggcgagctcgagcgcggagcgggtggccactggtataaccgacggggacctggatgagctgaggggatccatggatctcggcttcaggttcgacgagcagaacggcggccaggacctctgcgacaccctccccgccctcgacttctattt

SEQ ID NO: 11728 - DNA, 332 bp, Zea mays
  Clone ID: LIB148-029-Q1-E1-B10
accgtgggcgagtgcggcgtggacgaggaggaggagctcgggctgagcggcggcggcggtatcagcgccggggacgcgctgcggcggacgcgtgcggagcgcaggccgacgaaccggtacatcagctacgcagcgctgcgcgcggaccaggtgccgtgcaacaaacgcggacggtcctactacaccaactgcgcggcgcaaacggccgccaacccctaccgccgccgctgctccgccatcacacgctgcgcccgcaggatgaactgagcgccatggcggccgcctgcggtctgatctgcctgctggctggatgggcatggggcacgcagctg

SEQ ID NO: 11729 - DNA, 267 bp, Zea mays
  Clone ID: LIB148-029-Q1-E1-C2
tgcgcgcgtccctcgctcctgcgccgcccgtccgatccggtcactggccggggagggctcagaaacctttcatccaatacatacatctatctgagccctttcccgcggtgaggcccgaccggagtccacacacacacggtgtctatggcggccgtaataaggagccgccgccgcgtgtccgttttcttctacgtcgtcctcgccgcagctgcagctgcagccgcggcgcaggcatccaataacgtcacctccgacgaggagtactgg

SEQ ID NO: 11730 - DNA, 249 bp, Zea mays
  Clone ID: LIB148-029-Q1-E1-D12
gggtcgacgcgctgctgcacgatggctactgccatacgcggatccgactggtcgtcggccgcggcgagcttgtaaacgaccggcttgccgccgatggtcggatgcttcgcgttcgcgtcgtcgatcgcgagttgcgcgccgttctgcaggtccttgccgatccgcgcggacgggccggtgagcggcgcggcgagaccgatcaggatcgtctgcggcgcggattgcgcgaacgcgggaacggatgcggcc

SEQ ID NO: 11731 - DNA, 243 bp, Zea mays
  Clone ID: LIB148-029-Q1-E1-D4
gaaggctcccacagcgtggcctcttaacgccgcacgcctatgtgctcccggaagctgccggccttcctccaaagtgacaagaacgtcaccgtcatggacatcaacatggaaggtcgccaagggttcagttcgtggtaccaacaggcgataaactaaagcgataagggcgtagagatcccatacgacatattcgtcaccgtctccgttgctctgcagctcggatcagtcaacctcagccatatt

SEQ ID NO: 11732 - DNA, 63 bp, Zea mays
  Clone ID: LIB148-030-Q1-E1-B3
aatcgaacgacgacctgtggctcaaccgagccttcctccagcagtccgggggccaggacgaca

SEQ ID NO: 11733 - DNA, 382 bp, Zea mays
  Clone ID: LIB148-030-Q1-E1-C12
gacaccactaaatgacatgaaagtgacaccttttccagacccccttcatccagtgcaataacatagctcatccattcattcctcttgaacttgattggcatccatatttgggatctccacttcatctggaaagcagcctgcatatatgtcgatactccgtgtaaggtagatgctatataaactgtcagagtatattgggcatgttagaatatattagacaactactaatatgattggtttaggattgattataatcctggataaccttccttgtatctaagataacattccttgtatctaagataatcttccttatctctaggatagccttcttgtcttcaagtcgtgtattcctatatattctctctaaaggcttcattga

SEQ ID NO: 11734 - DNA, 379 bp, Zea mays
  Clone ID: LIB148-030-Q1-E1-D1
ttcccctgttcctcgaccacctcaacgagcttctgctccgacgaacacgacgcccccccacagccacattgccggacaacgccgtcgccccccgaaccggcctttgccggcgcaagggccggcctcgcctgtctccaagcaaggaagcagcagcagcaaccccgacgacccccgctgcggcagcagcagcagcgacgaccactaccagcacgacgtgatcatgctgaggcggacaaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgc

SEQ ID NO: 11735 - DNA, 421 bp, Zea mays
  unsure at all n locations
  Clone ID: LIB148-030-Q1-E1-E11
gacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgacgccccgccgccggtgagcgggcagaagggcgagcacttcgacctcaccataccggcgttcctcaagatcgccgaggagaaggccggcatcgtgcccatcacctaccgcaaggtggcgtgcgagaggaaaggcggcatccggtacacgatcacggngaaccagcactacagcgaggtgaacggtgacaccgtgggcggcgccggggac

SEQ ID NO: 11736 - DNA, 387 bp, Zea mays
  Clone ID: LIB148-030-Q1-E1-F11
gaacaactcgtccatggccgtctgcagcaacgccaagggcaccgccaagggaagcatcgaggcactggcttgcctggtctgatgatgaccttccttttgcatgcatgcatggtatctcatccttgatgatgatctagctcactagttctttttaatttccgcttcattcgcttttccaaattcgattgtgtttcagccaagttgtttagcgggacatctcttgtctgatcttcctgctaaatagagttggactcctatatatagaggccttccggcacatataatatacgtcggaccaatattattgtgatcactagttatgtctctatatgttgcgacggggataaaaaatttgaatgaaacatagatcacatttcacacaataaa

SEQ ID NO: 11737 - DNA, 371 bp, Zea mays
  Clone ID: LIB148-030-Q1-E1-F4
aagaagtcgtctaattcttggatcgaattagacgacttcttcgtccctctcttcattagcacgctaacttgtaatctgcaggatctaagcaaagacttgatttagttatggacggattggtaggcctcttgaaagttcgcgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctgactgtttgctacaggaggtgttcgacaaggacaccttcagcagagacgacccatggg

SEQ ID NO: 11738 - DNA, 411 bp, Zea mays
  Clone ID: LIB148-030-Q1-E1-G10
acgaggcagccgcggtctcctctccaccccggccgccggccgcccccacagtgccgtaccccgaccagccatgcgcatcttcctgctgtcgggggagactaacatggccggccgccgaggagtacaccacaggcactgggacggagtggagcccccacaacgcgcgccggatccgtccatcctccgccttgcctctgcgcagcactgggatgaagcccgcgagccgccctacgccgacatcgacacacccaagacctgtggcatcgggcccgggatggcattcgcccgcgctgtgctctcgagcctgcaggaggacacccctggcgcggcggcccagatcgggctcgtgccgtgcgccgttggcgggacggccatccgggagtggtccctcgggaaacatctgtacgagca

SEQ ID NO: 11739 - DNA, 314 bp, Zea mays
  Clone ID: LIB148-030-Q1-E1-G8
acacaaccgcaacaagtcggcttaaatgattaagcgtactatacgcttcgtgtcttctccttaattataattattactggccagcccatcgccgcatggatgcatgcacggcgctaattaatccttcttgctactaattaactccggttaattggtggcacaccatgtatagcgtcgtggagttctctatattacaccatacagggaaatgtggagaccggtgttgcattctatacaatttcttcttataattatatgattcatcggttttaaaaaaaacaaccacagacaaaaaaagaagcacaatacgaaaa

SEQ ID NO: 11740 - DNA, 418 bp, Zea mays
  Clone ID: LIB148-030-Q1-E1-G9
tacgccactcattccaagaggcagccgcggtctcctctccaacccggccgccggccgcccccacagtgccgtaccccgaccagccatgcgcatcttcgtgctgtccgggcagagtaacatggccggccgcggcggcgtacacgacaggcactgggacggcgtggtgcccccagaatgcgcgccggatccgtccatcctccgcctttcctcggcgcagcagtgggaggaagcccgcgagccgctccacgccgacatcgacacaaccaagacctgtggcatcgggcccgggatggcattcgcccgcgctgtgctctcgagcctgcaggaggacacccctggcgcggcggcccagatcgggctcgtgccgtgcgccgttgtgaggacggccatccgggagtggtccctcgggaaacatctg

SEQ ID NO: 11741 - DNA, 57 bp, Zea mays
  Clone ID: LIB148-031-Q1-E1-C2
aaaaaaaaaacaaaaaaattaaaataaaaaaaaaaaaaagggacccaaaccaaaaaa

SEQ ID NO: 11742 - DNA, 336 bp, Zea mays
  Clone ID: LIB148-031-Q1-E1-F7
aggcgaacgcgtgcatgcgcagacgttgaggtcgagggacacggtatctctgagcttcatcggagagcgacccgccaccgccacgcttggccgcaagccgagaagagtgccgggccgggagaccggacgattattgatccgtagcagattcgctaatggcggatacggcggacatggagcggatcttcaagcggttcgacaccaacggcgacggtaagatctcgctgtcggagctgacggaggcgctacggacgctggggtccacctctgccgacgaggtgcagcgcatgatggccgagatcgacaccgacggcgacggctgcatcgactttaacg

SEQ ID NO: 11743 - DNA, 78 bp, Zea mays
  Clone ID: LIB148-032-Q1-E1-B2
cataaccctcaagatgaagggaattgccggtaaaaaaatggcaatcgtgttcatggaaaaacaaaacaaaaaacaaaa

SEQ ID NO: 11744 - DNA, 386 bp, Zea mays
  Clone ID: LIB148-032-Q1-E1-E11
ttggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaacaagacgatgttcggcgtccgcatcaaagcgtacgaggacgccgcctccgtgctcaccgtctccaagatccactacgagaatatcaagatggatgactcagccaaccccatcttcatcgacatgaagtactgccccaacaagttgtgtactgccaacggcgcctccaaggtcaccgtcaaggatgtcaccttcaagaacatcaccggcacctcctccaccccg

SEQ ID NO: 11745 - DNA, 296 bp, Zea mays
  Clone ID: LIB148-032-Q1-E1-G5
tcggcctgaggccacacacccacacggacgggaacccagatgagcctgtcgtttggatcggcgtccctgcctccgttctcgcgaggagaggaaggcctgcagaaaatggagccgatcaccagtgccacggcagtccatgagatgggcgtcgtcgccacgctcgccgccgctgctaacgccgtggtccccgccgcagcacctgtctaccactgacggaacatctgtactaccatcgagtcgcctacgtccacatgctggtggagcatgtcctcagctacctcagccaaccattggac

SEQ ID NO: 11746 - DNA, 392 bp, Zea mays
  Clone ID: LIB148-032-Q1-E1-G7
tcgtcctgaccccccagagcgagagggaggggcacccagaggagcctgtcgttttgatcggtgtctctgcccccgttcccgcgaggagagaacaacctggagaaaatggcgccgatctccggagccacggcagtccttgtgatggccgtcgtcgccacgctcgccgccgcggctaacgccctggcccccgccccagcacctgctaccagtgacggaacaagtgtagaccagggaatcgcctacgtcctcatgctggtggcgcttgtcctcacctacctcatccacccattggacgcctcctccgcctacaagcagctcttttaaaaccatccgctttgtaatttggcgccaattgagggtgtcattaacggtgttcgattagtaatccatcc

SEQ ID NO: 11747 - DNA, 375 bp, Zea mays
  Clone ID: LIB148-033-Q1-E1-C11-R2A
cccacgcgtccgaaccatagcatcaatgatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgac

SEQ ID NO: 11748 - DNA, 413 bp, Zea mays
  Clone ID: LIB148-033-Q1-E1-C7
cagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtgcttacgtacgcg

SEQ ID NO: 11749 - DNA, 436 bp, Zea mays
  Clone ID: LIB148-033-Q1-E1-D8-R2A
cccacgcgtccgcgaggttctctccgacaatgggtcctctcctccgcgccgccgcgctctccgtcgcgctcctcgccctcgccgccgtgggcgaggcgcacagcgccaccgaattcctcaacatcttcaaaccgcggaatgagcacgactacttccacaacgcgaaccaggaggaggatgtgatgccccgggccagcgaccagcagaacctcataacggcgccggtgaccaagagcggcctcatgaaggtgccgccccggtccgcgcccaccgcggtggcgcaggacacggtggtgctccccgtggacagcgccgcggggttccccggcgcttggtccatcatcagcgagaacgcgggcgggtccgcgatgcacctggtgatcatgcggagcgacaaggccatcatgttcgacacggtcaccacggggccgtcgct

SEQ ID NO: 11750 - DNA, 369 bp, Zea mays
  Clone ID: LIB148-033-Q1-E1-E12
tcgacttcgagaagctgcagcgcgtcacgctggacctcatcaccgaggcatccggatccatgtccgcaggcatcgccctgccaccctccaacgccggagcgccctcctacggggcggcggcgccgttcggaggtgccgcggacgcacccgccggcacctccgagggccctgccagcgccagcgggccatcagctggtgacgcgccggcgtatggcgccagcgccagcggcccgactgctgatgctccggcggcggcggcggcggcggcgtcgtccgggccctctagcgcacccgcgccatcgtcgtctgagtcctccggcgcaccagggccgtcgtcgtctgatgggtcctccggcgccccggcgcaat

SEQ ID NO: 11751 - DNA, 387 bp, Zea mays
  Clone ID: LIB148-033-Q1-E1-F6
tgccaccctcgtctcaccctccctccctcacacaaataataaggaaaggtcccgcccttttcctccgacatccacaggggggaggggaaaacacgtgcattcacccggcggcaataatggcctcggttccggctccggcgacgacgaccgccgccgtaatcctatgcctatgcatcgtcctctcctgtgccgcggctgacgaccccaacctccccgactacgtcatccatggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacga

SEQ ID NO: 11752 - DNA, 455 bp, Zea mays
  Clone ID: LIB148-033-Q1-E1-G9-R2A
ggggtgaccgtctggaggtgctggtggacaagacggcaaccatgcaggggaacacggtgcgcttcaagcgccaagctcgccgcttcaggaacaccatgtggtggaggaacgtcaagctcacagctgcagtgatattcatcctcaccgtaatcgtgtacgtcctgctcgcctacatgtgtcgcggcttcaccataccgtcatgctttccgtaatctccatccgtcccggtgccagtgcggaccaccagccctagctctagctgcctcacaacttggttttccgggttctgtaacagcagcagcggtgctgcagttctctctcttgtacgagggaaacaacagctcattcttaaagttctgcacaaccagatctgatttttttttaaaaaaaagatggtagtcaaatggggaagcttttccaccctgttttctaatcttaaacacacgaacctttgg

SEQ ID NO: 11753 - DNA, 316 bp, Zea mays
  unsure at all n locations
  Clone ID: LIB148-033-Q1-E1-H2-F2A17
aacattaacgccacacgtcttgttttttttttcttcttcctctttctgtgttctgtttttggcacaccacgacctgaccctcggatgatctagctagataataataataagcaaacagaacggaaggaacaatggctttgcaatcgcttcggngaccctgcaacgcaacggccgcggcgctcagggcttccagatgatggtggtctcggcgatcatggaggtgacgacgtaggggtccatgttggacgccgggcggcggtcctcgaagtagcccttgccgttctgctccgttttccggcccacgcgcaccgacgcg

SEQ ID NO: 11754 - DNA, 578 bp, Zea mays
  unsure at all n locations
  Clone ID: LIB148-033-Q1-E1-H2-R2A62
aacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacacncttctncagaaggacaccaactggnccccttggttggccaatcggttggtttccccggccttcagggtccttactactgtggaatcggcgccgaaaagtcgttcggccgcgacatcgtggacgcccactacaaggcctgcttgtatgcggg

SEQ ID NO: 11755 - DNA, 411 bp, Zea mays
  Clone ID: LIB148-034-Q1-E1-B2
gacggagacctcgatcgcgttccctgtaatgccaccaccaccgtcatcaccatcgctcgcccggatcgtcaacatggcagccgccctccgtgtcgtcatcgccgtcctcgccgtcgtctcggtctctctccggcgcgccacggcggccacggtccccaccgtcgacgaggcgtgcaagcagtacaccaagtacccggagctgtgcgtcaagtccctgtcgtccgcggcgccggaggcgaaggcgaaggcggagcggggcgggctggcggggctggccgggctggcgctggcgcaggcggcgcagtgcggcgccgagacggtggcgttcgtcaagggcctggagaaaatgccggggggcatgccgcccgtgtgcctgaacgagtgcgtggccaagttcagggcgcgctggtc

SEQ ID NO: 11756 - DNA, 534 bp, Zea mays
  unsure at all n locations
  Clone ID: LIB148-034-Q1-E1-B7-R2A
cagcctttgtttcctggtgaaagtggtgttgaccaactggtggaaataataaagattttgggtactccaacaagagaggagatcaggtgcatgaatccaaattattccgaattcaagttccctcagataaaagcccatccatggcacaagctttttggtaagcgcatgccacccgaggctgtcgatctcgtgtcaaggctgctccagtactcaccgaacctgcgctgcactgctgtcgacgcctgtgcccatccgttcttcgatgagctgcgggaccccaaggcttgcctgccgaacggacggccaatgccaccgttgttcgacttcacagcagccgaactcgaagggctccccgccgagcttgtccaccggatcgttcctgaacacatgaggaaggaagtgaattangtggacggacgtactggggcaaaaaaaaaaaaaactccctgtttctctgttggttctgagagatgtgtgagggcacggatatggaggagcggtggtgtattgtaattgtaaagagggctgaaagaa

SEQ ID NO: 11757 - DNA, 557 bp, Zea mays
  unsure at all n locations
  Clone ID: LIB148-034-Q1-E1-F1-R2A
gcgggacggggtcgtcccgcttgcagggcgtgaagcgccgtttcccgagaagacgggctcaaggacagcgtggtggtctccggcgaaggagcgggcgcgaagggacaagggggcgtggacaagctccggtgaggacggcgctgaatcgaccttcgacccttggctcggggaaacgcgagcacgcagcgactcggggaagcgctggggatcggaagcgcggaccggcacggggaatgtcgagcgaccggcgacgacggggaggccccagcgaccgggtgggctgtgggcggcggcgaatctacccgccgaggtcgcgataaacaatgttatgtgcaaggataatattcttactaagagctgatttggtgattaggtatcccaaggggatccatgggggaggaatcccttccaattcaattttgaaaagtaagaggatttcttcccctagggatccccgatcaccaaattagtcctaagagcatctctaacgatgcctcaaactagtgcctcaaattaaaatatagggctctacacaggaaaaactacntcaacagtgc

SEQ ID NO: 11758 - DNA, 311 bp, Zea mays
  Clone ID: LIB148-035-Q1-E1-A12
cggttcaaggctgaccccggcaccgccgccggcctcctccgcctcgtcttccacgactgcttcgcaaacggctgcgacgcgtccatcttgatcgacccggtgtcgaagcaggcctccgagaaggaggcgggccccaacatctccgtcaagggctacgacgtgatcgaggagatcaagacggagctggagagggagtgccccagcgtggtgtcgtgcgcggacatcatctcggtgagcgcccgcgactcggtgaagctgtcgggagggcccgaatacgcggtgctccttgggcggcgcgactcgctcgtgtc

SEQ ID NO: 11759 - DNA, 248 bp, Zea mays
  Clone ID: LIB148-035-Q1-E1-A3
aaacccgcggatcagatccggtctcctccgtatcgcattctccacagcagaggggccacatgagacagttaccgcgatgaaactgtctatcgaatcacgcgttatcaaactgtccctgccgtgtccgaatccgtgccgtggcagtatcgtctgggacgggacaaataagaagaaacgctcgctgtctcacggcgacacgacaatcgatcaccgtcatcatccatccacctcgatgatcatcgacgagc

SEQ ID NO: 11760 - DNA, 263 bp, Zea mays
  Clone ID: LIB148-035-Q1-E1-A9-R2A
ggcgggtggtcggcgtctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggcgccgccccgggggaaaccccc

SEQ ID NO: 11761 - DNA, 380 bp, Zea mays
  Clone ID: LIB148-035-Q1-E1-B10
aaacatgagctagctctccaccaacagtggcctccaggtcctccattgtactcgccacggtgatgttggctgcgctgttcgcggttggtttctgcaccacgccggacaccttcccactccgcatgggatccaagcctggtcatctgatactcaaccgcaacgttgccacgatgatccgatgtggagatcatagaacacggtggtgatcacttctcctttacactcaaggagggcccgactggaatctggaccctccagagcaacgacctactcaagtaccaccattgcatccgctttgcagtcaactctggcggctaccacaacgctcgacgacgtcatccccgccgatttcaaggctggcaccacctattggaccacac

SEQ ID NO: 11762 - DNA, 438 bp, Zea mays
  Clone ID: LIB148-035-Q1-E1-B4-R2A
agcgtgtagttctcggagagcattggcattttgcacctgaaactaagtcaattgacccgccctgatacatttgcttgccaaaatgtggcgacctatacacaaaacactgaaaactgggtacagttctcgcattctctgttttagttgagtttgcaggtagtagagacgacatgactcagtcaaccgcttgttctttgacaacgacggctgctgcagcaagtgggccattgttagcgtcaagcttcagggagacatccttgaacatcttgcggctgagggtgttgtaaaccgctctcgagtactgccgcgacgtgttcctccagtccattccagctttcatcatcagctcgaactcctcgtagcttatcttcccgtccttgtccttgtcgacatctaagattatgtcgtcgattgccttctggtcacctctcggagaga

SEQ ID NO: 11763 - DNA, 251 bp, Zea mays
  Clone ID: LIB148-035-Q1-E1-C1
ctcacgggtcgatgcaagcccctagagtgagtcgtactatgatacatcatacatgcatgcatgggatgcgatgacgatttgatgcatgcatgcatgggtatacctaccaatttgatgaccgacgatgtatagtttcgtcgactgcttcatacacatatatagcagcccaattaatgtaacgtcacgcaaataagcatttgcggtaattttttgtctcgttgattcgatgaataaagggcatgcttgagagt

SEQ ID NO: 11764 - DNA, 320 bp, Zea mays
  Clone ID: LIB148-035-Q1-E1-C8
acgacgggtcatgatggaaatggacaaggccaattcccggtcctacagcgacgtgcatagacacctgatctagaagtacgtcacacggggcggcaaacccatccgcatgcgcaagggccgcacagtcatcgagtatcacgacgactacacgctcaccatccgcgacaacttcaccaccttcacgggcaaggcaagccagcagatccatgaccggacgggcacgcacggcaagctgcacacttcatcacagtcagcgtgctactgaacctgatccctcactgccatctgagagatcaagtgcgcagacaggtccaagctca

SEQ ID NO: 11765 - DNA, 452 bp, Zea mays
  Clone ID: LIB148-035-Q1-E1-D6-R2A
cgcgcgcattacttgcacgtacgagctcagaaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcaccaccatcgagaactgccagaagagcaagatcttcttcttcttctggtcccctgacactgcacgcaccaagagcaagatgctgtacgccagctccaaagacaggttcaggagggagctggacggcatccagtgcgagatccaagccaccgaccccagcgagatgagcctcgaca

SEQ ID NO: 11766 - DNA, 363 bp, Zea mays
  Clone ID: LIB148-035-Q1-E1-D7
tagagagctcaaagaacagattgcttgcctcagggcagcattagctaggaaagatggaggtcaagagagcattcgaagcactcaatcaagcccagacatatatagaatgagaacgggcaatggattacctgcgttgaggcacccaatagtagatggaagtatagagaacgactcggcattgggagatttcgctgagcactcgccattcgggagcagcaattcgctgccagagttgggaccagatggcacacaagatctagccttctaccaaagaagcagccctgaacagcaatggagctggtccgggtctgttgcaacagaggattccgatgacttcgaggttgcaacgaattgctcgtcaga

SEQ ID NO: 11767 - DNA, 215 bp, Zea mays
  Clone ID: LIB148-035-Q1-E1-E3
tacaacactctaatctgagtcgtattaatggtcggtcccatgagagttggtgtattaatatattgttggtcgtttctgaggacggtctactggtggctttgcacggttgtttcttttttggcaaccaattttataggtcaattcttttatttgtataaaaaaaaaaaaaaaaaaaataaaaaaaaaaaaaaaaaaaaaaaaaaaaaaaaaaaaga

SEQ ID NO: 11768 - DNA, 263 bp, Zea mays
  Clone ID: LIB148-035-Q1-E1-E6-F2A
ttaaagaaactgctgtatttaagattctttgtccaagctacagtaaactttttctgccctaaaccttcaaacagttttttaatttatctgtgtgtggggtacctgtgacatgacaccaacaccaaagaaacatggagcaggcggatattttatccatttgacaggtaactctatggataccgtgtaagaacttgagcacagaagcgaggcgaccttatgcttgtctggcgggcgtgcctctcaatgccgttggtggacgatca

SEQ ID NO: 11769 - DNA, 313 bp, Zea mays
  Clone ID: LIB148-035-Q1-E1-F12
gacgttgcaataccctaaagtgagtcgtatgacagcacttcctcgtgctgctcatgaagctgtgtttcaacctcatacatagttccgttatgaaatgtatcagaggagattaagcaaaatatcccatgtggtgtcggtgtcgtccaggctgatgttgtccccttctcctgctgctcgtttcttttcacatgtttgtgatgtaaatgcccatactagaatgtcaccaaagtgttgattatgctcttatcatttgattaaaaagaaaagcaaggaagagaaaaaaaaaaaataaagtcaaaatcaacagctccag

SEQ ID NO: 11770 - DNA, 359 bp, Zea mays
  Clone ID: LIB148-035-Q1-E1-G1
tctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacggggaacgcacgtacacgatcgagctca

SEQ ID NO: 11771 - DNA, 373 bp, Zea mays
  Clone ID: LIB148-035-Q1-E1-G12
atgcgtccgattcaccggagatgactgttgtgagtatcatgtggtcgttagtgcacgtgcaggtgctggtggcggtggcattagcatttctggtaggcggtgcctggtgtggtcctcccaaggttcccccgggtaagaacatcacagccaaatatggtagtgattggctagatgccaaggcgacatggtatggcaagccgacaggtgctggccccgacgacaatggtggcggctgcgggtacaaggacgtgaataaggcccctttcaatagcatgggcgcgtgtggcaacgtccccatcttcaaggacggtctaggttgtggatcctgcttcgagatcaagtgtgacaagccagcggagtgctctggcaagcc

SEQ ID NO: 11772 - DNA, 411 bp, Zea mays
  unsure at all n locations
  Clone ID: LIB148-035-Q1-E1-H8
aaatcncaggggggacaggaaatcagcggccatggcctcgattccggcgacgaccttcgccgtcatcttaaccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaccgacgggaacggcacgtacacgatcgagctcaaggacagccacgaggaggacatctgccaggtggtcttggtggagagcccgcgcaaggactgcgaccangtgcangcggacagggaccgcgcccgcgtcctgctcaccaggaacgtcggcatcagcgacaacctgcg

SEQ ID NO: 11773 - DNA, 77 bp, Zea mays
  Clone ID: LIB148-036-Q1-E1-A7
aaaaaaaaaaaaaaaaaaaaaaaaaaaaaaaaaaaaaaaaaaaaaaaaaaaaaaaaaaaaaaaaaaaaaaaaaaaaa

SEQ ID NO: 11774 - DNA, 434 bp, Zea mays
  Clone ID: LIB148-036-Q1-E1-D5-F2A
gggctcaaaatgctattcgggggcagtactggggcgaaggtaacaaaaggttttatgtcccacatgaaaattttgttcaaagaaagggtgatcccgcccaatatgacaaataaaaaaaccgggcccataaagggaatcgcaatcccaacaaaccatttttacaaggcatgataactgccctcgttttccagatggggaatctattaaagttggggccttggttttataacagcccgatgctgatttgattaaattcaaaccagttcctgacctgggataagaaaacaatgcacaaaaaacaacttgtcggttgcctgacaagcaaggggatgcttacagcttcaccaccccaaattatagtttcccgttttcaatttggggaggggtatttaaatttgattgggaccccagagtttttatccatgcttttgggc

SEQ ID NO: 11775 - DNA, 272 bp, Zea mays
  Clone ID: LIB148-036-Q1-E1-F1
gtcgatacaagcctctaaaatgaatcgtactatatattgtatggttatcacatacattgacatggctgtgcgcattccgatgcatgggcatgttttttgattcgacacaccttttgtcctctttttctttgttccctcattctccttaatttaacgaattgatgcatgccgctgatgttcttcccctgagagagggattaacacttgtatcatttcatcgcttgccatttgtttgaatccattcaacaattcagtcaagaaaaaagtaaaca

SEQ ID NO: 11776 - DNA, 399 bp, Zea mays
  Clone ID: LIB148-036-Q1-E1-G8
tgacgtccgcccacgcgtccggcccggccaccaaaaccaatcagcgtcacaaagccggggggcgatagctcaagcgccgctagcgagttgcgcaccgggagccgtcggcggtataccgctctctgtgccggatcaacaaagccacaggtccgattatctcctttcgtgacttagccaacgttgcgccggatagatcagtactgctaatcgctaacaacacatcaactcaactaagcctgttgtacgcatcgcaagaaaattgacggatctcatcatagacagtgacagtaggatatgtgctgactgtggtgcacctgatcccaaatgggcatctggtaatattggagtgtttctttgcttaaaatgtggagatgttcatagggcaattggacctgacag

SEQ ID NO: 11777 - DNA, 360 bp, Zea mays
  Clone ID: LIB148-036-Q1-E1-H1
tcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctg

SEQ ID NO: 11778 - DNA, 413 bp, Zea mays
  Clone ID: LIB148-036-Q1-E1-H6-F2A
ggcacataacttggacaattctcattaatgtgcaaaaaccttgcctgaaggacaactgatgttcacgatcaagcatttcaaaaaatattattcaatccaacatcgggcctgtttggatcggcttctggccgtcagaatcggtttctggccaccaaacgcttcgcttctcagcccgtttcatgaaggcatgaagcagctcagccagtgatcatggtgcctgtgccctcgtctgtgagaatctcaagcagaagagagtgtggaacacgcccatcaatgatacttgcggtgtgtacaccttgtgcaagggcgtgaacacaacactccacctcgtgtttcatcccaccaactacctttccgtcagccaccatcttgcgcaccccagcaatgttcgccacctttaccaggcttcccag

SEQ ID NO: 11779 - DNA, 315 bp, Zea mays
  Clone ID: LIB148-036-Q1-E1-H7
tatctttcgttggtagaagcaaacatcaatgaattgttcacgcccactagaaaaaaggttttgcgtgtgatggaagcgatctggtgcttgcgtatgccagcaagctgcgattctgagtgtaacacataacgatgttctttcattcttcttttttgttcccttgttgcatcaaattgtgcctaaaccacgtcgatgtgctgccatattgtcaatccctgaaacggtcaatcatggatggaccgaatgcaatacaaatatattatactacacaataacgctacctttgctaaaatactggactcactcctaacaaat

SEQ ID NO: 11780 - DNA, 420 bp, Zea mays
  Clone ID: LIB148-037-Q1-E1-C5
cgcagctgagagagagaacagaagggaggagagagggcctcgccggcgaccttcgctccggccttgatgtgggtgcccagttcctcgctgggcagtgccgagcgtacaccgagaaggtcgcgctctcgccggtcaagtctggaggacgagctgctcagaatgcgtcgtcagcattgagagaagtcatgggctcctacacaaatgcaatccgccgtcgtctacgtctcgaccaacgcgtgaggttacgagccacctgaagaacaagttggtagctggaatctcaagtcccaggtcaagaacaggtaccgcaggatgaggcgcttggaggatgctgcgatgtgttcgtgagaggtctaggtcgtcgtctcccagtcaactttgggttgctggaccgttgtctccatataatgtaataattta

SEQ ID NO: 11781 - DNA, 80 bp, Zea mays
  Clone ID: LIB148-037-Q1-E1-C9
aacacgcatctgcggacgcgtgggcggacgcgtgggaatcatgcgaactgcagtaaaggaatcggacaacgcgcggagaa

SEQ ID NO: 11782 - DNA, 426 bp, Zea mays
  Clone ID: LIB148-037-Q1-E1-E8
cccacgcgtccgtatcagtcgggttctttccgaaccatagcttccgcattctttaacccacaccgccacgccacctcgacacgatggccgacgatgatgctgccgctgctgcccgtcgtgctttggagcagcgtgttgctgctttcactgctgaagaacgccgcgaggctgcccgccaagaagctgcgcgcctggaggctgcgcgcctcgaggccgagcgccgtgacgctgcgcgcctggagcaggagcgacgcgatgctgacgcccatgccttggtcgccgccggcgaagttgctgcggctactgctgctcttcatgctcaagcagcggcgatcctcaacgtcaagtctctcgttcccatcgtcctcgacttcacgtcgccgcacttcaaccgatggcgtggcctcttcctcaacactctcgagc

SEQ ID NO: 11783 - DNA, 403 bp, Zea mays
  Clone ID: LIB148-037-Q1-E1-G9
tccgcctcaaggctctcatctcggatgtctgataggcaacccaataatggcagaagtcctatcatgatctcatgaacactgtctaagctctgccttagatggacactacgacgagaacaggatatccaatgtggaatacacagatgacgacaagaaagccgtgatcgcggctctgaaaaagaaggctttgatcgcctcacagaagtttacgcattccatgaacacggggatgaagagcagcaacgtgatgtccatctcgattctggatgagcgtgaacctgaggaggtgcacgctgtggatgccttccgccagcttcttgtacttgaagagctgctaccatcgcagcatgatgactaccacatgatgctaagatttctcaaggcaagatagtttgatatcgag

SEQ ID NO: 11784 - DNA, 107 bp, Zea mays
  Clone ID: LIB148-037-Q1-E1-H4
aactggtcgcgctcacggtgcgcgccgcggcccagcaagtgcctacgtgtagccgcagctccctgtacacggactactacagccagtcatgggagcgcgccgacagg

SEQ ID NO: 11785 - DNA, 412 bp, Zea mays
  unsure at all n locations
  Clone ID: LIB148-037-Q1-E1-H5
acggacgcgtgggtgaaatctcgccctcgttgcggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctgggggggccaggagagagctacgacgccttcacggcctgcttccccgccaacgagtgccgctacgccgtgttcgattttgacttcgtcactgacgagaactgccanaagagcaagatcttctttatctcttgggccccggatacat

SEQ ID NO: 11786 - DNA, 389 bp, Zea mays
  Clone ID: LIB148-038-Q1-E1-B2
cactcgctgtctctctgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacgggtggaccatcgtctgccagctctcctgtgccagcgcatgctacggagaagtcgggatcacaaccttaggtacgtcgggtgtattagcgaaagcagaagcgcctgcatcaatcaccacaagcaggacaacaacgaggggccgccgccggcatgtccgcgctcagagggttcaggcggtcatcagcg

SEQ ID NO: 11787 - DNA, 410 bp, Zea mays
  Clone ID: LIB148-038-Q1-E1-D5
ttaacctcccttcctcctcctcctcctgcggtcccaactcccatacttcggttcaggaggcaggcaggcaggaaggcaggttcgaggggggattggctccgctcctgctccattgcgcgcgatccggctcgttcttgtgatctatctagccgtttcttgggtcagtgctggaaggtcaaactgttggtggaaacctcaccggggtgcttcaacgaacgcgaaggtgtcgctgtcatttagcgcgtcttgattggatttgacctgttggcctggtggcgtgttgtcgttgattgagctcgaggatgatgaaatgggggctcagcagcggcacgcccgcggattcctactacgaggtacggtcagattgcacggacggtgtgcccaagagcaagttcaagatcaaggctggc

SEQ ID NO: 11788 - DNA, 409 bp, Zea mays
  unsure at all n locations
  Clone ID: LIB148-038-Q1-E1-D8
tgcagaacggcgacaccgacgtcttcgacgcgccctacgcccgagtgtaccgcagcatcgccatgctgagcgccgggcaggacgggataccaatgcacagcctctggctctgcaagctcttcttcgcgctggcgctcgcgctcagcgtgttccgggaggtggccatgtggaagcgctggcgtgtggcacactacattccgagcatcatctgtgtggccatcgcctttgtggtgccggcgcgcatacccatcgacatgttcgtcgggagcttggtgctgtacctgtggaggcgtgccgaccctagcaaggcgccgacgttctcgatggcggtggcgtcagggatgatctgtggggacgggctanggatgctcttgtcatccacgatggcactcatgcatgcgcgggcgcc

SEQ ID NO: 11789 - DNA, 395 bp, Zea mays
  Clone ID: LIB148-038-Q1-E1-E1
aacgtccggatccttgcactccaaggggatttacacgcatagcaggatcagctaaacttcctgttggtgttcttgagccgaaggttgaatacagaccttttgctcattctgcggggaacttctctgagtgtagatctgcagcactaacactactgcaaaaaggaaatgagggatgtacatatcatgaatgccgccttggagcagcatttgtaccataattggaagggaaatttttggcgacagaaaacttttaccatacttcaaagttctttggtctgagttcgaagcccttcctttctgatctgatggtggctggggagaaattttgccatggggattggtcaaagattaaaaataagtacagttcctttgatgacggacaactgcttcttttt

SEQ ID NO: 11790 - DNA, 155 bp, Zea mays
  Clone ID: LIB148-038-Q1-E1-F8-F2A
gggaacaaagcatttttaacttgtaacaacaaatatgttaaaaagccaggaaactttgggtttacaaattcgggtttttagatggaaaaattttggttcacgagttaatcccaaccagcttagcaaccttcggtttaattacccggacccgtggg

SEQ ID NO: 11791 - DNA, 307 bp, Zea mays
  Clone ID: LIB148-038-Q1-E1-H7-F2A
aaaatgcattcaattactggattttttgcacaaaatgacttgatacacacacagggtgtttttgccgctaaaagggaatgtattgtttttgggctgacaccaaatttgttacataaaaatgggcatttcatcgaaatacaacccttaaaccctttggacagggcattctcaacattacagggggggttctgaaggcaacctcttgagttggggaaattcatatcctcgggggaaccaccaggggaactatttgagaaatgggttgttttggcggattcccccgctccatatctggcggaatgggttt

SEQ ID NO: 11792 - DNA, 410 bp, Zea mays
  Clone ID: LIB148-039-Q1-E1-A5-F2A
aacaagcaatccaatcttgggacaattttttctcaaacaaacccttttgagttcaattcagccaggacaactatagttttggatataataatagtacatagatagtacccaacatgggtaactaatttcgccgcacgcctagcacttgatctccttaagaccatgagagaaatagaggaatgtcggattagtggcaccatccttgtaataggcgaataccacagacgcatcatccttcatggactcaccaacaaaaaattggaggtccttcagcttgctaaggagaaacttggttgcaccctcgacaccctttttgaactcatccgctttctcttactggtgtgttggagccagagaaagcggatgagttcaaaaagaatcttactgctgggttgcacccttgacacccc

SEQ ID NO: 11793 - DNA, 367 bp, Zea mays
  Clone ID: LIB148-039-Q1-E1-B11
ccagcgccggatcaccaaccggtcggggctgagcgaggacacgtacctcccggaggtcgtgctcaacatcccgcacaacccgtcaatggccagcgcgcgggacgaggccgagatggtcatgttcggcgcgctggacgagctgttcgccaggaccggggtgcggcccaaggagatcggcgtgctggtggtgaactgcagcctcttcaactcgacaccgtcgctgtccgccatggtcgtcaaccactacaggctccggggcaacgtctcgagctacaaccgctgcggcatgggctgcagcgcggggatcatcgccgtggatctcaccagggacctgcgtcagtgccagcggggcaactacaccgtggtg

SEQ ID NO: 11794 - DNA, 348 bp, Zea mays
  Clone ID: LIB148-039-Q1-E1-B12
agtcatctcctccatcaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcac

SEQ ID NO: 11795 - DNA, 215 bp, Zea mays
  Clone ID: LIB148-039-Q1-E1-F11
cgaaaagcagtctcccaattccaccgaataactaataacatctcctcgagcgcgaggccggcttccttggaccaatccagcagcaagcgacccggccagcaccagcagccatggagatgaagaaggtcctctgcgccgcgctcgtcgccgccgcctccgccaccgccgtgctggccgaggtcgcctccgagtcgccctccgaggcgcccgccggc

SEQ ID NO: 11796 - DNA, 358 bp, Zea mays
  Clone ID: LIB148-040-Q1-E1-B3
agccatgacgatgacaatagccgccgtgctctgcctgctcctcttctctggccgtctcgccgcggcggagaagactttccgcggaggcggaggcggaggctacggcgggttggaggccggtggcggaagcggcggcggcggctactccaccccgagcgaggcagcgccatccacgcctgccgctggggagacgacgaccccttcgtcaggcggcggttactccacccctagcgaggcagcgccatccacgcctgccgctgaggagaccacgacgactccttcgtcaagcggcgggggttaccgcggtgcaaccggcaaagcttcctcaagcggcggcgggcttggacccgacggggac

SEQ ID NO: 11797 - DNA, 195 bp, Zea mays
  Clone ID: LIB148-040-Q1-E1-B6
gatacaagcatctacagtgagtacgtcattactaccagttctattggtgttggtgcgtaccttctctataaataatatctaactccaacaagatatgtttgatgatggatcgcgatctatcatatgtatgccattcattcgttaatttgaaaagatgatgctgaaaaagagaagctacactagaagaagaaaacg

SEQ ID NO: 11798 - DNA, 373 bp, Zea mays
  unsure at all n locations
  Clone ID: LIB148-040-Q1-E1-F8
atcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctccaacctgcagctgcaggangaggaagcagcagctaccgcggggcgtgttac

SEQ ID NO: 11799 - DNA, 181 bp, Zea mays
  Clone ID: LIB148-040-Q1-E1-G12
acgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccgg

SEQ ID NO: 11800 - DNA, 365 bp, Zea mays
  Clone ID: LIB148-040-Q1-E1-H4
gaggggctgtcggacgtgacccgcaagtggctgcagtaccagaaggagtgcgtcaaccaggtgctcaaggcggccatggccattaacgcgcaggtgctcgtggagatggagatcccggagatctacattgagtcgctgccaaagaaagggaagacgagcctgggcgacgccatctaccggagcatcaccgaggaaacgttcgacccgctggagttcttggccgggatggacctttcgacggagcacaaggtgctggacctcaagaaccgcatcgaggcctccaccgtgatctggaagcgcaagatgcagaccaaggactccaagtcctcgtggagctccatcgtcagcttcgagaagcgcgagca

SEQ ID NO: 11801 - DNA, 233 bp, Zea mays
  unsure at all n locations
  Clone ID: LIB148-040-Q1-E1-H7
tggtgcncgcgtgcggcgaggacgtcgcggcggtggtgggacacgccaggctcgccgggtgggagggtctgatgctgtgcctggactagtcgggcaccagcgggcgcatgaaagcggtggccaggccacgtggcgccatggcggtgggcatgtccagccgggacgcgtgggcggcggcgtacagcggggtcgccgccggggctgccctcgtcagtgggatcggcgtcatggcg

SEQ ID NO: 11802 - DNA, 396 bp, Zea mays
  Clone ID: LIB148-041-Q1-E1-B2-F2A
gaccattaattacgggcggcattccaaacacaagagttatatacaacacaaccttgcattgttacgatcgatcgccaatgatgaaagctgcagcctagagctgcacacgcactagcacttcctgccgacgcggcagttgagcgcgccggcgtacctggtgagcgactcggcgtactggccgcccttggcctggatgaggtcgagcctgtcgtacttgcgctcgttctggccgccggactggttgaagaaggcgccgttgaggaacaggtcgtcctgcgactttcacacccagttcttgttctcgctgtactgcgtggactcccgcttggtcacctccttgaacctgttgtcgtcgccggcgcggaagcgggtgccctggctgatgatggtggggtt

SEQ ID NO: 11803 - DNA, 400 bp, Zea mays
  Clone ID: LIB148-041-Q1-E1-E1
tacagccgcgggctggtgcagcggatgccgcgctgccgctacggcttcttccacgtggtgaacaacgactacacgcactggatcatgtacgccatcggcggcaacatgaaccccaccatcatcagccagggcaaccgcttcatcgcccccgacgacgccaacgccaaggaggtgaccaagcgggagtacacgccgtacaaggactacaaggagtgggtgtggaagtcgcagggcgacgtcatgatgaacggcgccttcttcaacgagtccggcggccagaacgagcgcaagtacgacaggttcgacttcatcccggacaagcacggccgctacgtcggtcagctcacgcgcgtcgccggagcactcaagtgcatcgtcggctaccgtgctagtagacagc

SEQ ID NO: 11804 - DNA, 119 bp, Zea mays
  Clone ID: LIB148-041-Q1-E1-F11
caggaatgcatttaatccgttgctcatgaaatgagggagatggccattgaaaaaaaaaaaaaaaaaaaaaaaaaaaaaaaaaaaaaaaaaaaaaaaaaaaaaaaaaaaaaaaaagaaaa

SEQ ID NO: 11805 - DNA, 293 bp, Zea mays
  Clone ID: LIB148-042-Q1-E1-B6
atcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggacgacaagccgaagccgacgccggaggccgccaccgcggcgaactacgcgtcgttgtggtcggccaagcgcctcatgcagctcgctgcccgcgctttccgccgcatcaggt

SEQ ID NO: 11806 - DNA, 197 bp, Zea mays
  Clone ID: LIB148-042-Q1-E1-C12
tcagcctccagctgcctccaccccacctccgtcactggtgaagttgtctcctccgcaggcaccagtggcatcaccaccgccacctgtgaagactacttctccaccggcccctattgcttcaccatctccaccaccaccagcgccagtggtctcaccaccaccgcccgtgaaatcacctcccccacccgcgccagtgg

SEQ ID NO: 11807 - DNA, 191 bp, Zea mays
  Clone ID: LIB148-042-Q1-E1-D3
tcgatcttccaggagtacatcttctttgtggagtcttgcggttcgaaacaggagctagctcgctctcgcggccgccgctgatgaggtgcaaccagggatctgtcttcctccaactgttgtagaagggggccggtgacctccagggtgaagatgatcggggtcacctggggcccgtggccacggcattagca

SEQ ID NO: 11808 - DNA, 393 bp, Zea mays
  unsure at all n locations
  Clone ID: LIB148-042-Q1-E1-D8
nggngggggggggggtgggggggggggggggggggcggggggggcgaggcggcggggggggggggggggggtggggggtggggggggggcgggggggggagggggggggggggggggggggggggggaggggcggggggggcgggggtggggggggggccggggggggcgggtggggggggcggggggtgcgggggggggggggggggggagtgcgggggggggggggggggtggggcgggtgggggggggcgggggggggaggggcggggggggggggggggggaggggggggaggggcgggggtggtgggggggggggtgcggggggggagggggggggggggggcggtggggggggggtggggcgggtggggagtggtggggggaggggg

SEQ ID NO: 11809 - DNA, 378 bp, Zea mays
  Clone ID: LIB148-042-Q1-E1-E4
aaataaactccgccgggcatgggcgaagctaagctcaacaacgtgaccgtcctgctggtggccctcctcctcctgagcagtggcgttcaggacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggggtttatattacataaagagagaaaaga

SEQ ID NO: 11810 - DNA, 397 bp, Zea mays
  Clone ID: LIB148-042-Q1-E1-F6
ttacagcaatggcggccaaggtgttcctcctcctccgactcagcatggtcgccgtcgtcctggctgccatcgccacagtagtgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgcatggcgttcccgttcgac

SEQ ID NO: 11811 - DNA, 275 bp, Zea mays
  Clone ID: LIB148-043-Q1-E1-C8
aagctatattatgttcgacggtgtaacaccctgaatttgagggtataaaatttattctccaaataccaaccaaattcaggggttacctcttgtctctctctctctcttttccttttgattaaaagtaagtgaattaggcgagggtttaattatttattttgtcaaaacttatgtgagtcatgaaatgttgcatcatgctgagcctaaattattcttttgtttgatgcacatgtttgaattggtttgaatttgaaatttggtttgagtttgatttg

SEQ ID NO: 11812 - DNA, 393 bp, Zea mays
  Clone ID: LIB148-043-Q1-E1-D11
gggtcgagcacgcgtccgaacatctgcgtcaagtccggcgcctccaaggtggccgtcaacgacgtcgtcttcaagaacatccacggcacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgcatccatcactcactcttcgtcacctctctctttctcactctcgccagtctttttttaggcctctggcaatctgcgaactttcttattcattctactagtgtggatctataattccattc

SEQ ID NO: 11813 - DNA, 609 bp, Zea mays
  Clone ID: LIB148-043-Q1-E1-F4-R2A
gactaaaattccaagtttatgcttgggctaagtttatattgggtattttatacccatgggttaacatgtatgggtgaaagtggaacgttctaatacccgtttacccattgggtcaagatttttgaccaataaccgacccacggataaaatatttagcccacatacatactttaatggagtaaatattcatcaggtcgcgggtacccattgccatctctactgacgcatggtcaggccgcatggtggcacagaccgggtgcgacaacgacacggaccacggagatgactcgctcactcgcccctgctgccggtccgttgcgcgagaggcgacgcaccggcgatgacggtggcacaggtgagcgtggcgccgtgggtgggccgggcggggccgcggcatacagcgtgagcctctggtggacggcttcaacgtggcggtcgtggtgacaggctgccgccggagggcgggcggcggtgccccacgctgggatgcgccgtggacctcgctgccgactgccccgcgcgcccgagcgccatgaggaggatgcggcgctgttcaaggccgagtgcccagacacgaggaccaacgccacggacgtcgaggtgacgccg

SEQ ID NO: 11814 - DNA, 447 bp, Zea mays
  Clone ID: LIB148-043-Q1-E1-F4-SP6A
gactaaaattccaagtttatgcttgggctaagtttatattgggtattttatacccatgggttaacatgtatgggtgaaagtggaacgttctaatacccgtttacccattgggtcaagatttttgaccaataaccgacccacggataaaatatttagcccacatacatactttaatggagtaaatattcatcaggtcgcgggtacccattgccatctctactgacgcatggtcaggccgcatggtggcacagaccgggtgcgacaacgacacggaccacggagatgactcgctcactcgcccctgctgccggtccgttgcgcgagaggcgacgcaccggcgatgacggtggcacaggtgagcgtggcgccgtgggtgggccgggcggggcgcgcgatacagcgtgagctctggtggacggcttcaacgtggcggtcgtggtgacaggc

SEQ ID NO: 11815 - DNA, 227 bp, Zea mays
  Clone ID: LIB148-043-Q1-E1-F4-T7A
cctttctttttttttttacgtgtttacaaatgctactaggcattgttattgtggctagcataaatacatgactactacactatacactctccataaatctagtacatgggtgacaatcgaatcatgtagataaaaaaataacgccgactaggatagctaaatactcaagttgacggtcataaactggatcttaaactacacgaaacacttagtgacctatactcact

SEQ ID NO: 11816 - DNA, 538 bp, Zea mays
  Clone ID: LIB148-043-Q1-E1-F4F2A
tcggggcgctgctcacgtcgcgacgaggatctcctcgagggagacggagagctcgaggtggtggcgcacggaggccgggctaggcgtgggcgtgggcgtggtctcggcgcggcacatcgggcagctggtgctcccgcgcagccacgtgtcgatgcagtcggcgtggaagtagtgcatgcactcggggagcacccgcacgacctcgccgtcgtcgaagtcggccaggcacaccgggcacgtcgactcgttccaggcctcctccttgcggtaccggcacaccaccgccgcgcccaccaggacgacgcatgcatggcgcggcgcgctagaggtggcccgcgacgatggtggcgggcttggggcacaagacaaccttgatctcaacgggcttgacgcggtcctgcggcgtcacctcgacgtccgtggcgttggtcctcgtgtctgggcactcggccttgaacagcgccgcatcctcctcatggcgctcgggcgcgcggggcagtcggcagcgaggtccacggcgcatcccatcgtggggcac

SEQ ID NO: 11817 - DNA, 419 bp, Zea mays
  Clone ID: LIB148-043-Q1-E1-G12
gccgaggagaagatggcccacgacgccgccgagctcgcggccctcgaggaggctctctcgaagcgtgaggccgggatgcgggcgctccagggccagacgccccgtcacgcctgcgccgtgccgtcggggggctccaccccacgacgcccctccgtggccacgccgcgccacccaccctcctcgctgtcccccgcggcgtcgtccggaggagggtactacccgcctctgcggtgcagcatcgaccacccgcccaccgcgtccgaagcagacgcgctcgagacaccgcgcgaccagctcaaccacctcgcccaccgcgtccacctcctcgagcgcggcgcgaccccgatggccgccaccaacaccacgcccatcatccgtgtcgcgccggggtctgccttcccgcaccatgcacgtgccta

SEQ ID NO: 11818 - DNA, 422 bp, Zea mays
  unsure at all n locations
  Clone ID: LIB148-044-Q1-E1-B7
tcctgcccttgtacaacgcacgcacggtccccgtcccaatggcccagactctgtccgccgcctcggagctggccaccctgaagcgcccgttcggcaacgacgggttcggcgatggcagcaacaacggcagcgcgaccggcgagaagcccaaggcgcggcggcgggaggcggacccggcggcggcgatggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggagacatgtacatctacagccggcacttcaacccgacggtgctggcgctggggcggcagatggcggcgctggagggcacggaggcnggctactgcacggcgtcc

SEQ ID NO: 11819 - DNA, 410 bp, Zea mays
  Clone ID: LIB148-044-Q1-E1-D10
aatggctagcggcgtcctccatcgctccgcctccctatgtctccgcccggccgccggctcctccgccgactccggccggggccacggcgcggttatgatcggtgattcgaggacgcgcgttgctgctctgcggctgggaggatctagccggagagagttattatctgtcacaatggcctccagagatcacactggcttgacccgacaacttcttgattttcaacatgatacaatagatgaggtaggcgcaggacatgacccattcattgatttgaaagcgagattcatggactttaaacagagaaactatgtggaaaaattttcaaattaccaaacccttgctgagcagcaaacaccaaagttcatggtggttgcttgtgctgactccagggtctgccctaccgctgttt

SEQ ID NO: 11820 - DNA, 402 bp, Zea mays
  Clone ID: LIB148-044-Q1-E1-F9
tccctgcacgcctgacctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccg

SEQ ID NO: 11821 - DNA, 399 bp, Zea mays
  Clone ID: LIB148-044-Q1-E1-G11
tctccctccacgagccgaccaaatcgaatcgattcgcgcgcagcgcgcccgcgcagcgattgccggcgatggcgagcctcaccctgccgccggcgatggcgaacccacggcaggacgccatcgacctccaaaaggccttcaaagggtttggctgtgacagtacaacagtgataaacatacttactcatcgcgattcagtgcagcgtggactcattcaacaggaatacagggctatgtatcatgaggaactctcccatcgcatttcatctgaactcaatggaaaccacaagaaagctatgttgctgtggattcttgatcctgctggacgtgatgcaactgttttgagagaagctctaagtggtgacactatggatctgagagcacccaactgatatatat

SEQ ID NO: 11822 - DNA, 435 bp, Zea mays
  unsure at all n locations
  Clone ID: LIB148-044-Q1-E1-G2
caaaacaagaacctccaattagaagcaaccaaaggaacttattaaactcctaacggcggcaatccaaaaaacaaggcaaaccgacccggtcccaaaggaaatccttcgccgacgtacaacggcaaccgaaggaccaaaatggagatgaaaaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctcnctcctcgcctactacctccactaagcgtgtgcgtgcttacgtacgcgcgcatggacgacgatg

SEQ ID NO: 11823 - DNA, 300 bp, Zea mays
  unsure at all n locations
  Clone ID: LIB148-045-Q1-E1-D1
cggatctatgatgtgcccttgcttgattcgttattgggtctctagccaagaagatgaagaacaacaacaacaacaaaaatatatatatggtgctgcgtatgcccattgtaacagttgatgagatctgtgactccccgtgccgtgtcccgtgagttgctgatgatttcatcccccgcccccaccgggnccaacacacacacactttttttaatctttccccttaatatggggtcccaaattgatgcggagatctcgagcgactctgcaaatttcagatgagtggacatatgtcgaaggaaa

SEQ ID NO: 11824 - DNA, 66 bp, Zea mays
  Clone ID: LIB148-045-Q1-E1-E5
aaaaaaaatcaaaaaaaaaaaaaaaaaaaaaaaaaaaaaaaaaaaaaaaaaaaaaaaaaaaaaaaa

SEQ ID NO: 11825 - DNA, 215 bp, Zea mays
  Clone ID: LIB148-045-Q1-E1-G6
acacacgcgtctacccacacgttctgccaacgcgtccgggcaaggactggctgccggcgtactactactgatccgacgatcgactgctggatcgatcaagcatgcatgcatgcatgtatacacatcttgtaacgctgaattttgattcatggcacactgtactggacgaggatcattttttcttgcctaagtaaaaggaaaacaaaaatagaaaa

SEQ ID NO: 11826 - DNA, 349 bp, Zea mays
  Clone ID: LIB148-047-Q1-E1-B2
aatggctggttcgtggatggctgcgccacgacctctcctgctgtcgctgctggtcgccgtgctagcggtggccgccgatgtcgccaacgccggccacgccaagcccctgacgcctggcgggcgtgtggtacacgacaaccacggcaagttcacggccgggccgtggaaacccgcccacgcgaccttctacggcgggcgggacgggtccggcaccacggcgggcgcgtgcgggtacaaggacacgcgcacgcacgggtacggcgtgcagacggtggccgtgagcacggtgctgttcggtgacggcacggcctgcggcgggtgctacgaggtgccgtgcgtggacagccct

SEQ ID NO: 11827 - DNA, 406 bp, Zea mays
  Clone ID: LIB148-047-Q1-E1-E8
acggacgcgtgggtccggacgagccttccgcgcgacgctgcacggctccgccagccacccgtaaaaccctagacggctagccggcgcacggaagcgggcagcggagcggaggtgagcctctcctgcgtcggattgtccccgcccccgcccccgctaggcgccatgaagctgacggtgaagaccctcaagggaacgcacttcgagatccgggtgcagcccaacgacacgattatggctgtgaagaagaatattgaagagatacaagggaaagacagctatccatggggccaacaactgctgattttcaatggaaaggtcttgaaagatgaaagtacattggaagagaataaagtcaatgaggatgggtttctagttgtcatgcttagtaagggtaaaacatccgggt

SEQ ID NO: 11828 - DNA, 91 bp, Zea mays
  Clone ID: LIB148-047-Q1-E1-F7
taaaatcaatcataataacataaaaataataaaaaacaaacacaaaaaaaataaaaaaaaaaaaaaaatcagtcagaagaaaacaatacta

SEQ ID NO: 11829 - DNA, 383 bp, Zea mays
  Clone ID: LIB148-048-Q1-E1-A2
cgcgtccggccggttcccagcccaaacccctgtcatctccactggcagagctcagccaattgcagtaccgggcattcatctggaagagctgaaggaaattacaggcgaacttcagcagtgatgccctcattggcgatggctcgtatgccagagtctattttggtgtgctgaaagatgggacgaaatctgcagtgaagaagcttgactccagcaaacagcctgatcaagaattccttgtgcatgtttcagctgtctcaagattgaagcatgagaatgttgtccaactcgtcggatactgcgccgaaaggagcacccgcgtccttgcttatgagtatgcagctaggggatcattgcatgatatcctccatggtaaagacggtgtc

SEQ ID NO: 11830 - DNA, 312 bp, Zea mays
  Clone ID: LIB148-048-Q1-E1-B3
ctgacagcgaacaatgatgccacaactgcgtagcctcgtcgcgctggtcatcgtggccacggccataaccgccgcgggcggcgtcgcgttaggcttcacccttagcatcgcctgcaagcaactgtcacacccggttagagagacacctatctcaagctaacgggcgctcgattgtgaacatcgagtgcgggaaattccagtcgtaacagtccataatcacgttgaagcaaataccggtttcggcagctggtataagatcgaaatggcccgcaaccatcaccattacatccgcgacctcagcctgaacaggaa

SEQ ID NO: 11831 - DNA, 360 bp, Zea mays
  Clone ID: LIB148-048-Q1-E1-B5
ctcaggcaacatcgacttcaacttcggcaactcggcggaggtgttccagatgtggctcatcatcagcctgcagaccatggacaagcacaacatatcagcaagggatcatcggcataacgataccaacatgagctgtggtgtcgtcatctataactgacgactaattccgtagataacctatgttcggactgtgtcaaaattaacacgtaaatgcacagtctcagaaacgagttctgcacgcttaatctcatggtgaactacaacccaaaatgcggttggcaaaatcggtgtcagtcctgtcacttgtcactggaggtccccggttcaattcagatgttgctttggcacgtgctattcttt

SEQ ID NO: 11832 - DNA, 364 bp, Zea mays
  Clone ID: LIB148-048-Q1-E1-D6
tttgatcccgacggaggtttgcacactagaagcgtcctttttctcgattttgatgagaagcatgttggcaggaaaaaaacatcggcccttgccttgtttgtgcatgcgatcgagatccatgcatgcatatgagagagacttgcatgatggacgatcttacaggagaccgagtatggagcccttgatgatgccgttgacgcttgagatggtggcgactcagcattcttgcactcgccagttcttgcgtccggacggcagtaccggggatacacgcctatttctactctcaatggagcatctacttctctctgtattgttattgttttgcgagcagaattgctgatatcgtgttgtaacacagtgg

SEQ ID NO: 11833 - DNA, 351 bp, Zea mays
  Clone ID: LIB148-048-Q1-E1-D7
cacagataataaggaaaggtcccgcccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcatgtactgcgacacctgccgcgccgggttcgtgaccaacgtcaccgagtacatctccggcgcaacagtcaggctggagtgcacgcacttcggcaccggcaacctcgagcgcgccatcgacagggtcaccgaatcgatcagcacct

SEQ ID NO: 11834 - DNA, 399 bp, Zea mays
  Clone ID: LIB148-048-Q1-E1-F12
atatacagttcgtgaatccctgaagcgtgcatatatatattcctgccaagataaaggtaatggaatcgtcacgcaggttccagccggccgtcatcctgcttctcctgctcattgtgtccaccgatatggcatatgcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcactgctaaacaagatcgctcgatcgcttgccatgcatcgacaacctattcttaataacgttcattatctcgttcttatttatgacgaatgtcatgtatgttctggtgactgtcatgtatattctga

SEQ ID NO: 11835 - DNA, 616 bp, Zea mays
  unsure at all n locations
  Clone ID: LIB148-048-Q1-E1-F3-R2A
aaggacaacattgttaggaacaatatatagcagttctgcttacacagttacagtttttccgcgaggctaacacaactccatgccaaaatcgccattgtcatgagcctcatcagacgtaacgaaggcatctggtacacttacagccagctggacgacaaaccgagttcacggagagatagatgaaaggagggaataacgaagtcgtagagaaaaagaaaagaaaaatggcaaacgcagacttgagtgtgagaatgtgtgagtgtgtgtgtgtgtgtgtgatatatattggtggcggtcccttcctcctagttgtcctctccttccccgtcttgcggtggcgccggttccggcggttgctcgtcggctgccatgtccggcagcgtatcctgggacgggctcttcttcatcatgtggctgtagctccccttctccatgaacagctgcgcgaagtggatcttgcagtacagaacgccgttgagcgcggcgtaggaggaggtggtgaggatgcancccccgtgcgagcacttgaagcagctcttgtggtaggactcgccttccagagttaacttctccagcgggtacactgttttctggcaagctgcacacttatcctgag

SEQ ID NO: 11836 - DNA, 605 bp, Zea mays
  unsure at all n locations
  Clone ID: LIB148-048-Q1-E1-F3-T7A
cccacgcgtncgggcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtaacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacggnggctgcatcctcaccacctnctcctacgccgcgctcaacggcgttctgtactgcaagatccacttcgcgcagctggtcatggagaaggggagctacagccacatgatgaagaagagcccgtcccaagataccgctgccgg

SEQ ID NO: 11837 - DNA, 575 bp, Zea mays
  unsure at all n locations
  Clone ID: LIB148-048-Q1-E1-F3.F2A
gcgcccacgcgtccgggcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtggcgacgataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcattctcaccacctnctnctacgccgngctcaacggcgttctgtactgcaagatccacttcgcgcagctgttcatggagaaggggagctacagccacatgatg

SEQ ID NO: 11838 - DNA, 370 bp, Zea mays
  Clone ID: LIB148-048-Q1-E1-H11
agggaccaacatgaacaaggcgttcacgctcgagaagcccatggacctgaagaagggcgtgaaccacgtcgccgtcttggcatcgtcgatgggaatgacggacagtggcgcttacatggagcaccgtctggccggcgtggacagggtgcagatcacgggcctgaacgcgggcacgctggacctgacgaataacggctggggccacatcgtcggcctcgtcggcgagaagaagcagatctacaccgacaagggcatgggcagcgtcacctggaagccggccgtgaacgacaggccgctcacctggtacaagaggcacttcgacatgccgtctggagaggacccggtcgtgctggacatgagcacgatgggc

SEQ ID NO: 11839 - DNA, 300 bp, Zea mays
  Clone ID: LIB148-048-Q1-E1-H9
ctgcgtccgcactgcgcgaggtcgtcctcctccttcgccgccgccgccgccgccatcgtgatctacctgacggggccgggcctggccgtgttgccgatgcgggtgatggagtccgactccatcgcctctgtgaagctccgcgtggagacgtctcggggcgtgaaggcgcgcaagcagaagctcgtcttcggcgggcgcgagctggatcgcgaggaacggcgcatcctgtactacggtatggcggacggcaaggttgtgcacctggacatccgcgctccggacgtgcgtctcatcatcgtg

SEQ ID NO: 11840 - DNA, 447 bp, Zea mays
  Clone ID: LIB148-049-Q1-E1-D8-R2A
gcgcagcgcgcagcgcagcccacctatcaataaccgacgagcgaggcgcgagaaccgacttgccaccggctgctcgccgtctctctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcggcgcccccatcctcgtgatgatcccgatgatcatttaccggaagc

SEQ ID NO: 11841 - DNA, 470 bp, Zea mays
  Clone ID: LIB148-049-Q1-E1-F9
tttacgtgaaaccagatagatttgtgtgatcatattctttcatatgtttgtaaacattacattgccatccatattctaggatggtattttttgtagcttcagtgtcattcttttgttaatatgatcgattgtttttgtgtatgttacccccttcctcgactatatgctcccccgtgctgaattgcaacacacacacgcacccacacccacactggccgcaacgattaaaaaagcatcctgcgaagcctagtcagcagttaccgcctcttgggaagctgaaatgtgcgcttcaggaagtggctggcgacctcgtcgtcgcgatggcacagcacgcgcaggatggtgtttggctcactgcggctccaccgcctggtcgtcggcggcaacggtaggcgctgcctctcggagaccgcctcggtgcactcgtacgccgcgatgccaaactcctccacgagctgctccgccgttag

SEQ ID NO: 11842 - DNA, 452 bp, Zea mays
  Clone ID: LIB148-049-Q1-E1-G3
cgccatatctagcaccacacaccgcaggtatggagaaggcgacgaggctggccttggcagcggcgttggttctgtgcctgcttctggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatgggcctgtttggttcagcttttttctgaccagcttttctgaaaatctggttgtgggaagaatctagctgtggggagaatctgagtatcattacgattacgtgtgaggaagataaagttgttcatagggctcaggatctagaaagtaacggattcctactattacaatgattcaacagattat

SEQ ID NO: 11843 - DNA, 453 bp, Zea mays
  Clone ID: LIB148-049-Q1-E1-H3
tgataatccagagaaggaactaaagccagggatcgatcttcttgggaaggtggacgagttatttatcgacatatatgacagatatgaacctaccaatgactcatcagcagacaattgtttcatctcaacaagttatgatgccacaacacactttgagtccactgttatggatgtactttccctttacacaaagatcaccggaaagactgttgatctcagcgtggatctaagcgctgctagtgctgctgaagatgatatgtgatacttatcgtagtgctatgtggcgtagtgtggaaaatatttaattaagctttgctttggcaacgattattaggttcacctttatttttccaattgttgttattagctgtgttgtgaccatgattaaagattgcatgctgtaaatttgaaggcatttttttatcaaaagttgttacgcggtgattcgtgttt

SEQ ID NO: 11844 - DNA, 463 bp, Zea mays
  Clone ID: LIB148-049-Q1-E1-H8
tgtaaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagattaagtgcgataagcctgtggagtgctccggcaagcccgtggtggtgcacatcacggacatgaactatgagcctatcgcggcgtaccacttcgatttagcaggcacagcgttctgcgccatggtcaacaagggcgacgaggagaagctg

SEQ ID NO: 11845 - DNA, 361 bp, Zea mays
  Clone ID: LIB148-050-Q1-E1-B2
ggggccacgcacgcgtccggagacactgtgggccgtctccatgggcggcggcgtgctccccggcaggtcggacatggacggccccgacggcgagatggcgtacatgcgcgggagcttcgagcacaccgtcgggtcccgggactcggagtcgctctacatggtcggaccgcccggcggcgactgcccggagctcgccatcttcttcgttaggctatgaattgaaccgagcgaaccatacgaatcgaacaatacagtgtacacgtcgcagtcgtggggtctaatctctcgcctggtctcgttcgttgttcagcagcctcagctatcgtcagagatattactcatttgccccaaaaggaaaggg

SEQ ID NO: 11846 - DNA, 415 bp, Zea mays
  Clone ID: LIB148-050-Q1-E1-G11-F2A
aagaaaaagatcgatcgatgctcgccggcggaccgacgagatgagggggcatgggcatggccggccatacttaggtagtacgtgtgtatgtagcttaattattattaataataacttaataactgcggtgtcagctgacgggagctagcctaggcgacgctgcggtggttgaagccgaagcaggagcacccctgcgcgacgtcgtcgacgggcgtcatgccgcccttgccgctgctggtgtcgatcttctccagcagcgccaccacctccgacatctccggccggttgtccgggttgccgtcccaacaccgcgtcatgatctccaccagcgcccgcgggcagcacctcgggatgtccggccggatgcccagcttgacgacgtggtaggagatgtcggcgaggctgtagttggggt

SEQ ID NO: 11847 - DNA, 427 bp, Zea mays
  Clone ID: LIB148-050-Q1-E1-G11-R2A
ctgcactcgaagaaggtgatgcaccgcgacgtgaaggcggagaacatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatctcctaccacgtcgtcaagctgggcatccggccggacatcccgaggtgctgcccgcgggcgctggtggagatcatgacgcggtgttgggacggcaacccggacaaccggccggagatgtcggaggtggtggcgctgctggagaagatcgaca

SEQ ID NO: 11848 - DNA, 394 bp, Zea mays
  Clone ID: LIB148-050-Q1-E1-H12
aggcagtacaacttcaacgggtacatggagctcatggagatggccaaggaagaccgggctcaaggtccaggccgtcatgtccttcaaccagttgcggcggcaacttcggcgattcagtcaccataccacttccgggatgggtcttggaggagatggacaaggaccaggacctggcctacaccgaccggagtggccgccggaactacgagtacgtctccctgggctgcaacgcgatgcccgtgctcaagggccgcacccccatccattgctacgccgacttcatgcgcgccttcggcgacaacttcgccaccttcatgggcaacaccatcgtggagatccaggtcggcatgggccctgccggcgagctgcgctacccgtcctacccggagagcga

SEQ ID NO: 11849 - DNA, 329 bp, Zea mays
  Clone ID: LIB148-051-Q1-E1-B4
ttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggccca

SEQ ID NO: 11850 - DNA, 390 bp, Zea mays
  Clone ID: LIB148-051-Q1-E1-B6
tacagccaccactctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctcccggcgtctgc

SEQ ID NO: 11851 - DNA, 234 bp, Zea mays
  Clone ID: LIB148-051-Q1-E1-C9
agagacctgataccttctcaacatccgggctgtcagggatctatctcatctggtggatcaacaaaagaatgaatgccaatccgatgctgttcggatgaatctgatacagacagggtccgtgtacgtaggccgaatccggacccaaccaaacagtactagactggataacactgcacctaacttaaatgggtctttcttctcaaacgccaaattaaatggcccaaaaaaactgaa

SEQ ID NO: 11852 - DNA, 281 bp, Zea mays
  Clone ID: LIB148-051-Q1-E1-D1
tatatacaagacgatacaaccctgcgggtgttggtcatgttcctaacctttttgcacactccacttgctggttgcaatatgcctgcttccagatgcagaaagacattgaacctgacaatattcaaatgcccatgcatcagacggacatgtacatccataataggattttgacagaaattgcggcgggtgcgcctgttgtaagcttttgttccggacattccggtattaaaagcaaaggtaacctgtttccggaaaagcgaaacaaaataaaggatccagac

SEQ ID NO: 11853 - DNA, 174 bp, Zea mays
  Clone ID: LIB148-051-Q1-E1-D3
aagacgcgtgagcggacgcgtgggaaaaaaaaaaccgcccgaactaagcacaaagaattgactgaaagaaagggctgacgtccctagaggatttaacttaacgtacgcttgcatgcaaattgttacgccttcaaaaatgccaccaaacttcatttcacggcccatctttttaca

SEQ ID NO: 11854 - DNA, 164 bp, Zea mays
  Clone ID: LIB148-051-Q1-E1-E1-F2A
attattataaaatgtgaagattacttgtttacaatcataatatgccttaggagctcaatacatcgtcagatgccaaggggggataaactaaaattgttgtggtttcatgtcaaaaggcatattagagcacatttaaaataagagcatgggcagtgataatgttt

SEQ ID NO: 11855 - DNA, 111 bp, Zea mays
  Clone ID: LIB148-051-Q1-E1-F6
acccacgcgtccgaagaagtcggctaagtctttcgatcgtgttgcgcggcttcttcgtcgcatgggccatctgtaggtgtagtctgaggcctgacaggagcatttgagtgg

SEQ ID NO: 11856 - DNA, 368 bp, Zea mays
  Clone ID: LIB148-051-Q1-E1-H9
aacagtgtcaccgacgtggcttacgccgtgtgcaccgacaccataactgggcgcaacttcgtgatcgccattgttgagttcggtggttcatgcctccagatcgacatcgtgaacctgttgtacatctgcgagtgcaacagcgtgcccgatgtggccaactactgtaagcaggtgatcaagatcacagattacaatcagaaccagttcgtgaaactcgtcgtggcctctatgttcagcaccgtcgacggtatgagcatcgcggtccatggcttcgccttcacgaaagacaccggtcacagtagggtgaccccggccattgacgtctgtaacggcctgctgggcgagaacgaccagatcagcatctacga

SEQ ID NO: 11857 - DNA, 355 bp, Zea mays
  Clone ID: LIB148-052-Q1-E1-A9
agtgcagcactacgaatcccggctctcggaatgcgaggtcaggatgaaatctgtggagaggcagatcacttcgttacagatggctcacagtcacagccagaccgctggcgtaagcgtaaggagagatggatcgacgaggcacatccagggatcatctcgtggaggccttccgccgtcgtctcagccatcgtcagtgaggcgccagcagcgcggttccgagcccgccgctgccgacgagagccagaggacgacactggcggagccggtagtgaaccagctggccagggagttccacacggggacggaggcgttcgagcacaacgcgcccgccgtggccgaggccaacaggctgccg

SEQ ID NO: 11858 - DNA, 423 bp, Zea mays
  Clone ID: LIB148-052-Q1-E1-D7
tccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgcatgcctccgaatatatattatccgactcgatcctgccaaattgtttcgtcgacttcattatatatatcccatccctttaatttaatggagaagtgtgactgctgttcgtgatggttttgtatgcgcaaa

SEQ ID NO: 11859 - DNA, 427 bp, Zea mays
  Clone ID: LIB148-052-Q1-E1-G10
tgtcgacgcaggtgcgctacttcaacggcaccaaggcgaagatggtcgccaagaagggcgccgccgcggtgagcaagctgctggccgactccgtcatcctcatgggcatcgccaacaacgacctgttcgtgttcgctgccgccgagctgttgcggggcaggtcggccgcggagcagaagagcgacgccgccgcgttcctcaccgacctgctgtccaactactcggccgccatcacggatctgcactccatcggcgcgaggaagttcgccatcatcaacgtggggctggtggggtgcgtgccggtggtgcgggtgctggacgcggacggcgggtgcgccgaggggctcaacaagctggctgaagccttcgacgtcgcgctggggccgctcctcgccggcctcgccgacaagctgccgggggctgacta

SEQ ID NO: 11860 - DNA, 418 bp, Zea mays
  unsure at all n locations
  Clone ID: LIB148-052-Q1-E1-H11
aagcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcanagtgttggcaagcctaccacatgcatgc

SEQ ID NO: 11861 - DNA, 118 bp, Zea mays
  Clone ID: LIB148-053-Q1-E1-C11
acacgtccggtgcggacatctaacggacctgcacctgacgctgaacctttacaagcaaggcctgctctgggggaagatatcgaccgccaaggggggcaatcagttcaaggcaagggtg

SEQ ID NO: 11862 - DNA, 420 bp, Zea mays
  unsure at all n locations
  Clone ID: LIB148-053-Q1-E1-D11
aagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggangaggaagccgtggagaagaccgtcgtcgangaggagaagccagcggcagcagcccatgcagaggaaaaggtcgccaccgccgccgagaacacgacgacggtggaggcgaagaagaacgccg

SEQ ID NO: 11863 - DNA, 338 bp, Zea mays
  Clone ID: LIB148-056-Q1-E1-B5
aaacaacaagaccatggctatatgcacgaacgcgaagggcagcaccaagggttgcctcaaggagcttgcatgcttctagaccctccgtcgactgacccatctctctagttataatttttctctcgtccttgcattgcccattacatgctatccattggtaacgcacaagagtaaaacgacagacatccgacagctatattatgttcgacggtgtaacaccctgaatttgagggtataaaatttcttcgctaaataccagccaaattcaggtgttacctcgtgtctctctcgctctcgcttttccttttgattaagagtaagtgaaaaagaggaaaagc

SEQ ID NO: 11864 - DNA, 338 bp, Zea mays
  Clone ID: LIB148-056-Q1-E1-F10
cggcgccacgacctctcctgttgtcgctgctggtcgccatgctagcggtggccgctgatgtcgccaacgccggcgaagcgaatcctgtgacgcctgctgggcgcgtggtacacgatcatcacggtaagttcacaggcgggccgtggaaacattcggacgcgaccttctactgctggcgggacaggtccggcacctctgcgggcgcgtgcgggtaaagcgacacgtacgcgcaggggtacggtgtgcaaacggtggccgtgagcacggtgttgtttggcgacaggacggcctgccgccggtgctacgaagtgcggtgcgtgcacagctccagcgggtgc

SEQ ID NO: 11865 - DNA, 432 bp, Zea mays
  Clone ID: LIB148-056-Q1-E1-H1
tgctgacatttgcaaccttcttgagagcaaaaaggtctcaaagtctcttgagagtgactttagcaataaaatgaaccagctgttgctaatagttctgcaaaaacaaaggcaacaacagatgatggatggttttggaggatactatgatgaatgcatgtactggagacaaaatgatgaaattcatgatgctcataaggaggcatctgctccatgttcatcagctcctgtctcacatcttggtgctcatcagcaagagtgttggcagcactcttcatatggaagtcaacatcacgataaccaaaatttacttgaaatggaagtcagggtaaggggtgaaatgtcccagattcaacatgaaatatatgaactgcagaagttggtggaaagttgtattgcatcccaagtaaagatgcagcactccattaaagaaga

SEQ ID NO: 11866 - DNA, 160 bp, Zea mays
  Clone ID: LIB148-056-Q1-E1-H3
cagacgcgtaggtgcagctctaggctgcagctttcatcattggcgatcgatcgtaacaatgcaaagttgtgttgtatataactcttgtgtttggaatgccgcccgtaagtaatggtcaactctaacactgcttgccaaaaagaaaaagaaaggagaaaaa

SEQ ID NO: 11867 - DNA, 300 bp, Zea mays
  unsure at all n locations
  Clone ID: LIB148-057-Q1-E1-A9
taacanggaggaactcctcatcctcctcgcttctgccctttccagagtgctccgtccgtgtgcctgtcatgtcgttgagacagcccgagcatctgggacaatctgctgtaaggttcattgcgagatggagtcgtccgtggactgctactgattataattcggaagcatgaggtggtaagaaacttgagcgtagctaacgagcatgttcacaggctgaaccgtgagagtggctgcgcattattgtacactcagcttgagacacattgccattcggaagagcttgcacgattcatcgatgtt

SEQ ID NO: 11868 - DNA, 122 bp, Zea mays
  Clone ID: LIB148-057-Q1-E1-B4
agaagtcgcctaattctctcgatcgaattaggcaccatcatcgactcacgctacgtctatagctagtctctcaagcgtataggaatatttcattggatcatggaccgagtgataaggatcat

SEQ ID NO: 11869 - DNA, 293 bp, Zea mays
  Clone ID: LIB148-057-Q1-E1-B6
tcgggctaggctagctagctaggttaccactctggtacaacatggctggtgatggcatggaggtatctgccagcgggggtggcggcggcaacaagcagccgcagatcagccttttggggctgttcctcgtctgcgtcgccatggccttggtcaccgtcctcagctcctggtccctcggcgacatccggggcaacgtgcacgacgccgccgccgtggataagggcctcaagaccagcgcgctcgccatcttcgtcttcatcggcttcccattcccggtcctacgcagcgttccg

SEQ ID NO: 11870 - DNA, 153 bp, Zea mays
  Clone ID: LIB148-057-Q1-E1-B8
acatgcgggcccccgacggtgacgcccggtccgaacatcaccatcacggaggcaggtgtctgggtcaacgctaaggggagttgtttgcgtgagcccaaccagtgcccgagatctgagactgttggggatcgtgcagggtccacaacttgatcc

SEQ ID NO: 11871 - DNA, 260 bp, Zea mays
  Clone ID: LIB148-057-Q1-E1-C12
atgctcagacatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttattatatttgtattccacattatatataagagatacagattaaattaaatttattccaaaatgcacgaacgccgcaacaaagaactcatcaccgtcaagtacatcaaaacgtggc

SEQ ID NO: 11872 - DNA, 215 bp, Zea mays
  Clone ID: LIB148-057-Q1-E1-D11
cgtgtccatcggccacgtgatctgcgacggcgatctggtggggaagttctcgctgtccgacacctgcaggacaggggcggccgaggcgatcctgcagctgaggtcgatggggatcaagtcggtgatgctgaccggggacagcgcggcggcggccaagcacgcgcaggagcagctcgggggcgtcctggacgagctcgactccgggctcatgccgg

SEQ ID NO: 11873 - DNA, 124 bp, Zea mays
  Clone ID: LIB148-057-Q1-E1-D6
acgacaaggagccaggcatcaagacttcatgctttcaataatagaatctgttttgagtctcggcaacccgttcaaatagccctggagggacctaatttcaatacacaggggacagaccggtatc

SEQ ID NO: 11874 - DNA, 412 bp, Zea mays
  Clone ID: LIB148-057-Q1-E1-D7
aagggcggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaagtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgc

SEQ ID NO: 11875 - DNA, 369 bp, Zea mays
  Clone ID: LIB148-057-Q1-E1-D8
agggctccgcgtcgtgtcgcttctcttcctcctcctcctcctcctctctccaacaccccatccatcagcgctgcactccgcattgctcttgatcccatccagtacatcgattcgccccccaggatcaaaggccggaagaagaatcaagtttataattttggatctagccggttcctacctgaatgcgatgtcatctccaatcgcagaacatcatcaagttgagttctcagccaatcatccggaagggctgagcgacattacagcccccttcattagtgatgccctcaatggcgacggctcatatgccagagtctattttggtgtgctgagacatgggacgaaatctgcagtgaagaagcttgactccag

SEQ ID NO: 11876 - DNA, 382 bp, Zea mays
  Clone ID: LIB148-057-Q1-E1-E11
tcaagaacctcctcgcctcctccattgaccaacaattaagcctccccgaccgccacatctattaggtgcagccatgggtgcctgtgcaacgaagcctaagacgcttgaggggaaagccccagctgaggccaccatctccacacccaaggttgcacctgagaccactaccatccacattgaggttgcggcaaaacatgcagtagttgagaaggtggaggaggacaaggaggaggcactaacagtggcggcgaaacaagagccagcagccaccattgagcctcagcagattgctagtgaggtgaccacttcggaagtggcggtcgtcgttgtcgagcctgagaacaaagaggaggaggaagttgtggagaagaccgtcatcgag

SEQ ID NO: 11877 - DNA, 160 bp, Zea mays
  Clone ID: LIB148-057-Q1-E1-F5
agcgcgcgccgtgcatcatcgcctcaccgttcaggacgtcgaactacgaggacgtggcgcggggaccgcgctcagacacgaatgggagggagagctccaaggacggcggatggtctctacacctggacgggcagggtagagtcaacgcatattcaggaat

SEQ ID NO: 11878 - DNA, 375 bp, Zea mays
  unsure at all n locations
  Clone ID: LIB148-057-Q1-E1-F6
agcgtccgatccgctgcggtcagtgtaggtttctgaatcatagcttggcgatgcctgaggctagacaaatactgagctagccttcagaaaaaaaagaaaagaaagagattgagaagcagggagaaaaaatggcactggcccattgaggaagcttgagaaccagttaacaagaattgccaacatattcttggacaatcttgttaacagagttttaaggtttcncancagacatttttcgagtccaggaagagcgcgtgcaaccaccacattcatataattaataagcaaggttcagagaaaaagcaaatgggcacaaagaatgaataaagggatcctgaagccgttccgccatatctcaaccatcatggatggtaa

SEQ ID NO: 11879 - DNA, 300 bp, Zea mays
  Clone ID: LIB148-057-Q1-E1-F7
aacggcggacaggacacgctgtacgaccacaagggcctgcactacttcaagggctgcctcatccggggcagcgtcgacttcatcttcggcttcggccgcagcttctacaaggactgccgcatcgagtcggtggtcaaggaggtggcggtgctgacggcgcagcagcgttccaagtccatcgagggcgccatcgacaccggcttctcgttcaagaactgcagcatcggcggcgtcaagggcggccagatctacctgggccgcgcctggggggactcctcccgggtcgtctactcgtacacg

SEQ ID NO: 11880 - DNA, 62 bp, Zea mays
  Clone ID: LIB148-057-Q1-E1-F8
agtcgcagcggcgacggcgggcggccggcggccgcgacgtccgttgtggcggccgtggggcc

SEQ ID NO: 11881 - DNA, 394 bp, Zea mays
  Clone ID: LIB148-057-Q1-E1-G1
gtcatcctctggagatccaggctctgttctattctgctttacgctgtgcccgagaaatgattggggtaaccgatggatccaagaacttgatccgtgctattaacaacaggctcagtgctctgtcatttcacatcagggagtattattgggttgatatgaagaagataaatgagatttatcgctataagactgaggagtattcccatgatgctattaacaaattcaacatctacccagagcaaattccatcttggcttgcagactggattcctgtgaaaggcggttaccttataggcaatctgcagccagctcacatggatttcaggtttttctccctaaggaatctgtgggcgattgtcccatctcttgctactcaaaggcaagcagagggtat

SEQ ID NO: 11882 - DNA, 275 bp, Zea mays
  Clone ID: LIB148-057-Q1-E1-H3
agctagcagcttcatgtgtgggtacgtcaccgcggccgtcagtgcataaacaccaacaacacagactcggggtagggcaccagggtcacgggggtcaactggagggggtcaagagttgccgtcgcagatctcgtctgggaaaacatcgaagggagctccagcagcccgcgggccagtaggctgagctgctccaagaacttgaggtcctagcgagatatcccaacaagcttcggccttgggtcgaaccggtccataagatggaaagcatgagtggg

SEQ ID NO: 11883 - DNA, 442 bp, Zea mays
  Clone ID: LIB148-057-Q1-E1-H8-F2A
caaaggctaaaccagggtattcttattgcccaaaccaagaattggctggccaccaaatcagtagaccgggtacaaaaaaaaaaaaccatgctcagtaactatcatacagctggatagaagaacagtgttggacggttggaacattagtgtacattgcgaaaaatggaaagaatgcctgctcggcatcgcagaaaaagtatgccgcaatcaataagcaagatctggaagggacaaggatgatgactaactactagcatgcacatccgcttgtctgctcagtctcagggacaggatccgcaacactctggaagtaaatgtcctgatcgcgctcatgctctagagcaagcttggcaacagtcaggaaagcattggcaacattgtagtcctcttttgcggaagtttcaaaataagggatattgcctttataagcacaccactccat

SEQ ID NO: 11884 - DNA, 209 bp, Zea mays
  Clone ID: LIB148-058-Q1-E1-A9-F2A
caaagtcaacatttcagaccatttttcatgttgccaccaacttgattccttacacggaaacaaaaaggggaagggacccacccacgtaaagttcagcctagcaatttcaaatttcaaaaatgatcaggaagctggatccaaaaaacttaaagaaggtgccctttatgattgatactaacagatgaaacaaatcaatggaccaaatatca

SEQ ID NO: 11885 - DNA, 267 bp, Zea mays
  Clone ID: LIB148-058-Q1-E1-D4
tgcaggatcggcaccgatgcgattcaaccgcggcctcgcatccggtgcggaggtctgcaattggggggaggctcctctccgccgttggaaccgctgcggcgtcgcagcctgtgcgactttcctgctggttcctcatccctcagggagagattttgcattctttggcattactgtttgatggcagacagtagtgctccttctctgtggaggcattggggcaaaaggcagttgaactgaacgggcacatcaatagtctctggcctccaa

SEQ ID NO: 11886 - DNA, 269 bp, Zea mays
  Clone ID: LIB148-058-Q1-E1-D5
ttgaaggttgatggaatggatgttcttgctgtgaagcaagcgtgcaaatttgcaaaagatcatgctgttgcaaatggcccaattgtccttgagatggatacctacaggtaccatggccactctatgtcagatccaggaagcacttaccgcaccagggatgagatttcaggtgtcaggcaggaacgggacccaattgaaagggttagaaagttgcttttggctcacgacttggcaactgctgctgagctcaaggatatggagaaaaagaa

SEQ ID NO: 11887 - DNA, 76 bp, Zea mays
  Clone ID: LIB148-058-Q1-E1-F6-F2A
ttttgtcgcccttttttttttttttttttgatacaaaagttaacgtcaatgacatttttacatgttgacaccaaca

SEQ ID NO: 11888 - DNA, 268 bp, Zea mays
  Clone ID: LIB148-058-Q1-E1-G4
ttattatgttgctccagaggttctacacagatcatacagtatggaagcagacatttggagtataggtgttataacatacattctgctctgtggcagtcggccattctgggcaaggacagaatctgggatcttccggtccgtattgagggctgatcccaattttgacgattcaccatggccttcagtatcggctgaggctaaggattttgtgaagagatttctgaacaaagattaccgcaaaagaatgactgctgtccaagcactgact

SEQ ID NO: 11889 - DNA, 80 bp, Zea mays
  Clone ID: LIB148-058-Q1-E1-H10
aatgctcgcttcgcgcctcgtcctctccctgtacacgatcgtctgcttggatgtgctctgggggccctcgcatatcgctt

SEQ ID NO: 11890 - DNA, 356 bp, Zea mays
  Clone ID: LIB148-059-Q1-E1-A10
agccgccgtcgcgctcaccaagtgaccggatcggtcggcgttccccgtcgactgtgtgcgatcgctggatcgggtggcacgctgcgatgactatctgtatggcgagtcgctatacttacgcagacataagctgctccgacgtgtcttccggacgcgtggggccgtgggcgagtgctgcgtagacgaggaggacgagctcgggctgatcggcggcggcggcatcagcgccggcgacgcgctgctacggacgcttgcgcagctcaagctgaccaagcggtatatcagcgacgcggcgctgctcgcggaccatctgccgtgcaacaagctcggccggtcctactacaccaactgcgcgg

SEQ ID NO: 11891 - DNA, 315 bp, Zea mays
  Clone ID: LIB148-059-Q1-E1-A11
gacgtccctcccgacacggggaaccccgctccgcgcgctcgcattcgtcgcgccgccatccaggtcccagccggccgcgcgcccgcgcccccctgccggcggccgtgccatgccgcagcggggctatactgcggtggtccccattgaggtggcgtgcgccggcggccgtcgacgccatcagcggcgcatgagacatcgacacccgaggtcaagggccggacgtcaccgtccggatcggtgtcgcctgtcaccgcgtccctcgcgggcgttaaggtcgtgctggagttcggtcccgtccctagcgccgcgcttcag

SEQ ID NO: 11892 - DNA, 381 bp, Zea mays
  Clone ID: LIB148-059-Q1-E1-B9
gctgctgcctggagatggaggaggccctgaacgcggtgtacaggcagggccgcaacggggacgccatcgggccgctggagatccgggtggtgcgcggcggcacgttcgaggaggtgatggactacgccatctcgcgcggcgcctctatcaaccagtacaaggcgccgaggtgcgtgtcgttcggacccatcatcgagctgctcaactccagggtggtgtccagccacttcagcccggcgtgccccacgtacagcccgcacaagaagtgatgacctaatagcattggccgtcggagctcggaggctggggttcacggtcacggcccagactgagctactacacttctgctagtactatatattgccacttgttgctctctac

SEQ ID NO: 11893 - DNA, 83 bp, Zea mays
  Clone ID: LIB148-059-Q1-E1-E5
cccacgcgtccgaaaaaaaaaaaaaaaaaaaaaaaaaaaaaaaaaaaaaaaaaaaaaagaaagaaaaacaagggcggtcactc

SEQ ID NO: 11894 - DNA, 209 bp, Zea mays
  Clone ID: LIB148-059-Q1-E1-F5
ctgagctatcacttctccgtgaggcctgagcccctcaccgctgtgatctagagcggcccacgtcgcctcggggatcactctcactaccgaggcccacccatttagtactatatatatatctctaggatcgatcatcactacattggcaagctcctccgtcctgaggagcctactgtccctcctcgtctacatcgtcgccggcgtgcccg

SEQ ID NO: 11895 - DNA, 361 bp, Zea mays
  Clone ID: LIB148-059-Q1-E1-H1
tacgaggccaaaagtaagctgctgctgttcttcgacccgtcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatga

SEQ ID NO: 11896 - DNA, 439 bp, Zea mays
  Clone ID: LIB148-060-Q1-E1-D3
gacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatcc

SEQ ID NO: 11897 - DNA, 379 bp, Zea mays
  Clone ID: LIB148-060-Q1-E1-G8
tcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacg

SEQ ID NO: 11898 - DNA, 222 bp, Zea mays
  Clone ID: LIB148-061-Q1-E1-B2
cacgggtcgacacacgcctctacacacgactctctgaactgagccacgcccttctttatatgtatatatatgcatgaagcggattatattggactgttgtactgtgtactagcttgtttattccatgactaacatattgttatattgactgggttgtttgtactgaaaagaatggatggcgcccgacaagcccaaccccaacgagctcaccagcaccatcat

SEQ ID NO: 11899 - DNA, 375 bp, Zea mays
  Clone ID: LIB148-061-Q1-E1-B5
ttcctcgaccaacgcaaatctgcctcgggacgaacaatgcgtcgtcgtccatcgatcatgaggcgtctccgacggagctaaaagagaccgatcagtgagcggtggtggattgaagaatcgagggcgaggaggaagacagggaggatggaggaggtggagcagcagctgaccaagaaacagatcgaggagttccgggaggcgttcagcctcttcgacaaagatggcgacgggacgatcacgaccaaggagctgggcacggtgatgcggtcgctggggcagacgccgacggaggaggagctgcaaggcatggtggacgaagtggacgcggacggcagcggcgccatcgacttccaggagtttctcacctgatggcgc

SEQ ID NO: 11900 - DNA, 271 bp, Zea mays
  Clone ID: LIB148-061-Q1-E1-C5
tccacatattgatcacagcattgtcacttaccctccaacgttgatgccacatctacgtttacccgtaccagtgcttatgtctttcagacaaagatggaatcggttcaaggagatttgccagtctagtgcctcagccacggctgacttcacgtgggaatgacctactgaacttcgagattacctctgcacatgcatggacttgtcatggctcaaggcatcaagcaagagaatgtcaagaatgacgaatgtagctgctggatggtccagattc

SEQ ID NO: 11901 - DNA, 407 bp, Zea mays
  Clone ID: LIB148-061-Q1-E1-D5
tggctagttcgtggatggcggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgccc

SEQ ID NO: 11902 - DNA, 420 bp, Zea mays
  Clone ID: LIB148-061-Q1-E1-D6
tattttttctttttattttttttttttttatgccaagcggttttcttttgttataggcgacaagaattgcacggctgtacacacaaaagcaaacagcacgcagtgaatagcagcgtacgtacagataccgtgctagctagctcaaacgaagattattgccgcctgctgctgtgctgtgcctcacgtcgtcagctagcttctcctctgcgattctccgctactacgtataccgtcccccgtgcagccgcgcgccgcgtatgtagtggcggctggcgtgcggtcctttgcgcgattcgatcgacctgccgcctggactggatcacgtgtttgtggttcacgcacgcacgcgtgtcgtttcgattacttgtaccgcctggagctggagctggctttgctgctgttgtggtaccggtggtcgtc

SEQ ID NO: 11903 - DNA, 396 bp, Zea mays
  Clone ID: LIB148-061-Q1-E1-D9
tgttcgggcgccgtgggcgagtgcggcgtggacgaggaggaggagctcgggctgagcggcggcggcggcatcggcgccggcgacgcgctgcggcggacgcttgcgcagcgcaagccgaccaaccggtacatcagctacgcggcgctgcgcgcggaccaggtgccgtgcaacaagcgcggccggtcctactacaccaactgcgcggcgcagacggccgccaacccctaccgccgcggctgctccgccatcacgcgctgcgcccgcagcatgaactgagcgccaaggcggcggccggcggtctgatctgcctgctggctcgctgggcagggggcacgcagctggcctggctcgatcgcacaccatgcattgacgtcgtcgcggccggccgccatgccg

SEQ ID NO: 11904 - DNA, 370 bp, Zea mays
  unsure at all n locations
  Clone ID: LIB148-061-Q1-E1-F12
aaccacgcgtccgcccacgcgtccgtaatagggtgcttgttgacactgctgcaccaatagaatctgttaaagaggctgtaagcaaatttggaggcattcttgactggaaagagagacgtaagaatgtccagaatgagcttgataaggcattggaagatgctcctaggtacaaaagaagagcggaagctgcagaagctgagaaaagcaaagttgtcatggaattgtgtaccactaggagaaccattgaagggttgaagctaaatctagagaagacacaaattgaggcaatacaagcacaacaagactcggagcttgctgacatacggttcaaagagattcaacaaggaattgcatgtanagagagtgctgc

SEQ ID NO: 11905 - DNA, 371 bp, Zea mays
  Clone ID: LIB148-063-Q1-E1-E10
tttgcacctttttccattgttaagagcagtagatggtgaggaagtacctggagaggtcgtggtgtcaacggaaaacctggcaagggggatgacgaacgacttaatcctccccgtgcagtacttcgtcttggatgccatcttggacgtgttctgcagtacggcgatcggcaagcatgaccacttctcaaatcccggtggcccaggctgcatgcacctccttctcggacagacacttacctgcatgacagggtacctcttgccatcaccggagttcttgatgaccttgaagctctgaccgtaatatatccggaatatggtggcgtcctccaccctggacacgggccgggccatcacaggcccgggcccggcct

SEQ ID NO: 11906 - DNA, 535 bp, Zea mays
  Clone ID: LIB148-064-Q1-E1-B9-F2A
ggaaaaggagcgaagagagagagagacgcatgcccgccggcgacgatcgaagagggaggaacgccagagacccggcggcggcgaccatggctccgcgcagctcatcggcggcgacctgcctgtgcctcgctctcgccgcggccacgctggcgctggcccacggggcgcaaggaggaggaccatcggcatccgcggtggacctggacaaggtcacggtcgacaccttcctcgacatctacatcaacagcaagcctgcaggcctgatcgtgctgggactgtttggggacaccgttcctaaaacagcaaagaacttccgagcactttgcacaagggagaaaggaatggtcaagtcctgcaagcctctatggttcaaggggacgacgttccacaggatcatcccgaagttcatgatccagggaggcgacttcaccaacggctacggcacggggggcgagtacatctacagcagcaccatcttcttcgacgagaacttcaagcacacccacgctaaagccggtacgctgtccatggctaa

SEQ ID NO: 11907 - DNA, 531 bp, Zea mays
  Clone ID: LIB148-064-Q1-E1-B9-R2A
aacacaagtggccttaatttggcagtctttcaattcaccatgatctgaagaagagcacgtcttatataattaaccatgcacacgtttggtttcttaacgaacaagacagatcgaccggattgatggatcgtgagtcgttctcctcgtcatcgatcagaggtcacgatggccggcggcggcgggcgctggcagctggccgctgttggctatgacgaccttggccttgggcacgccggtgagctggccctcggcttctatcttgcgcacgacgtccatacctttcaccaccttgccgaacaccacgtggcgcccgtccagcttcttgggcaaccggttttcgtctacggtggtgatgaagaactgggagccattggagtcgggcccgtagttagccatggacagcgtaccggctttagcgtgggtgtgcttgaagttctcgtcggagaagatggtgctgccgtagatggactcgccccccgtgccgttgccgttggtgaagtcgcctccctggatcatgaaccccgggatgat

SEQ ID NO: 11908 - DNA, 381 bp, Zea mays
  Clone ID: LIB148-064-Q1-E1-C4
aagcaccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaaacctatctctgtcgaccccaaggcagacgccatcgtggtgatggacgccaagaaagaggagggcaacaacaaggtgg

SEQ ID NO: 11909 - DNA, 376 bp, Zea mays
  Clone ID: LIB148-064-Q1-E1-D10
agcaagatgttgtgtacacggattggatagatcgtccacaacctcgattggaccgtcatacaggaaatgggtttacagtgacgctgggaagagtgagggaatgttccgtgatggacataaagttggtattgtttggacataacacagtggtaggagctgcgggtggttcgattattactgcaaagttgagtgtcgccaaagggtttattgcacaaaaaggaaaacaaagtgtatatgcggcagtatctcgtcactagtgtgtgtcactagacagaatagtgtgtttgtgttgtttgtgtctgtgttttccaatgaaagacattgaccactagaactatgtgaaaaaaaaattacagtcaaccacaaagactatcaa

SEQ ID NO: 11910 - DNA, 387 bp, Zea mays
  Clone ID: LIB148-064-Q1-E1-F12
aagcaggccgcggctgacatgtccaaggtgctgcaggtggagatctcagccggcgccgccgaggaggacgccgtggctgcgactgcgactgcgcctgcgccggcgtcggcgtcggcgtcctttgggctcttctccggggagttcctccgccggcacgggctgcacctcctgggcacgtcctcgacgtggttcctgctggacatcgccttctactcgcagaacctgttccagaaggacatcttcagcgcggtggggtggatccccaaggcggcgacgatgaacgcgctggaggagctgttcagcatcgcgcgggcgcagtccctgatcgcgctgtgcggcacggtgcccggctactggttcacggtggcgctgatcgacgtgttgggg

SEQ ID NO: 11911 - DNA, 319 bp, Zea mays
  Clone ID: LIB148-064-Q1-E1-H3
agcgagatgagcatggacattgtcagggcgcgagctctctgaagaggaagacgcgcatccgctcgcgcgatcgccatgcatgccccggaaccgacagagcagtgctagctgtttgtcttgcatcatcgaccggcggcctctgcatgtacccgtgtgccgttttttgcaccgccggtgccagtgttctcttactccatgtaaactactctagacagtgctcggtgagtacagctgctcggtgagtacggtgtcacagtcactccgtgtaggcagtgccatttcgaagacaatattgcacaatttaactggaaaccttaac

SEQ ID NO: 11912 - DNA, 434 bp, Zea mays
  Clone ID: LIB148-064-Q1-E1-H7
acggacgcgtgggtttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatccagtcacggtgttcatcacagacatgaactaacgagcctatcgctccctaccacttcgac

SEQ ID NO: 11913 - DNA, 51 bp, Zea mays
  Clone ID: LIB148-065-Q1-E1-D12
aaaaaaaaaaaaaaaaaaaaaaaaaaaaaaataaaaaaaaaaaaaaaaaaa

SEQ ID NO: 11914 - DNA, 261 bp, Zea mays
  Clone ID: LIB148-065-Q1-E1-D6
ccacgcgtcggcccgctcgctctcacattcatttgtgcagctgattacgctaggtctatttacgcagctgtcgtgtgtcgaattttaacagcgacggccatgcatcagacgcccaccccacacatcattttctttcttcctttcttttgattcgacgacgcctgtgagtcatgcatgctctcgatcgaggcaaagctgttgtatgttgttagcgtgtactgtttttttattatttataaagttttgatgggaaggaaaaag

SEQ ID NO: 11915 - DNA, 399 bp, Zea mays
  Clone ID: LIB148-066-Q2-E1-A4
tacgatgtcactgcctgtgagaccaaggtcattcctggcaaccttgggtttgttgcacaactcaatgaagggcgccatcttaagaagcgccctactgagtttcgtgtggaccgtgtgctccagccgtttgaccctgccaaattcaatttcacaaaagttggccaggaagaggttctcttccaatttgagaatagtggtggtgatgacagctatttcctgaacaacgctccaatcattgctgttgatcgggctccaaatgttattgctatcaatgtaagcccaattgaatatggacatgtgcttctcattcctcgtgttctggaccgcctgcctcagaggattgattcagagagcttcttgcttgcactgcaaatggcagccgagggaggtagcccatac

SEQ ID NO: 11916 - DNA, 92 bp, Zea mays
  Clone ID: LIB148-066-Q2-E1-C10
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11917 - DNA, 542 bp, Zea mays
  Clone ID: LIB148-060-Q1-E1-H6-R2A
gccggccgggcggcaccgccatcggagtacgtacacacgtggtgctgtcccgcatgccagcggccgggggagaaaaccaacagccaagccaagcccacattgtttccgcagctaggtagaggggcaaaggaggagtatagcggagaggttgatgcgtgacggaggaggcgccatggacgtcgacatgcaagcccgcggtggcggtgctagccatggcggcgaacttgacgacgacggcaaggagaagaggacagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaccgactgctaccgcttcggcgaccctgtcaccgggaagcgcaactacacctacactgaggccgtcgagtcctacctaggcggcaggtatgtctggttctgcggcttctgccagtacgccaacatgttcggca

SEQ ID NO: 11918 - DNA, 602 bp, Zea mays
  unsure at all n locations
  Clone ID: LIB148-008-Q1-E1-D12-F3A
ccgccgggggccgcgaccgacacggtgacggcgacggcgacggcgcggtggctcaggtgcaccccggcgccgaccgcccgagctccatctgggcgcacgctatcctcagcacggtcgacagctccgcccgtcgccgccgcaaccggcggagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagctggcggcgagcatggcgtggcgctgggcgactacttcctcggccccagcctcgacgccttggtacagcagctcgccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggnncgcgagcgcgcccgccagatgccctgcaggcacaggttccacg

SEQ ID NO: 11919 - DNA, 487 bp, Zea mays
  unsure at all n locations
  Clone ID: LIB148-012-Q1-E1-E4-F3A
gatgaccacagaatctgcacttctctacctagatctcccttgctcagtttcaatggcagctgcagttcaacctctgacagatgcagctaaggattttctcgctgttaagtacaaggatttgattaagttccaagatgaagtgatgaacatccctcgcgctggaatcgaagccatcttgtcaagtaatgacctccaggtggcatctgaagataccatctatgacttcttactcagatgggcccgtgcacaatacccgaaatcagaagagagacgtgaggtccttagttctcgtctgctccctctagtgcgattcagtcatatgacgtgtaggaagctgcggaaggtcctagcctgcacagatatagaccacgagcaagncaccaagtgtgtcaccgaggctcttctgttcaaagctgatgcaccacaccggcaacgagctcttgcagcggacgcaataacctgccggaaattcgncgagcgggcttac

SEQ ID NO: 11920 - DNA, 617 bp, Zea mays
  Clone ID: LIB148-012-Q1-E1-E4-R3A
gaaaccctgccctgcaaggtggaaggcttgcgagtatatccgccctgcaggaaagagtcgagagcactcgtcgcgcttgagatccaagtatgctatgcactgtgggtagggccgatcaaactcaacaactttgagtggtctgtacttgtaagcccctcggcgaatttccggcaggttattgcgtccgctgcaagagctcgttgccggtgtggtgcatcagctttgaacagaagagcctcggtgacacacttggttgcttgctcgtggtctatatctgtgcaggctaggaccttccgcagcttcctacacgtcatatgactgaatcgcactagagggagcagacgagaactaaggacctcacgtctctcttctgatttcgggtattgtgcacgggcccatctgagtaagaagtcatagatggtatcttcagatgccacctggaggtcattacttgacaagatggcttcgattccagcgcgagggatgttcatcacttcatcttggaacttaatcaaatccttgtacttaacagcgagaaaatccttagctgcatctgtcagaggttgaactgcagctgccattgaaactgaacaagggagatctaggtagagaagtgc

SEQ ID NO: 11921 - DNA, 471 bp, Zea mays
  unsure at all n locations
  Clone ID: LIB148-018-Q1-E1-G8-F3A
accatgtgcttgtggagatgacaggcatcggcgtggccgcgacctcctcgtcgagcttccgccatgtggccgacatgtcgcangcgggcagatacaaccacctcatcgagacggcgcacaccaagaagaacgaggccgcggaggccggaccggagccaccggcggacgcaggcgcggttgagccggaagcacccgcgcaatcggcgtagaacgtacaaagattagcagcaacgcaaagagaaatagagccgcacgtgtctatctcctctatatatacgaaccctgcatcagtaagtagtcgtcacaagtatatgttcttattttgtaaccttggcagcttggttcagtctgggattgtaacaagtgcatgttgaattgcttgttatgtattatgaggctgtggattcatgacgatgaaatgagtatatgggtgtaaacatttggcttcaaacaaaaaaaatgatgaaaaat

SEQ ID NO: 11922 - DNA, 410 bp, Zea mays
  Clone ID: LIB148-018-Q1-E1-G8-R3A
gatgctcacctgaaagttctttgagaaggtccctgtctccttgaagagctgttcaaagtgcgtcttgcagtacaggacgccgtccatggaagagtagctgctaatcgagaggacgcccttgcagtggctgcacttgaagcatgtcttgtggtacgagacgccgtcggcggtgaggaggtcgatgatgtggaccgtcttgtcgcaggctttgcacttgtcctgcgtgccggtgaaagacatggcgatcgagctctgtgcttgcacctgccaatcaggactccagcctcaaacgaagcccgtacgtctggctagccgctgctcgtgcaggcggtcccccaccggcaggcaaaaccgatgagcaaacgggcgcggacggaggagaaagacgctcgttcgcgattagggggagg

SEQ ID NO: 11923 - DNA, 633 bp, Zea mays
  unsure at all n locations
  Clone ID: LIB148-043-Q1-E1-F4-F3A
cttgggcacaagacaaccttgatctcaacgggcttgacgcggtcctgcggcgtcacctcgacgtccgtggcgttggtcctcgtgtctgggcactcggccttgaacagcgccgcatcctcctcatggcgctcgggcgcgcggggcagtcggcagcgaggtccacggcgcatcccagcgtggggcaccgccgcccgccctccggcggcagcctgtcaccacgaccgccacgttgaagccgtccaccagaggctcacgctgtatgccgcggccccgcccggcccacccacggcgccacgctcacctgtgccaccgtcatcgccggtgcgtcgcctctcgcgcaacggaccggcagcaggggcgagtgagcgagtcatctccgtggtccgtgtcgttgtcgcacccggtctgtgccaccatgcggcctgaccatgcgtcagtagagatggcaatgggtacccgcgacctgatgaatatttactccattaaagtatgtatgtgggctaaatattntatccgtgggtcggttattggtcaaaaatcttgacccaatgggtaaacggntattagaacgtncactntcaccatacatgtaacccatggtataaatacccattaactagccagctaaactga

SEQ ID NO: 11924 - DNA, 334 bp, Zea mays
  unsure at all n locations
  Clone ID: LIB148-043-Q1-E1-F4-R3A
agcgtgagcctctggtggacggcttaacgtggcggtcgtggtgacaggctgccgccggagggcgggcggcggtgccccacgctgggatgcgccgtggacctcgctgccgactgccccgcgcgcccgagcgccatgaggaggatgcggcgctgttcaaggccgagtgcccaaacacgaggaccaacgccacggacgtcgaggtgacgccgcaggaccgcgtcaagcccgttgagatcaaggttgtcttgtgccccaagcccgccaccatcgtcgcgggccacctctagcgcgccgcgccatgcatgcgtcntcctggtgggcgcggcggtggtgt

SEQ ID NO: 11925 - DNA, 396 bp, Zea mays
  Clone ID: cC-zmpo148010a01a1
caaacaaacttgcgtggtctatgcgatcactgatacattttttcctgatccatattgggtagagtcgtctctgacacgaatgcaatttgggttaaaatcagaacgattacatacatgccgaaagcggatggatcaatggaacactcgaaggcacggccattaaaccatacatactcgaactgctgatacaccttgacctaaagctggatcgtaataacatgccaaaccgtcgggccaagtcgtatatgattcatatcatgcttgaaaaccttattcctgtgctgtccatctgggtgagctccttatcgaacttacccatggggttggggacaccgggatggataaacggacggagacactagtcgaagtcctggacagcaagctgcagcatgaact

SEQ ID NO: 11926 - DNA, 450 bp, Zea mays
  Clone ID: cC-zmpo148010a01d1
ccggttcccacgatcacctcggccgcaagcaacgaggaggaggcttcgtttagcgtcggagaatccaccaaggacggggggcatcgcttgacgatggaatgcaccactcccgtctcctccagtagccctttcactcgcaaagaagcgccgtgcgttcagcctcttcagggcgacgttcctgtccttcggccggagcgacgacagcatgaagaagacagacgacgacacctcgagccccaagaagagagccatcgcggctgctgatgacgattgcaagcctgccgatgacgagtcaacgtcgtggaagcgcctcgtggacggtatgcgcccgctccgtctccgggggcagctggagtactacccgtcgtcaccgacgccacagcgaccagtaagagggtgctgagggtggcgatgacggtgacagcagttgcccacacgccatcgacatgc

SEQ ID NO: 11927 - DNA, 402 bp, Zea mays
  Clone ID: cC-zmpo148010a02a1
ccccccctgtcttggtctcttttttttttttctttttttccctttccccttttttttttttttttttttttttttttttccccccaagaaaaccaaaaatactttttggccccccaaacccctttttaccccaaaggacaaaaacccccctttacacaaacccaaaccaaaaccaacccaaaaacccccccaaaaaaaaaaccgcccccccccaaccactcgccctaaaaaattgaccccgaaaaaacaacccccccctgaaaccctcctttcccgaaaacttgcaaaccccctaaaaaccccaagcccccccaacccggccccccatttgaaaaccccctttaaaccccaaaaaaaattttccctttttccccaccccctttaaggaacccccaaaaccca

SEQ ID NO: 11928 - DNA, 446 bp, Zea mays
  Clone ID: cC-zmpo148010a02d1
gttcgacgacggggccgaggacaagtccaagctgcctagcattgacttgtatgcatgtgcgagcggcgactgcgcgggactcggctatggctgctcctgcaatgggctggacgagaagagcaacatctcctacgcgttcaacatgtacttccagatgcaggaccaggatgtgcgcgcctgcgacttcgaagggcttgccaagatcacagacaagaacgcctccacgctcggctgcctgttcccggtccagataatcagtgccagtggtcgggtggcgccagctctattgctggcggcgctattggcattgctcgtgattgtgttcgcgtagagtggggatttcgtcacttcgtgtagaactgcgttcgcgtgaccaaaaaaataatatgaattccttgctggcaaaaaaaaaaaaaaaaaaagaataactcacaacaacaaatgca

SEQ ID NO: 11929 - DNA, 492 bp, Zea mays
  Clone ID: cC-zmpo148010a03a1
gaagatacattataatttgaattcactactattctagagtggggctctcttcgagagggtacatatacgcgcatcaacaatgtacatacatatatgtacaaattaatttcaggcagatgttactaactgcgagcgcggcgtgagattcttggagggtattattttgcagcggcatgtacaaataaaggtacggtgcagtgtaacacagtggagtatttcgcaggatgcatgtggggccggtggtaccagcttgtcggagctagctagctgctaagcggcgttgccgaggtcctcgaagctccagtcccggcgcatgccgacgctgcgccggagccgcgggccctggatgagctgcgacacctttagttcatccaccgtcgacttgcacttgcgcaccatcttcttcttaccaccactcctgctgctgtcgtcgctttttatcgcggtggcggcgtcgtggtcgtccttcttggccttgccgctgatcttggg

SEQ ID NO: 11930 - DNA, 477 bp, Zea mays
  Clone ID: cC-zmpo148010a03d1
ttccgatcgattcgaaacatgggagagagtagcaaataaacaacatttagattgttgattatccaatcggatcgttcgagcgggatgagcatccgaacgtcgcacctgaccgtcctgcaagtgccccgccgcggggccgtcttcgttgccggagacgcggcggcggcggcggcggacccctacgacggaccgcagccgcagactgtcacctgctgcacggcgctgcatcgtggcgtggccctcgacggcctggcgcagcctcggtacgcgccgctgcggacgctagcgatcgtcgacgacgacgacgacggcgacgtcgaagaggacgaggatgggaatcccatgatcagcggcaaggacaagaaggacgaccacgactccgtcaccgcgataaaaagcgacgactgcagcatgagtggtggttagaagaagatggtgcgcacgtgcatgtcgacggtggatgaactgaaagtgtcg

SEQ ID NO: 11931 - DNA, 420 bp, Zea mays
  Clone ID: cC-zmpo148010a04a1
aaacttatggaaaaccaaatcatatatttcgtggcgtgattacagaacgacttgacacaaatagataaattaaatcacgtctatgtaattaacacaacccgtcaccatgcatatatattcatatcacatcacatcaataataatatatggaaacagcggtgcaggtgacgtcttccaagtcgaccaccgcagcaacagtcaccaagaacgagcgaggcaactgcaatggcaacggtggacggatccatcgtcgtccatgcgcgcgtacgtaagcacgcacacgcttaatggaggtagtaggcgaggagggagaagaggagcgcggcgggcgctgcggccagggcgggcgcgcctctgctggcggaaggccccacggaggcggcgccagcggcaagcccagcgccagcgccagcgggagcc

SEQ ID NO: 11932 - DNA, 526 bp, Zea mays
  Clone ID: cC-zmpo148010a05a1
ataaaatggctttaataccgagatggaggggtacaaatcgggagtagtagctttatatgctactatcgatatacaaaccgagagcacagtacatatggtcacactactacaggtgcacgcatgtattgccgcttataaatgtgggaaaaaaaaagataacccgtttctctagcaatggaaagaagaaatgacaaaaacacggcacacacacagagaaggatggttttttttcactgatggtcgtctgatggaaacacttgttccgtaatgtatacgtgtggacatgtggttaatttcatgcaggagctctcccttaaaccttaataactgcagcagcagtagcagccgccgccgcctcctgatgagcggcggcggcgaccgccgaaaaggtcttcttcatgactttgagcttctcgggaggcggggccgcagcgaccgcgtcggccgcctggccgtatgcagcaaggatttttgcgatcttgtccttgtcccccttcgcgtaagccttgttgatgtttggcgtcgt

SEQ ID NO: 11933 - DNA, 533 bp, Zea mays
  Clone ID: cC-zmpo148010a05d1
ctccgcgctagggcgtgcgcgttcgacggcgcggggttcctttccgagccgtgccccgccgcggaagggcttctgcgagacctacgccaagactgagaccgccttcagcggaaccatcgcctccggggacacgcccaagagcaagctggggatcacggacgccgtgctcaagctgaggctcgccaccgacgccaacatcaacaaggcctacgcggagggggacaaggacaagatcgcaaaaatccttgctgcatacggccaggcggccgacgcggtcgctgcggccccgcctcccgagaagctcaaagtcatggagaagaccttctcggcggtcgccgccgtcgctcatcaggaggcggcggcggctgctgctgctgctgcagtgattaaggcttaagggagagctcctgcatgaaattaaccacacgttcacacgtatacactacggaacaagtgtttccatcagacgaccatcagtgaaaaaaaaccatccttctctgtgcgtgtgccccgtcctcgtcatttctttcttt

SEQ ID NO: 11934 - DNA, 474 bp, Zea mays
  Clone ID: cC-zmpo148010a06a1
ggacatgctgattgatgatgatgaatggatatctgcatgcatgcattgtaaaaccaaagaaatgggaggtagcttaggcatgcatgcatgatgcatggggccttaattaattcatccacggccacgggtcgtcggtgatgatagcttgaaccctctgagcgcggacacgccggcggcggcgcctcgctcttgtgctgcttgtggggctgatgcaagcgcttctgctttcgctaatacagccgacgtacctaaggttgtgatcccgacttctccgtatcatgcgctggcacaggagagctggcatacgatggtccagccgttgcatgcaaccaacacaaccaagcacagcagcaacgccgccgcctgctgcacctgcatcatctgcatccccgtcgtctttgccgccatggcgcccatcttcttttaattcatttccttgcttgcagttgcagatacagaaagacagccaggagg

SEQ ID NO: 11935 - DNA, 423 bp, Zea mays
  Clone ID: cC-zmpo148010a07a1
ggttagttaaactccatgaataatcgattccatcaaatgattacaccaaattaaacatgcctcctccgcccaagcatatacccgtacgcacctaattaatccgtatgccgaccctactacctacatcaacctccggtctcaccgcggcggggcgtcggcggcaccggcaccggcggcgaggactgcctcgagcgtggtgacgaccctggccatggagggccggaccttggggttctggctgaggcagtcgtactcaaggcgggccacgcgctgcaagcccatctccgagcagacctcgcccatccgccggtccaggatccgctccaactttttgggccggataaggatgggccgcgcccagtccaccaggctgccgtcgcggccccccgcccggctcggatccagcgcgcgccgtcccaccag

SEQ ID NO: 11936 - DNA, 352 bp, Zea mays
  unsure at all n locations
  Clone ID: cC-zmpo148010a07d1
gagagcgagcacaacgaccgaccgaccgaccagagcgacgcgaaagaacagccgcaaaccgnaccaccagaaaacgcaccgcagcaccaacccaagccgcaacgacaaccgccagccgcgcccaacgacccgccgacgagaagcgagcccgaggccggcgacagcgacggcgncggcgacgacggacccgaccccacagaagccgaggaacgcgcagccggaggggacgcacacgccgaccgagcccaaggacagacaggaaaaccagaccacgacgacaaacggacgccacaagcaccgcaccaaccacgagcacaagaaggccacccgccacaacaacccggggcacaac

SEQ ID NO: 11937 - DNA, 317 bp, Zea mays
  unsure at all n locations
  Clone ID: cC-zmpo148010a08a1
gcggccgctctttccaccccacnttaataactattggagggaacctgcaataacacctgtaagcttttatcacatctaccgaatcaaccctcccttgtactttggagttgtcttccctcttggagtttggggagagctttatactataccctggggtttggtgaaaagggtgcattttcatggcagccttgtaaccatccatccatcatctatttgccgatttgctttatctgcacagagcaaggatccctcaaaatttcctcggcctaataaccgccttccactctcataattcatcagctcgtacacatttttct

SEQ ID NO: 11938 - DNA, 192 bp, Zea mays
  unsure at all n locations
  Clone ID: cC-zmpo148010a08d1
cccaaacacaggacggaccccacccanacaacgccgccacgaaaacacaccccacaccccaaacccccacgaaaagcaaaacgcacaccccaaacaccaagagggaagacaacaccaaagcacaacgcaacccagaaaccacccaccaggcacaaccccaacgcacaacgcaaaaccccacacaacgaccac

SEQ ID NO: 11939 - DNA, 360 bp, Zea mays
  Clone ID: cC-zmpo148010a09a1
ttgactatacaacatatttctctctaaaaatgttagattcatattgtatttcaatttatataaccgcattaacccaacacaacaaggtgcacgaagggacatgtaacataacttatttcttgggtggtgtggtgccataaaataaccatagaacaaaaattaaatattagctcgctggcacatggatcagatgagctctttcaaaatattattcctcataagaggatgatcagatgctgagggtggtcttgtaggtggcgtcggccttaaaattttcagggatgacatcatcggcgatgcggtagccgccaaacttgatggcaaagcggatgcatagggggtacttgaatggggcctttg

SEQ ID NO: 11940 - DNA, 416 bp, Zea mays
  Clone ID: cC-zmpo148010a09d1
ggacacgtgggcagacgcgcgggcaaagtaacatgagcacacaaacaagacccctccaggacacgaccaacaacagccactaggcccgccaacacgctcgccacaacggcactggctacgaaccacgaaaaaggaccagcaccaccccgctcacctacaaggccggcaaaggctccaagcctggccacctggacctcacccccaacattgccaccatctccgaaacggacatcaaggaacacggaggcgaagacttctccttcgagctcaaggagggcccagccggcacctggacgctagacacaaaggccccactcaaggaccccgacagcaaccccattaccatcaaaactggcagctaccgcaacgccgatgacgtcatcccagaaaaccaaaaagccgacaccacctacaag

SEQ ID NO: 11941 - DNA, 379 bp, Zea mays
  Clone ID: cC-zmpo148010a10a1
agctgggattgtttggactaactgggtaccaaacccaacacagctaaccctgacatgcaaaatcaggatgaccaccaagtactactcaatcttgaaaagcgaactagatgtaaaaactcatgacaaccaccaccagaaatacctaactacttggcccaaaaggagctgaacaggggatttcaaagtcaggataaccaccaaaaacaggtaactggtccggcaaacggaaatgggacagttgcttccgctgctttgaccttccaagccacacttttacttttgggtgcaactagtatgtacaccataacccactaactcaggtcaaacggagcgccttgatatgaaagatcaatttgcaataaaagtccccgcttactta

SEQ ID NO: 11942 - DNA, 552 bp, Zea mays
  unsure at all n locations
  Clone ID: cC-zmpo148010a10d1
gacgcgtgggatgctgaggctaccaacgaccttncatgtttcattttcgtacctggtgctgattaccacaggacgggtttgcccgagagtagcagcaacatcagtcaagacctgcagaacgaggagtccgcaacaacttctgatgtgaaatctgtgctgccaaagttctcacagatcaatttgcttcacaatgacctgggcctgcctgatgatgataagtcagcggggacttctattgcaaattgatctttcatatcaaggcgctccgtttgacctgagttagtgggttatggtgtacatactagttgcacccagaagtagaagtgtggcttggaaggtcaaagcagcggaagcaactgtcccatttccgtttgccggaccagatacctgtttctggtggttatcctgactttgaaatcccctgttcagctccttttgggccgagtagttaggtatttctggtggtggctgtcatgagtttttacatctagttcgctcttcaagactgagtagtacttggtgggcattctgtatttgcattgtagggttagc

SEQ ID NO: 11943 - DNA, 258 bp, Zea mays
  unsure at all n locations
  Clone ID: cC-zmpo148010a11a1
cttttcttctccatanctatttacccccccacccccccncaggggaaagctttatttaaantctacaaaccccacaaacccaacctaaaaatggaatctttaccttatttaccccccatttttactccttattaaaaaaaaggcaaacccttaaacaaatcttctccccccacacaattaaattaaacactcccctatttttaaacaaaaccattccaaacacaccctaaatgaaaaaaaaaaacccaatactaacaa

SEQ ID NO: 11944 - DNA, 472 bp, Zea mays
  Clone ID: cC-zmpo148010a12a1
agtatgaatccagcactcagaatttgggagagcgacgcagttacatttttgttttcctttcctttctcagttacatatttgtaatccaggtgaagaggatttgtggtttagtgccagccagtctgcgacgactgcggtcggtcgtcaacgacgtgctattacatatcgatcgtcgtcgtcgatgtgctattactgatcgtcgtcgtcgtccgagtccaactgtttgagcagcgaggcgcagatgggcagcggcacgtccttgaggtagccgagcgggttggcggggcgcacgttgtcgctgatgccgacgttcctggagagcaggacgccggcgcggtccctgtccgcctgcacctggtcgcagtccttgcgcgggctctccaccaagaccacctcgcagatgtcctcctcgtggctgtccttgagctcgatcgtgtacgtgcccgtccccgccgtcaccccgtcgatggag

SEQ ID NO: 11945 - DNA, 556 bp, Zea mays
  Clone ID: cC-zmpo148010a12d1
ccgggctaccctcgtcggggtctcactcaccccgccttcacgccatccttttcaaataaggtcccgcccttttccggcatgcttagtggggacaggaagatcagcccccatggcctcgattccggcgacgaccttcgccgtcatcttatccgtcctcttctgtgccgcggctggcaccgccgtcgacaacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacaccatcgagctcaaggacagccacgaggaggacatctgcgaggtggtcttggtggagagcccgcgcaaggactgctaccaggtgcaggcggacagggaccgcgccggcgtcctgctcaccaggaacgtttgcatcagcgacaacctgcgccccgccaacccgctcggctacctcaaggacgtgccgctg

SEQ ID NO: 11946 - DNA, 537 bp, Zea mays
  Clone ID: cC-zmpo148010b01a1
gttcattacacttaaatttccttttggacaataagcagagctggggtgtgtaaaacatttccctcaaagtaaaatacatgtaaaatttctggattatactggcaattaatattctccataatatcatggaacctgtttgaatatacaggaaaaaaacacgaaaaatgatccgccacttggcgaagtgagcctccttgctgattcgctgattcttatctaaaggtcctcagggccactgatatccttattcccaatcactgctccgtctgggatttctagcttgacgccaggttttgcagtgatggtcactttccccttcagtacaattccagaaccgaaccaaacatcaccggaaaccttcaagctgtcaagctcaacaatgctaggtatcgacttgaagcgaccaaggaagctcccaaccttcttgaactcaggaccaagttcaattgatggatttgatggatttgttctggctgaattacgtgtaacgaaaccatcaaccaaggtatatagatcagactgtactaactgcaaatc

SEQ ID NO: 11947 - DNA, 428 bp, Zea mays
  unsure at all n locations
  Clone ID: cC-zmpo148010b01d1
cgaacagaatgacgcacgtctctagcaatggcggacgttttgcttgccaagctgcgcgaagccaccgcgggcctgacgcagatcagcgagaacgagaagtccggcttcctcagcctcgtcggccgctacctcaacggcgacgaggagcacatcgagtgggccaagatccacacgcccaccgacgaggtggtggtgccgtacgacaccctggagtccccgccagaaggcactgaggcgaccaagaagctgctcgacaagctcgccgtgctcaagctcaacggcggcctgtggaccaccatgggatgcaccggacccaaatcggtcatcgaagtgcgcaacggatttactttcctcgacctgattgtcatccacatcgagtcactcaacangacgtacggcagcaatgtgccgctgcttctgatgaactc

SEQ ID NO: 11948 - DNA, 397 bp, Zea mays
  Clone ID: cC-zmpo148010b02a1
cctttttctttttctttctctcttttttttttatttttctatcctccccctggccgggcttcattcttattatttcattttcttcccttacaacaccgatgctcaaccccaaaatacccacccctaccctcaaacccataccaaaccaccctaaaaacaagccaaaaaaataccagctaaataaactctaaaaccatatcactgcaaaaaacattcaaccataacaaatcccaaaaaccaaacaacccaaacccacaaacccaaacccaaggatcccaaaacagtaaccaaaccacaaaaaaacccaacacgcaactaaccaactttcacgggggaaaaccttgaaacccatcaccattaaacaatataccaaacccccataaaaatacccaagacc

SEQ ID NO: 11949 - DNA, 517 bp, Zea mays
  Clone ID: cC-zmpo148010b03a1
gacgaatctagttttttcagggttctggaaggaatgataaaattctgtggggggcgtaaataataatgacatggcaggaactgtaatttgggctggaatggaatcccgtgagaagtcttgggactgcctgctaatctcgattctctctctgcagctctctcttcaccacacttctcacgcatggagttcgaggatcgctgccacaaggtccaggagcccaagttcgactgtctgctcttcggtaagccgctgctccgcttcctgcagatacgccgccgcctggcccgttgctgtctcgtttttgtatcgttctgttgtcgcctcctcctccttcttcttctgcctcttcacggaatgcaagggttttctgacctgttctcgcctacagacctcgacgacaccctgtatccgctgagctccgggatcgcgggccatgtcaagaagaacattgaacgtgaggttcctcttttcctgctgttactgaccgctgcttgttttttttacctcatctgaactt

SEQ ID NO: 11950 - DNA, 466 bp, Zea mays
  Clone ID: cC-zmpo148010b03d1
cctgttgggcttgcacaggacgggggtcttgggaagctcggctgtggcttcggagcgggcgaagtggcctccgagctctgcgatctcttgctcccggtctccctgcggcgggcacggcgggttcagggtctcgaagcataagatcctctcgaagcagtccttcaggcccagcctctccagggctctcacggcgtggaccttgtcgccgttggtgaatatctgaaacaccacaccacaccacaggttcttgagaatgtgcttgagaacagggtcgggcttgatgttgtcgtacggcagccttccgtggacgaaggcgtggtactcatccgaatcgaagctgtagccgatcgcctggggaatccatgcatgggaacctttttagttcaccgattcactagtagaaaaaaaaactgaacaattcaagggattatgaaagacccgatacacgtaccctgaggccagccat

SEQ ID NO: 11951 - DNA, 397 bp, Zea mays
  Clone ID: cC-zmpo148010b04a1
acaatcaaagcagggggttgaaacggatctcggtacacgtacctacaccttagcatgatctttccgtacaatcaaagcaacacaagtggccttaatttggcagtctttcaattcaccatgatctgaaaaagagcacgtcttatataattaaccatgcacacctttggtttcttaacgaacaagacagatccatcggattgatggatcgtgcagtgagtcgttctcctcgtcatccatcaaaggtcaccatggccggcggcggcgggcgctggcagctggccgctgttggctattaccaccttggccttgggcacgccggtgagctggccctcggcttcgatcttgcgcacgacgtccattcctttcaccaccttgccgaacaccacgtggcgcccgt

SEQ ID NO: 11952 - DNA, 423 bp, Zea mays
  Clone ID: cC-zmpo148010b04d1
acgcgtgggcggactcgtgggcggacgcgtggggaaaatgatcttagagagagagagagacgcaggacggccggggtcgatcgaggagggaggaaccagattcccggcggcggcgatcgatggctccgcgcagctcatcggcggcgacgtgcctgtgcctcgctctcgccgcggtcacgctggcgctggcccacggggcgcaaggaggaggaccatcggcatcggcggcggtcctggacaaggtcacggtcgagaccttcttggacatcgagatcgtgctgggactgtttggggacaccgttcctaaaacagcagagaactttcgagcactttgcacaggggagaaaggaattgccaagtccggcaagcctctgtggtacatggggtcgacgttccacaggatcatcccggggttcatgatcc

SEQ ID NO: 11953 - DNA, 220 bp, Zea mays
  unsure at all n locations
  Clone ID: cC-zmpo148010b05a1
gcgggcgcccttttttttttttaatgctcatttcagaaaatcagnccactaggcagcagaccgtttaaattcaaatacaccgtacgtcattctaacaacgctgcacccacaagggcaggcacgtcttcttcctgggggccggctcggagcacgaaaaccagcatcccgccaccatttatcgacatagaaaccgaaacaaagcatgccgtatataactagt

SEQ ID NO: 11954 - DNA, 201 bp, Zea mays
  Clone ID: cC-zmpo148010b05d1
ttctataccggatgctttgtttcggtttctatgtcgtttatttgtggccggatgctggttttctcgggccgggcctacctccaggaataagacctgcctgcccttgtgggttcagcgttgttagaatgacctacttcgtatttgactttgacaggcctgctgcctagtggactgatattctgttatgcgcataataaatta

SEQ ID NO: 11955 - DNA, 423 bp, Zea mays
  Clone ID: cC-zmpo148010b06a1
aaagaatggttttgaaatttcaggagtgggcataagcatggtggacagcaccagcgcagcatgtggccgtgaaatagaagcagcaagttacagatactctttatacaggtacaggtgcatacaccaaccgtggcccagacacttctgtccaggcggtcactgtttgttcagtgttatccgtgtcggattattctgccactatgagcaggcctttcctccgaagagtttcacatgtgttggagatgctactctaaaatcatcatctccaggtatgggggagaagtgaaaaagtatcatctcgactcccacaacaaggtctcaaagaataatttacacgtattttggtcctcatgaatcaattggtgcaacccttgctggcttcattatccttacaatgttcctgatgtgcttaaaccccatgac

SEQ ID NO: 11956 - DNA, 506 bp, Zea mays
  Clone ID: cC-zmpo148010b06d1
gttctcccacgcgtccggcagaaagccttcttcctttagtttgaatggtagaacttcatggtgcagatcgggttagccatgaaagaccagacgaggtgaacaatgcacttatggatctgataaaggccaccggatctgtgatgaaacctgaagagtggtcagcccagcctgagaacacatcggagactggggcactcatttccgcgaggcccattaccgtcacgatgcaaacagatgaaggtgcaaatgctgccgtagcagtctataacttgcttggcaagctgcaactaagctttctttatctcataggggtgatagtcatggggcttgagcacatcaggaacattgtaaggataatgaagccagcaagggttgcaccaattgactcatgaggaccaaaatacgtgtaaattattctttgagaccttgttgtgggaatcgagatgatactttttcacttcttccccatacctggagatgatgactttagagtagcatcttcaaca

SEQ ID NO: 11957 - DNA, 257 bp, Zea mays
  unsure at all n locations
  Clone ID: cC-zmpo148010b07a1
aanatcattcaattcaatttgtatttcttatgtatgaggtggaatacaaatataataacaaccatccatcgatctctcgatcgagtggacacgattacaaatccatcgagatcggtgtgttgtcaaactttgtgggcaagcacgcacagtgtgcatacgcaatgcaatgcatgcatggataggcagatgatataggagcattaactacttcatgggatgtcaagtttgttatccttgtaagggtccctaggcccctg

SEQ ID NO: 11958 - DNA, 217 bp, Zea mays
  Clone ID: cC-zmpo148010b07d1
caaggagaacaaacacgacatttcactttacaagagaacgctcctatatcatcgcccgtgttcattcatgcattgcattgcgtatgcacactgtgcgtgcctgcccacaaagtttcgacatacacatccaatcctctatggacttgtaatcgtgtccactccatcgagacatccatcgatgcttgctattatattcgtattccacattatatataag

SEQ ID NO: 11959 - DNA, 360 bp, Zea mays
  Clone ID: cC-zmpo148010b08d1
gcccggcctggcatcaagacacggtctaacatgcaatccaaggaaaccgaagccttttgggagaaaccgcagcggaggtgacaagaaacacgccgtccgttcattccttcctcctcaccgcttgggctcgatcagccgagcgcccgatcatgcatgttgatggttaatcagacgtttgagtagcagctatcaatcaatctcgacgtccaggtccaggtcagagctcgagacacaggaccctttatttattcatccatggctgccctccaatagcagcagcgctggcaacaacggcagcccacaacccggtggacgaagccatgggcgccttcttctctaaacaggtggaccggctgaagc

SEQ ID NO: 11960 - DNA, 482 bp, Zea mays
  unsure at all n locations
  Clone ID: cC-zmpo148010b10a1
agctctgcttctcgtagccatgaggcccgtcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtcgctgttgaagcagaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggaggagaaacaagaataggacagctccctgaaacactgccatccttctctcgttttatcaagaacaggaacggctgaacctgctggcggccccaacctcgatgggtgggtgacaacgcnagc

SEQ ID NO: 11961 - DNA, 492 bp, Zea mays
  Clone ID: cC-zmpo148010b10d1
ccggtgggttgtcacccagccatcgaggttggggccgccagcaggttcatccgttcctgttcttgataaaacgaaagaagggttgcagtgtttcagggagctgtcctattcttgtttctcctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttcattaatttgatttgatgggtctcatggctacgagaaacaaaactacttttgat

SEQ ID NO: 11962 - DNA, 293 bp, Zea mays
  unsure at all n locations
  Clone ID: cC-zmpo148010b12a1
accttcctggacgtctatcctttgttgcgacaggccggccatctggtcggcggggattgatctgatccgtatcaccgacctgctgcncataatgttctgcggggggttgaactcggagcacgtcttcctgatctcgccgggcttccccttaagaaccttgatgtctctgaacttctccatggccttggcgaagatggggacgaagtcggtagtcttgtccgacatggccttcactatgggctccgtcgtcttgtccatacacaacaagcggtccatggtgaggggcatcttct

SEQ ID NO: 11963 - DNA, 214 bp, Zea mays
  Clone ID: cC-zmpo148010b12d1
ctctccccacatttctacaagacatcatacccctacaccaacaaaaacatcattcccactctactataaatctaccaaaacatcatcccatcaccaccgacatactactcacacctcttcttcacacaactgcatcgcaaactgccacaactcctacatcttaacccaccccacatcaaaccaaacctccaacaatgaaactaaccccaacata

SEQ ID NO: 11964 - DNA, 338 bp, Zea mays
  Clone ID: cC-zmpo148010c01a1
ggataggaactgccaaaatgccttttaattattcccctttcaatcattgaaaaccccccttttgctgaacatttcctttgaagttccttgaacggtttttttggaaaaaaacaattagcttaaaaaatgccaaattaataggaatccaatttatagttccgtccattttaaatggttatcgaatgcttggccaaccggtgacaacgtacgtttaaactcgtttaaggcctgaacttaacgccacgttaccccggcgcatgcatacatgcatgcatgcatgggtcattcatttcaaggggcttcgcttcaagaaggaggatgggtgcaagacctcttgc

SEQ ID NO: 11965 - DNA, 516 bp, Zea mays
  Clone ID: cC-zmpo148010c01d1
cggcctcgctcttggtgctagccctcgcgctagtggttttcatttcccacaggtagcggaggcaaagaagaagagagcggcggagagcggcgaggcggcggaggcgaagaagatccaggacgacttctgctcgacgctgtgcgagggcaagaaggggactgacctggtcgtgtgcaaggagtcctgcgcgctctcccagcagtccaacctggtgctgtacggcaggatccagtgcaagggctagtgcaccgagcagaagggcatcacggcgccggccatgaaggtctgccaggaggagtgcgacatggcgtacgtggtgaaggcggccgtggtcaccaaggcctgcagcgtcacctgcgccaaggagatgatcccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgatcgagtc

SEQ ID NO: 11966 - DNA, 308 bp, Zea mays
  Clone ID: cC-zmpo148010c02a1
gttgaactggtccagacaaatggcaggcaagggtacaggtgtcgatccctcactcgagggaaagaacaaataacagggcaccaaattaaactggtgcatcagcgataccaattcgttaaatgaaaatcaagtagaaagaggaaggaaaaaaaacaaacaaaaggaagacgaaggtgtgccactgccaccgccgtgcccaatcagagcacgcccacgcatcgggaatgcgcgggagcagcagagcagcgcagcgcagccaagtctctccccccaccttggtctcttccctccggctccggctcctcgtc

SEQ ID NO: 11967 - DNA, 325 bp, Zea mays
  Clone ID: cC-zmpo148010c02d1
ccggacgaggagccggagccggagggaagagaccaaggtgggttttgagacttggctgcgctgcgctgctctggggctggggcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaacc

SEQ ID NO: 11968 - DNA, 481 bp, Zea mays
  unsure at all n locations
  Clone ID: cC-zmpo148010c04a1
ggcgcggccggcggtgctgcttgcccttccgccagcgccgccgccgcgggcggagtgcccgccgccgcggcgctcgtcgtctccttcctcgcctccttcctccactgagcgacgtaccgcgcggagtgcgggaaacctgggatggagcatcgcgtttggttcacccgattaataattaattaatcgttgttttatttatttatttattgcttgcggttgcctaattatgtgatcgtctgttgttccttccttcgttccttccttggtgatgtgtgggtcgccaagggggtttcgtttctgtaatcctgcctgatcgatgctaatactatgatcccaatttggtttttgcgatccanannaaaaaaaaaatatataaaaaaatttattataaaaaaaataaaaaattaattttttttaaaaaaaaattgtattaaaaataattttaaaataaaaattataaattttaacattaaaagggggg

SEQ ID NO: 11969 - DNA, 428 bp, Zea mays
  Clone ID: cC-zmpo148010c05a1
ggtggtgtccttggccgcttcgttaccgctcccctcggagcttcccttcgtttggcggcggttggacttcttgggaacggcggggaggtcctggcatgtgcccgaggcgtcgtcgccggccgacttgtcctgcttcttgcggttctttcgggtgcccttcttgctcttctccttagtcttctcctcgccctcgccgccggtggcgtccatggatgagttgccggagccccgagagcggtgccgtctcgaccggcgggtggcgggggacggtggggagtcgcccccgccgacgtcgacgcctgcctctctttacgtgtccgtgaaggaggtttctccgacgcttgctccatgcatgactatctcttgagaagcccagggatttgcagcatgcgtgcccccactctcacttctaaaagaggacgagtcaa

SEQ ID NO: 11970 - DNA, 422 bp, Zea mays
  Clone ID: cC-zmpo148010c05d1
gccgttccgctatatctcaaccatcatggatggtaaggtggcttttaatgcaaattgggttcccgacggaggtagaacacgttgcacacatcggttgggacggtcctggctccaccaacaacaataacaacaatcacaacaacaatagtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctccttcagggacacgaaaagcgaggcatgcgtcgacgtcggcgggggcgactccccaccgtcccccgtcacccgccggtcgagacggcaccgctctcggggctccggcaactcatccatggacgccacc

SEQ ID NO: 11971 - DNA, 329 bp, Zea mays
  Clone ID: cC-zmpo148010c06a1
gcaagaaagccttttcaccattttatacgatgtctccctctatttaaaagttgggttgggttcttaaacttggacattgcaatgtcctttggggcatgaaatttacatcatgtatatattttgaatggaattattcatccacactagtaaaatgaataaaaaagttcgcagattgccaaaggcctaaaaaaagactggcgagagtgaaaaaaaaagaggtgaccaaaagtgagtgatggatgcaagtaggttcaaacccaagccagctccttcgccatgccaatggacttgccgatggccttcttgcagacggacatggtcttgttgtc

SEQ ID NO: 11972 - DNA, 457 bp, Zea mays
  Clone ID: cC-zmpo148010c06d1
tcaactgctccagcaacctgccctgccagggcgtgcagtacattttcgtcgacatcaagtacatcacggggctaggctcaagaccatgtccgtgtgcaagaactccatcggcaagtccattggcatggcgaaagacctcgcctgcgtctgaacctacttgcatccatcactcactcttcgtcacctctctctttctcactctcgccagtctttttttaggcctctggcaatctgcgaactttcttattcattctactagtgtggatctataattccattcaaaatatatacatgatctaaatttcatgccacagaggacattgcaatgtacaagtttaagaacacaacccaactcttaaatagagggagacatcgtataaaatggtgaagcggttttattgcataaaaaaaaaaattataatcttctgtaaattatttataaaaaaaagggcggccg

SEQ ID NO: 11973 - DNA, 310 bp, Zea mays
  Clone ID: cC-zmpo148010c07a1
ggtaaatctaaacatatataccatctcatgattgcagggcttacttgacacaaatcgataaattacatcacgtctatgtaattaacacaacccgtcaccatacatatatattcatatcacatcacatcaataataatatatggaaacagcggtgcatgtgacgtcttccaagtcgaccaccgcatcaacagtcaccaagaacgagcgaggcaactgcaatggcaacggtggacggatccatcgtcttccatgcgcgcgtacgtaagcacacacactcttattggaggtaataagctaggagggagaagag

SEQ ID NO: 11974 - DNA, 358 bp, Zea mays
  unsure at all n locations
  Clone ID: cC-zmpo148010c08a1
ggttaacaaagggagtttgttaaaattccccctttatcgtttacttaaaaaacaggatcctttcacttgacttcaattatgatgcatgtcctcccaaactttacaaagccatccggctttttttcccctaccatcgaatcgaaccaacatgaactaccctgaccccgtgctttaaaaagttccttttcctgccaccaggaggcaattgcgacaggaacagcagctaccatccatcaggtcacctgtttgtttcancacctggagcaggacccggagggaaattcccccactgcagttgcagctgtattttcccgcttttgaccttcctgagccggaggatcattttctgcgcgaactt

SEQ ID NO: 11975 - DNA, 459 bp, Zea mays
  Clone ID: cC-zmpo148010c09a1
agtgcgtatagcacgagcgcaaaacgatatcaggtacgtacagttgtttgcaaagtgacgaagaacatacaaggtgacatgaccacaattgtttgcagtgttgacacgagtgggctcatacaatagacaatacatatgtcgcacttcgatcccgtcttcttaacaaccagagcacaggaccgcgggggtataccgtgttcgatatcaagaggccgcggtgcggtgctttgaccggctagttgtcggattgcatgctcctgagcatgttcaggatggagaggaacaggttcaggatgtcgaggtacagcccaaccgacgcccagatgtactcgtcgtaggtgtggcgcctaatcaggttctcggtgtcgtacaggatgaagcctgagaagaccagagcccctagcccaccgaacaagcccaccgacacgggtcccagtgggaagaaaaccttgagaaagc

SEQ ID NO: 11976 - DNA, 507 bp, Zea mays
  unsure at all n locations
  Clone ID: cC-zmpo148010c09d1
gatcatgtccgcccacgcgtccgcccacgcgtccgcttccccgcaccgcactttaccttacccccgtcggagagagagatggcgtcgggggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgacgtctccgccctcaccgttctccaccccaccctcaacgccacgctctccgactccccgggcctcgcgctcgtgctcgccgtcctgcccttcatcctgatgatcccattgtatcattatcagcacaagcacccacacaattccgttttcctgggtctgttcacgttgtgctngagcttcagcatcggcgtggcttgtgctaacacccaagggaaa

SEQ ID NO: 11977 - DNA, 473 bp, Zea mays
  Clone ID: cC-zmpo148010c10a1
accaacgggcgatggggttatggtgctaccaggtagataaactctggagctatagcatggcaatctgcattgaacgataccatattctatctcccgttcaatgcgtgcgtgcgcgcgcaaacacaacgcatggtggccgggggccggcgggcagcggcgcccaacacgcaactaaggggcggagacgggggcggggcttggagcaagtgactcggacacggtatccttggccaccttacccttacccaccaccactgcttctacgggcttgcgcgggatcatgttggaatcctcatgggttgccgctgatggcttgatcttgcgcttaccacccttgccgcggcggccgggcgccccgacgggggagggcaacgcggccggcaaaatgggctcgctgatctccatgatggacacagagtacggccgcgctgcgacgaccttgacgagcttggccacgcagggggctccgggag

SEQ ID NO: 11978 - DNA, 575 bp, Zea mays
  unsure at all n locations
  Clone ID: cC-zmpo148010c10d1
cgcaccgccatcgtccccacgctgctctccgtcaccgatatgattctcggcgtcctcaactacaccagnggggaggactggcagatgtacttcggcgctcccggagccccctgcgtggccaagctcgtcaaggtcgtcgcagcgcggccgtactctgtgtccatcatggacatcagcgagcccattttgccggccgcgttgccctcccccgtcgcggcgcccggccgccgcggcaagggtggtaagcgcaagatcaagccatcagcggcaacccatgaggattccaacatgatcccgcgcaagcccgtcgaagcagtggtggtgggtaagggtaaggtggccaaggataccgtgtccgagtcacctgctccaagccccgcccccgtctccgccccttagttgcgtgttgggcgccgctgcccgccggcccccggccaccatgcgtcgtgtctgcgcgcgcacgcacgcattgaacgggagatagaatatggtatcgttcaatgcagattgccatgctatagctccagacgttatctacctggtagcaccatgacacgatggcccgttcgttaaaa

SEQ ID NO: 11979 - DNA, 435 bp, Zea mays
  Clone ID: cC-zmpo148010c12a1
ctgatccttaagcggccgcctttttttttttattcagatgataaacaatggggaggttaaacaaaggcagcatatcaaggtaatccctttcagggaagaacatacggcatcataatcgtaattaagaaagaggacaaaaaaaagacaagggtgcaataaaaacatcccccatgaatgcccaccatgtactctttcccttgctttctcgctcggcgaccgccgcgcgctactgaatgataggcgaaaagagcgacgcggcccaggcgcccgacgcgcgcgacgcgagaccgtgtggggcccggaccgacctcgggcagcccacgggcgcaggcggcacagacgccagccacttttattcatcctaatgcgggcgcgcgcggacgaacgaacaacgagcgagaaagacgcgcgcagcactgctgtgctgctgctact

SEQ ID NO: 11980 - DNA, 586 bp, Zea mays
  unsure at all n locations
  Clone ID: cC-zmpo148010c12d1
gcccggggacgcgtgggcggcgggagcacagagctagctagccagctagcctgcagccagcttgctcgccgcgcccagcctggtttctcgcctccgttccgttccgtcccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttctttgttccctctttctccttaatttaacgaattgatgcatgccgctgatgttctttcccctgagagagggattaacacttgtattatcgcttgccatttggtntgaatccattcaacaattcgatttaatcaatcatcgcgtat

SEQ ID NO: 11981 - DNA, 426 bp, Zea mays
  Clone ID: cC-zmpo148010d01a1
cagcagggaaaggtcttttgatcagccggccacccgtaggtacagtacagtactgggctgtgacatgatttaaggccagggatgccatgccatccatataatatacacagtttcatttacacgagcatcctacgtcctcctaataattagtaataaataatccctttgagcaccaccaccacgattaattagaaagagaaagaaggacaggcaaggtgtgtgtttgaagattgcttaattagctgcacagatttggagtacatgccccgtctggtgtctgctgctctttccagatccgtccggtgatcctgagcttgagctccttccggtccccgccggaaaagaagagcgccatgttcctctggatgatgaggccgtcgtggctgtccctcaccttgcggtggctgtcgcggacgctccttgggg

SEQ ID NO: 11982 - DNA, 586 bp, Zea mays
  unsure at all n locations
  Clone ID: cC-zmpo148010d01d1
agggagcggaggcgggcgggccggcgggcggccatggactttgactgcgtctcgctgcccgacgccccgggggtcgacttggatggcggcgccgcccggccgtggcccaaggccgtgaccaacggcggcgtccacgagctgctggagtgccccgtgtgcaccaactccatgttcccgccgatccaccagtgccccaatggacacacgctgtgttccacatgcaaggccagagtacacaaccgttgccctacctgcaggcaagagctgggcgacatcaggtgcctggcgctggagaaagtcgccgagtcgctggagctcccctgcaggtactactcgctggggtgccccgagatcatgccttactacagcaagataaagcacgatgcgcagtgcggcctgagaccgtacaactgcccctacgccggcttcgagtgcggcgcggtcggcgacatcccttncctcgtctcccacctgatggacgaccacaaggtggacatgcacagcngctgcacctttaaccacatatacgtgatatccaacccgcgggaggtggagtacgccacctggatgctgacggctgttcact

SEQ ID NO: 11983 - DNA, 339 bp, Zea mays
  Clone ID: cC-zmpo148010d02a1
cttatatataatgtggaatacagggctgggacaagcatcgatcgatctctcgatcgagtggacacgattacaaatccatcgagatcggtgtgttgtcgaactgtgtgggcaggcacgcacagtgtgcatacgcaatgcaatgcatgcatggataggcagatgatataggaacattaactagttcatggatgtcaagtttggtatccttgtaagggtccctaagcccctggttagcagcgatctccttgcacctcttcatgcaggccttcatgctcatgtggagtgggcccgtgaacttgttacacccgggcttgcaatccatggccgtcgccggagggg

SEQ ID NO: 11984 - DNA, 421 bp, Zea mays
  Clone ID: cC-zmpo148010d02d1
aaccaaaccgacgatggcgtcgaataagacggtcctcattgactttgcgatgcttctcatcacgctcgtggtggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggattcgtaatcgtgtccactcgatcgagagatcgatcgatgcttgtcattatattcgcattccacattatatataag

SEQ ID NO: 11985 - DNA, 267 bp, Zea mays
  Clone ID: cC-zmpo148010d03a1
ggggaaggtttaaagaggtcatttggattcgagatatatagaatttcttcccctttccctttctttcccctgtaaatccaagcgaccgacacaacttgcgagcaattttcagcgagaaaaatgcgaaacaccacgcacattatttcatcaatcgggccccggggcccgggacccgtaaggatctttcgggctccttcaagtcaagctatggccgtggcctaaccgccttctggccagctggaacgtgcgctctaagaactggttggc

SEQ ID NO: 11986 - DNA, 499 bp, Zea mays
  Clone ID: cC-zmpo148010d03d1
ttcctggtgtccgtgctcgcggaccgccgcagcccgtggcggtgcttgatgttatgcgcgcctccttcgaggcgcgggtgagggtgctcctggcgggcggcaacgagcggagcttcgtgcgcgccgaccacgccacggtggaggaggacttccggagcctgaggcgcgccttctccacgtgcggggaagggctggtccccgaggacgtggtggcgcgggaggcagagacggccgaggccgtcgtggagctcatggcacgctccacggactacctcatcgacgcgttcagcgtcgccacgtgcgactccatcagcgaggacggccgcgccggcgcaggcgggtgcacgccgctgccgtccacgacgcggacgtgggaccccgccgacccgaacaccatcctccgggtgctgtgccaccgcgacgacgaggccgtcaaccagttcttgaagcgcacgttccagctggccaggatgcggtgaggccacggccatagcttgac

SEQ ID NO: 11987 - DNA, 443 bp, Zea mays
  unsure at all n locations
  Clone ID: cC-zmpo148010d04a1
gattcgtcactgggactggacattaatcatgaaaagctgggccacgtacatcaaatcatcaatcgattgaacgcaagaaacgtcggctttcacatgcacacacggtacgagaacgacacgacatatatatatagctccggctgcctgcatcgatgacggttgatcagtcgcggcacttgtccatcttgctgcagccgcgggtgtacttgttgaccggcttcccggggcgggtggcctccgggcccttgttcttgtcgcagttgcccagcaccctgcagctgatcaacttatcgtagggcgatgccgtcttcctcctcccgtcggcgccggagaccccctgcggccccgccgccagcagcagcagcaggcacagnagcaccgccgtcgtcgccacggtcagtctcgccgcgctcacgcccgccgccttntccatatgtactact

SEQ ID NO: 11988 - DNA, 483 bp, Zea mays
  Clone ID: cC-zmpo148010d04d1
cctctctgtagcttgctactagacgacagctagatctatttcctcaacgacgtcgcagtagttcgggtggggtaggcggcgggcgtgagcgcggcgaggctggccgtggcggcggcggcggtgcttgctgtgcctgctgctgctgctggcggcggtgccgcagggggtctccggcgccgtcgggaggaggaagacggcatcgccctacgataagttgatcagctgcagggtgctgggcaactgcgacatgatctagggcccggaggccacccgccccgggaagccggtcaacaagtactcccgcggctgcagcatgatcgacaagtgccgcgactgatcaaccgtcatcgatgcatgctgcctgagctatatatatatgtcgtgtcgttctcgttccgtgtgtgcatgtgaaatgccgacgtttcttgcgttcaatcgattgatgatttgatgtacgtggcccagcttttcatgattaatgtt

SEQ ID NO: 11989 - DNA, 545 bp, Zea mays
  unsure at all n locations
  Clone ID: cC-zmpo148010d05a1
aattaataatgggtattgattaatttccaatggggatgtccaaacgaatagtgtctcccattctcccctctttacatatcgaaattaacagaaaagggagaaatggcaaagcaaataaaatgaatggatcaatcnacatgttcagacccaaattaaagtacttaaatatatatataaacggaatccaaccgaatacaggcaatggcagccagcagcctctccctccgatcctcctttaattttactgcaggtagtaggcgaagaaggagagcacggaggcgcccagcacggcgccgacggccgggaacgcggccgaggaggcgctggtgggggcgggcgccggggcctcggcggcgaggaccacggtggcggaggcggcggcggcgaggacggcgcaggcgaccttcttcatctccatcgcgacttgatgtggtttgccggagccgaacggagcgtcgtcgggatcgagacgaggaagaacgaagggcacgcacgcttattagcaagatggatcaacggatgatcacacttgctattattggttg

SEQ ID NO: 11990 - DNA, 398 bp, Zea mays
  Clone ID: cC-zmpo148010d05d1
ggcaagggcgcaagcaataatagcaagtgcgatcatccgctgaactttcttgctaataagcctgcgtgcgggtcgggcttcctcgtctcgatcccgacgacgctccgttcggctccggcaaaccacatcaaagtcgcaatggagatgaagaaggtcgcctgcgccgtcctcgccgccgtcgccttcgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgttaataatatattaaagtac

SEQ ID NO: 11991 - DNA, 422 bp, Zea mays
  Clone ID: cC-zmpo148010d06a1
attcggttgccatacttatacattaatcatcaaggggggatccacatacatcagtatacacctcagatatgcgaggcaagaaacatcagttgccatgcatacagtaaccatcgacgaccaatgtataatgcatgtgtgtaatatatacacacacgcggcaccacacgctgaggcctggtacctgcacgcgcgtgcgacattgacattgcgcgcacatcgaccagagagatatgatcagccgcgacagccggtgatcgggttgcagccgcgggtgtagtcgttggcgggtttccctgggcgggaggcctcggggcccatgttcttgtcgcagttgcccagtaccttgcagctgatcaaattgtcaaatgacaccatccccttggcgctgatggccccctgcggccctgtcgctaacaggaagc

SEQ ID NO: 11992 - DNA, 379 bp, Zea mays
  Clone ID: cC-zmpo148010d06d1
tgttagcgacagggccgcatggggccatcagcgcctaggttatggtgtcatttgacaatttcatcggcttgatcgtactgggcaactgcgacaagaacctgggccccgaggcctcccgcccagggaaaccccgtcaacgactactcccgcggctgcaacccgatcaccggctgtcgcggctgatcatatctctctggtcgatgtgcgcgcaatgtcaactgtcgcacgcgcgtgcaggtaccaggcctcagcgcgtggtgccgcgtgcgtgtatatattacacacatgcattatacattggtcgtcgatcgttactgtatgcatggcaactgatgtttcttgccttgcatatctgaggtgtatactgatgcatgtggct

SEQ ID NO: 11993 - DNA, 431 bp, Zea mays
  Clone ID: cC-zmpo148010d07a1
gtcacatctttatatataacaggggttcgagtacaaaataaataattacattataaggagacaacggtccagcaacccaaagttgactgggagacgacgacctagaccactcacgaactcatcgcagcatcttccatgagcatcatcctacagtacctggtcttgacctgggacttgagatttcaggtaccaacttgctcttcaggtgacacgtgtcctcacttggattatgcgcactggtgccctgaccacggcgcacggcggaatgccccagactacacgacgtcggcgagcaatccccatgctccacaagtcctcaatatccgcatgtgaggtcgcgaacgtgttcggtgtgctctggagactttccttgaccatcaaccagcccaaagtaaagctcctgacgggatgcccatgcgagcggacataca

SEQ ID NO: 11994 - DNA, 477 bp, Zea mays
  Clone ID: cC-zmpo148010d07d1
tgtcgtttgaaagcaccatggggagatgtatgtcttctcttttgggcatcccgtcaggagctttactctgggcttggttgatggtcgaggagagtctccagagcacaccgaacacgttcgcgacctcacatggcggtattgaggacttgtggagcatggggattgctcgccgacgtcgtgtagtctggggcattccgtcgtgcgccgtggtcagggcaccagtgcgcataatccaagtgaggacacgtgtcacctgaagagcaagttggtacctgaaatctcaagtcccaggtcaagaccaggtactgtaggatgatgctcatggaagatgctgcgatgagttcgtgagtggtctaggtcgtcgtctcccagtcaactttgggttgctggaccgttgtctccttataatgtaattattcattttgtatagaactcctgttatatataaagatgtgacattcgatccaaaaaaaataa

SEQ ID NO: 11995 - DNA, 509 bp, Zea mays
  unsure at all n locations
  Clone ID: cC-zmpo148010d08a1
gaacataataatgtgaatatactggataggttaataaaataatgaaccttgagtacatgaacaagataatgaaccttgagctcattagaagataattcatacatgaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaaaaataggttgtcgatgcatggcaagcgatcganccatcttgtttagcactgcctagtgcacatgcagcggcggcggaaggtgctgcacctgccggccaagaagccctcaccgcggcacacattggcgcagttgtctgcgatcatgcatgccccaacaaatcgctcactgtacttctcgcattcctttgcctgtgccatatcggtggacacaatgagcaggagaagcaggatga

SEQ ID NO: 11996 - DNA, 536 bp, Zea mays
  Clone ID: cC-zmpo148010d08d1
ttgtgaatggatagttcgtgaatccctgaagcggtatattatattcctgcaagataaaggcagccgggcttcacgcaggttccagccgggcgtcatcctgcttctcctgctcattgcgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttacgccgacgctgcatctgcactaggcagtgctaaacaagatcgctcgatcgcttgccatgcatcgacaacctattgttaataacgttcattatctcgttcttatttatgacgaatgtcatgtatgttctggtgactgtcatgtatattctgatgactgtcatgtatcttgttcatgtatgctcaaggttcattatcttgttcatgtattaagtatgttatgaataactcaatatttattattttgatcatgtatgaattatcttctaatgaactcaaaggtcattat

SEQ ID NO: 11997 - DNA, 641 bp, Zea mays
  Clone ID: cC-zmpo148010d09d1
aaaaaaacagacaaagacaaatacaaaaaaaaactaactaaaaaaaacaaacacaccccccggccagcttaaaataaaaaaacagaaaagacccaaccaaacaaacaataaaaaccaaaatcaaaaaacacaaaaaaaaaaaacaccaaaaaaccacaaataaaaacaacaacaaaaaacaaaaaaaaaaaacaaaaaacaaaaaaaaaacacaaaaaaaaaaacaaaacaaaaaaacaaaaaacacaaaaaaaataaacacaaaacaaacaaaaaaaccaaaaaacacaaaaaaaacaaaaaaaaaaacaaaaacaacaaaaaacaaaaaaaaaagggagaacaaaacaacaaaaaaaaaacacaaaaaataaaaaacaacaaaaaaaaaaaaacaaaaaaaaaaaaaaaccaaacaaaaaaaaaaaataaacaccaaaaccaaaaaccaaaaacaaacaaaaaaactaagaaaacaaacaccaccaacaaacaaaaaaacacaacaaaaaaactcaacaaacaaaaaaaaaaaaacaaaaaaaacaacaaacaataaatcaaaaaaaaaaaaaaataaacaaaaataacaaataaaaaacaaaaaacacaaaaaacaacaaaaaataaacaaaaacaaa

SEQ ID NO: 11998 - DNA, 505 bp, Zea mays
  Clone ID: cC-zmpo148010d10a1
atagaatacccatagctgggtttaactgaactgaggggcacgcgccatagcaggcgagcagcactaaagatcgagattaacatttctccactcttcaattacagagcaatagagcatttctcggggctggaaaaacgaaatgctagagatgctgcaacaaacgaggatcaccagtattgggtatagttaagtttggtcacaaccaccaatcaggtaccaacccggatagaaaatgctagcttccaagtggaagtggcacgattgggactgcttccttctgatgatttgaacattcagcgaaaagataaaattcagaaatgactgccctcttttttttggatgttttttataatatccattacaaagcgaaatccaaggttgcctgctcggtcaacgaactccaatcgaactcagcaatgtttgctcaaagatacgtttgagtttccttacacatgcagccgagtcagtaagtacgacaacctcataagtttggcaatcgcgcgcc

SEQ ID NO: 11999 - DNA, 508 bp, Zea mays
  Clone ID: cC-zmpo148010d10d1
ccggcgcgcgattgccaaacttatgaggttgtcgtacttactgactcgttttgcatgtgtaaggaaactcaaacgtgtctttgatcaaacattgctgagttcgattgcagttcgttgaccgagcaggcaaccttggatttcgctttgtaatggatattataaaaaacatccaaaaaaaagagggcagtcatttctgaattttatcttttcgctgaatgttcaaatcatcagaaggaagcagtcccaatcgtgccacttccacttggaagctagcattttctatccgggttggtacctgattggtggttgtgaccaaacttaactatacccaatactggtgatcctcgtttgttgcagcatctctagcatttcgtttttccagccccgagaaatgctctattgctctgtaattgaagagtggagaaatgttaatctcgatctttagtgctgctcgcctgctatggcgcgtggaactaagttcagttaaacccagctatgggtattcttt

SEQ ID NO: 12000 - DNA, 433 bp, Zea mays
  Clone ID: cC-zmpo148010d12a1
cagaaagggaccccatcgtacggaggagtgcgcaacacgagcatacaatggaattcctgatgaactgtgcaggaacccgatcatttgctacagaaagtaaaggaaattccttctgaaattggccccgatcgaagatagccaatggttaataatcggctggccatcttcttcggataatcaggtgtacacctacgtacctactaataggtacagaatcttccccgtggggtgatcttggcgatcgaacaggggcagctagtgcatgctgcatgcatcaatcgtcctgcagaatcctccgcttgagcatctcggcgcgcaggtcggcggcgtccacctccttcgtgccggtgaccggacggtagtatccggtctcggggtcaggttcccagaacgccgtcttctcctccgtcgtggtggccatggcgctggcgat

SEQ ID NO: 12001 - DNA, 570 bp, Zea mays
  Clone ID: cC-zmpo148010d12d1
gcccgggtcgttatcgtcggcgtcgtgggccttcatttctcctagattgtttaaggtcgagaggagaagaaggcgaggcgggggttccgtcgggcaccgatcgagaacagggaagcaagaggctgctagagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaggtggaggacaaggcggtgaagctgggaactgtggccaaggacatcgccagcgccatggccaccacgacggaggagaagacggcgttctgggaacctgaccccgagaccggatactaccgtccggtcaccggcacgaaggaggtggacgccgccgacctgcgcgccgagatgctcaagcggaggattctgcaggacgactgatgcatgcagcatgcactagctgcccctgttcgatcgccaagatcacaccacgacgaagatactgtacctagtagtacgtacgtacgtgtacacctgattatccgaaga

SEQ ID NO: 12002 - DNA, 398 bp, Zea mays
  Clone ID: cC-zmpo148010e01a1
gaagcaaccgctagcaatcaatggccatctccctcatttcatgagcaacagaataaatgcaggtcagggacaattacacagagtttgctcaacgtaactcgtaatttcaatgaattcttaaatgaaaaccaagtgctcatcatgtccaagcattccctgcttgcggcgcgccgccacctcatgctggagtgtaagaacatgccaaacagtcgtccccggccgcatatgattcatatcatgtttgcaagcgtcatgcagttgttggccatctggctgagctccttatcgaacttacccatggggttggggacaccggcatgggtgaacggacggtcacacgagtcgaagtcctggacagcgagctgcagcatgatcttcgcggtgcccgtgtccttgaa

SEQ ID NO: 12003 - DNA, 586 bp, Zea mays
  unsure at all n locations
  Clone ID: cC-zmpo148010e01d1
cgaacatgaataaactatggggcaagcctacccacggcttttccttctcgccctcgtggcgttgttgtctggcgggctcttcccgcaggcgttagggaacggcaagggcaaggtgcatggcggcggtgccgtcaaccccgctggttgccggcatctgctctcgcgccccattcccagaggtttgcacggccacagccgggcgccatgcatccaagtacccggtcatcgacaatttggccgtgctgaacatgcaggtggccgcgttcgccaagcgcacagcgcaggcgcggaagcacgtcgcggtggcggcccgcactattccaccgccgcaggcacaggccctcaggacctgcgacacgatgtacatgaacacgcaggacgccatcggcgcggcacagcgagccatcgcgttcaaggacacgggcaccgcgaagatcatgctgcagctcgctgtccaggacttcgactcgtgtgaccgtccgttcacccatgccggtgtccccaaccccatgggtaagttcgataaggagctcagccagatggccaacaactgcatgacgctntgcaacatgatatgaatcatatg

SEQ ID NO: 12004 - DNA, 530 bp, Zea mays
  Clone ID: cC-zmpo148010e02a1
atattactatacggaaaaagggaggagtacatgcatattatgtattttctgctgggagtaaaaggtgttgtaaaaccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcgtagacgggggcggggcttggagcacgtgactcggacacggtatccttggccaccttacccttacccaccaccactgctttgacgggcttgcgcgggatcatgttggaatcctcatgggttgccgctgatggcttgatcttgcgcttaccacccttgccgcggcggccgggcgccgcgacggtggagggcaacgcggccggcaaaatgggctcgctgatctccatgatggacacagagta

SEQ ID NO: 12005 - DNA, 515 bp, Zea mays
  Clone ID: cC-zmpo148010e02d1
ggaccttccctgcaaagtaccgcgatggctcccaagattctattcatccttgtgttcctcgccgtggcggcacgggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggcgcccactgcgtggccatgctcgtgatggtcgtcgcagcgcggccgtactctgcgtccatcatggagatcagcgagcccatttt

SEQ ID NO: 12006 - DNA, 155 bp, Zea mays
  Clone ID: cC-zmpo148010e03a1
aaaagtacatatacatcccatcaacaatgtacatacatatatttacaaattaaaatcaagcaaacgctactaactgctaacacaaccttagattcttagaaggtattatttatcaacaacattatacaaataaatgtaccttgcatagtaacaca

SEQ ID NO: 12007 - DNA, 399 bp, Zea mays
  Clone ID: cC-zmpo148010e03d1
ccagccggctcctgcctcctgttcgttattttactgttgctattgatctctactacggcggcgcgactgcttcgacagttcagtcgcggcaggcggcgctcacctctcgccaaagaggctctggattcccgtcgtgtcggatggatgtgctgaggccggacaggacggccggcgaagcttgggcgccgtcggcgcccaaggccaacagcaacgtcccaggagggcccttcggtcgtcgttgactcatccacatccagtcgcacccgcccaatcgccatcgtttcatgacacatcgaccagaagatagctagcaattcccatctcactggcgtgtgtcattttagcttcttttaacgatgaagaacctatggcgatgattgaaataatacaacttattgc

SEQ ID NO: 12008 - DNA, 486 bp, Zea mays
  Clone ID: cC-zmpo148010e04a1
gtctgatagagagttagagaccaaatgaggcagattcattagttacataacggttgaccccataatgttacaagagcaaacgaagtgagcaaagcaaagaaacacttggtccctccctccccaccagacgagagcgattacagcacagccaattacgtgtccaccctaatgtctcaccgcgacacgaccatcgtcggtgagtttagtagaagaagatcatggtagcaacagcagcggcaacgccggcgatggcagctccacttccaagggcagcagcaccggcggagtcatcagcagccggtccctcagccgcaggggacgccgcggcggtggatgctggcggggaagggctcaactcctcgtccgtggaaaaagagggtgtataggcggtggctggcgcggtagctggaccagacttcctatacgacggcgatggggcaacggcggcgacgggggtggatgcggcttccggtgcttagcgggggc

SEQ ID NO: 12009 - DNA, 526 bp, Zea mays
  Clone ID: cC-zmpo148010e04d1
ccttcgtcaccatgacatccagccagccaacaaatttgaccttgcgtcacagctgcggtgctcttctgcatcgtctccgttgctgccctcagcgcggccgatgccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgtctctacaccctcttcttccacggacgaggagttgagcccttccccgccagcatccaccgccgcggcgtcccctgcggctgaaggaccggctgctgatgactccgccggtgctgctgcccttggaagtggagctgccatcgccggcgttgccgctgctgttgctaccatgatcttcttctactaaactcaccgacgatggtcgtgttccggtgagacattaaggtggacacctaaatggctgtgctgtaatcgctctc

SEQ ID NO: 12010 - DNA, 334 bp, Zea mays
  Clone ID: cC-zmpo148010e05a1
aagcggggggggcaaatatcactgtccttcaaagttccaacctccgttttagtcatgcatcaacacatagcacaagcagactaaaaaaacagtgaatcaccggccaaatccagtagcattgagaccaagcagcatctttccgttttccccaaaaggaatgtatgccacattcggtgagcgagccagctctgcggcaatctccttggccgcctccatcctcctgagctccatcagccctgtcccaaccatcgccgtggcctcaaagatgaggcgcgcggactcgctctttccctcagcgcgcacgatggccgcccgcctttcctgctccgccttg

SEQ ID NO: 12011 - DNA, 453 bp, Zea mays
  Clone ID: cC-zmpo148010e06a1
atgcaacaattcggttgtcgtagttaaaaattacaaaacaatacccaaacaacaaacatagaaacaaggtaaccccgaataggatgaatcgaaaagcctaaaaaaccctaaggagagattcagagactcgtaataaggcgtagtcattggctcccacaaccatgcatgcatgaccatattaaactcagagcgatcgtggtcgtttagaaacaaagcatggcggaggacgtgacggtcgcgaccagcatgaccagggcaaggccagtgccacccaacatgctcgggctgccgctctcgtggtcagcggccgggccaggagactccgctggcgagtctgaagaagtgtgggtcggctcaggcgggctgtcggccgatgcgccgccggcctcggccgtcgacggctcctctgcggcaccagcctcgctggcggaaggctctttcgaggcggcacca

SEQ ID NO: 12012 - DNA, 491 bp, Zea mays
  Clone ID: cC-zmpo148010e06d1
cgtggtgccgcctcgaaagagccttccgccagcgaggcttgagtcgcagaggagccgtcgacggcctaggccgggggcgcatcggccgacagcccgcctgagccgacccacacttcttcagactcgccagcggagtctcctggcccggccgctgaccacgagagcggcagccctagcatgttgggtggcactggccttgccctggtcatgctggtcgcgaccgtcacgtcctccgccatgctttgtttctaaacgaccacgatcgctctgagtttaatatggtcatgcatgcatggttgtgggagccgatgactactccttattacgagtctctgaatctctccttagggttttttaggcttttcgattcatcctattcggggttaccttgtttctatgtttgctgtttgcgtattgtcttgtaatttttaactacgataaatgaattgttgcataaaaaaaaaattaactattctttaaaaataaagggc

SEQ ID NO: 12013 - DNA, 462 bp, Zea mays
  Clone ID: cC-zmpo148010e07a1
ttcttcctttttctttcttttcttttttcctcttccccttttttgtggcgtttttattttattttttttcttccttttccccaaccacaaaaaaactttctgtttaaacacttaaacatccgccccccgtagcaagccaactctattacactgtcaatatttacaacaccccaccacacttcacctttttggttgcgtgcaacacccacaattacaacattcacacttgcctcacccctttttctttaaatatttccacaccccacaggcgaaaaacccaacacccaaccatttattggatataaccaccaccccttttccaataaacaagggatcatccacctttttaccgtggtcaacccccaaaaaaacaaactttctctcccccaaattctaaggtaaaactcctcttgcaggccccacatcgaatccccaaataccaaaccccagcaaatgcttttt

SEQ ID NO: 12014 - DNA, 494 bp, Zea mays
  Clone ID: cC-zmpo148010e07d1
acgccgcggagggcgagagtggagtggtgatgctttcgtgttcgacgacgcgaagcgcgcatcggggggccgaggcgctcggatgcttttctacccgacgctggcgtacaacgtcgtgaggaatcggttcgagaagcactttcactggtggcatcagatcgatgagcatgtcctgctcggtgctgttccattccctagcgatgttctccggctaaagacgcttggagtttgtggcgtggtgacacttaatgaatcatacgagaggcttgttcccacatccctgtacgaggctcatggaattgaaaatctggtgctaccaacaagggattacctttatgcgccttcatttgttaacctttgtgaagctgctgactttatccacagaaacgcttcatgtgggaaattgacgtatgtgcactgcaaagctggacgatggcgtagcactacagttgtcatttgctatttggtgcaatataaaaatatgactcctgctg

SEQ ID NO: 12015 - DNA, 263 bp, Zea mays
  Clone ID: cC-zmpo148010e08a1
ttttattcttccatctttttttccacctttatttttttttgtttgtttttattaaaaaaaccaacccgaccccccccacgtaaatttctatccaaaaaattaaacctaaacaaaaaaccaaaaaaaaaatcctaaaaaaaacacaaaaaaacaaaaaaaaaaaaaaatcctaaaaaaaaacatataaaaaaaaatatccccaccaaaaaataaaactaaaaaaaaaacttaaaaacaaaaacaacaaaaaaaaagaactaacc

SEQ ID NO: 12016 - DNA, 222 bp, Zea mays
  Clone ID: cC-zmpo148010e08d1
aaaaaaaaaaaaaaagaaaaaaaaaaaaaaaaaaaattttaaatcaaaaaaaaaaaaaaaaaaaacccagcccagcccaattaaaaaaacccaaccggaacaacccaaaaaaaaaaaaacaaccaaaaaaacacaaccaaaacacaacaaaccacaacaacaaaaaccaaaaaaaccaaaaacacaacacacacaaaccacccaacaaaaaaaaccaaacaa

SEQ ID NO: 12017 - DNA, 462 bp, Zea mays
  Clone ID: cC-zmpo148010e09d1
atcgacctccggacggccgacggcgacaccaactatatttacatgcttcaagtgcagccactggggacagatcctctcgatgtgcagctactgttccatggacggcgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagcgtgcagcttgccagaaaacagtgtacccgctggagaagttaactctggaaggcgagtcctaccacaagagctgcttcaagtgctcgcacgggggctgcattctcaccacctactcctacgccgcgctcaacggcgttctgtactgcaagatccacttcgcgcaactgttcatggagaacgggaactacagccacatgatgaa

SEQ ID NO: 12018 - DNA, 372 bp, Zea mays
  unsure at all n locations
  Clone ID: cC-zmpo148010e10d1
gcgagcaaacctagtccgagaaccccacncccgtcacacctttattgccgtcgccgccgccgtcaccgccggagagcttttatctgcatctacatccgggcctccccctccgtgctctcgttcccaacggccgccgcgttcccagcatcctccaccgccgacaccggggcccccgcctgcttcgctctcggctacctcctgaccttcacccacctcccacgccacgccgccggcccatgttcaggaggtaccttctatgactattccgaggatcactcgtaagaacattatgacgaacactccagccgcactctcacgtgtaatcaatcctaacgacataaaaggcccctactcccgttgctctactgcgca

SEQ ID NO: 12019 - DNA, 409 bp, Zea mays
  Clone ID: cC-zmpo148010e11a1
ggtatttttttttatagttttcttgttttttttttttttttgggcgcgcgtaaaaacagccaaaggaatgcaaatggtgaaggtacaaatgtcagccctcctgttttccgacccctttgtttgcaagtctcagggattgtacatacacacaaacatgtgtgcccccccccccaaacgtgtttgccacctcactatatatgatgtgatgtatgccatgccatgcggcctttaaaacttgaaaccaagtttgtgcggcgcgccggtgtacttgagccacatggcgccgtcaataaacggcccggcggtaaacggttcggcctccttccgtccgatgacgtggaagccgggccagttgaccctcttgttggtgccggccccgggcccgcggttgttgtactcggcgtaaaaa

SEQ ID NO: 12020 - DNA, 403 bp, Zea mays
  Clone ID: cC-zmpo148010e11d1
gtccgcccacgcgtccgtagatcgcgagcggcccgccctttctctcttctttttgtgtgattatatataaggagcttggtttctttccaaaaacctaccaccggcaattaacaaccagcaaaggtatataagaatacacagtactagtccatgtttagggtctcggcatgcatgcaggtcatcacattttgggctcatatcatcagcttgcgcacaaccctccctatcgatcgattcccggccggttcgtgtcgatgatcagttgagggcaacatcgctgtagtcctcgtcgatcaccgtcgcttgcttgtcctcctcctcctcgccccgcaggtcccggtccattcaagaacccctcctacctgggccggccctggaaggagttcttgcgcctcgtcattat

SEQ ID NO: 12021 - DNA, 490 bp, Zea mays
  unsure at all n locations
  Clone ID: cC-zmpo148010e12a1
gatcgaatggcacatctttatatatggcaggggttctatacaaaataaataattacattataaggagacaacggtccancaacccaaagttgactgggagacgacgacctagaccactcacgaactcatcgcagcatcttccatgagcatcatcctgcagtacctggtcttgacctgggacttgagatttcaggtaccaacttgctcttcaggtgacacgtgtcctcacttggattatgcgcactggtgccctgaccacggcgcacggcggaatgccccagactacacgacgtcggcgagcaatccccatgctccacaagtcctcaataccgccatgtgaggtcgcgaacgtgttccgtgtgctctggagactctcctcgaccatcaaccaagcccaaagtaaagctcctgacgggatgcccatgcgagcggacatacatcttcccatggtgctttgaaacgacatcttcttgcaccggacgcgtgggtc

SEQ ID NO: 12022 - DNA, 478 bp, Zea mays
  unsure at all n locations
  Clone ID: cC-zmpo148010e12d1
ggtgcaagaagatgtcgtttcaaagcaccatggggagatgtatttccgctcgcatgggcatcccgtcaagagcgttactctgggcttggttgatggtccaccacagtctccagagcacaccgaacacgttcgcgacctcacatggcggtattgaggacttgtggagcatggggattgctcgccgacgtcgtgtagtctggggcattccgccgtgcgccgtggtcagggcaccagtgcgcataatccaagtgaggacacgtgtcacctgaagagcaagttggtacctgaaatctcaagtcccaggtcaagaccaggtactgcacgatgatgctcatggaagatgctgcnatgagttcgtgagtggtctacgtcgtcgtctcccagacaactttgggttgctggaccgctgtctccttataactgaattatatattttgtataaaactcctgttatatataaagatgtgacattcgatcc

SEQ ID NO: 12023 - DNA, 411 bp, Zea mays
  Clone ID: cC-zmpo148010f01a1
aaagttcaaacaaactgggtttatccatgccaacactgatacattttttcctgatccatattgggtaaagtcgtctttgacacgaatgcaatttcggggtaagatcaaaacgattacatacatgccgcaagcggatggatcaatggatcactcggaggcacggcccttgaacgattttgacttgaactgctcataaaacttggggaagaactcctccgcctgcatgtcgatggcctgtgggcaactgctgtcaccggcattgccacccttagaacccttttcctgggcccttgccatttggggcaaatccttaacggacccctaacggctggacatgcccaccttcttgatcttgaaaccgaaccgtgccttcaacggcggcgggaggatcacctcatggtacacattggc

SEQ ID NO: 12024 - DNA, 528 bp, Zea mays
  Clone ID: cC-zmpo148010f01d1
gcctatgatcgttgccgccgtagtgctggacaacattggctctgacgcggtctcctgcactgccatggctggcgtaacaataagcctagaggagaaagaaaacatcaatggggatgttcccacgatcacctcggccgcatgcaacgaggaggaggcgtcgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccggtgacgagtcaacgtcgtggaagcgcctcgtggacggtatgcgcccgctccgactacgcgggcagctggagtactacccgtcgtcaccgtcgtcaccgtcgctgggccacgccgatgtgtaccatgacgtgat

SEQ ID NO: 12025 - DNA, 410 bp, Zea mays
  Clone ID: cC-zmpo148010f02a1
ctcccctcccccttttcttttccccccccttcctctctctcccccctgcccgcccccctttctcttcccccttcccctcccctttccccttttctttttgggccaaaaaacttggaataaaaaacccaaaaaaaccaaattggagcccaaacccccaaaatttcctttttcaaccccaaaaaaccctatccaaaaaaaatttccaagaaacccaacccattaaacttggccgcccccccaaaccccgacccccttttccaaaaaaacggatctaaaccccctaaacaactcaattccccccccttcaaaaaaccccccccttctcaaaggggcccaaacccccccaaaaaaatggcccaccaacttctaccccataaatttaagcccaatttcccaaacttgaacccccc

SEQ ID NO: 12026 - DNA, 413 bp, Zea mays
  Clone ID: cC-zmpo148010f02d1
gctgcaaaataataccctccaagaatctcacgccgttctcttagttagtaacatctgcctgaaattgattgggacatatatgtatgtacattgttgatgctcgtatatgtaccctctcgaagagagtgcaattctagaatagtagtgaattcaaattgtcatgtgtcttcaatcagatttatacaaaaaaagcatcagcgtttgtagcgtcagacaagattaataggtttgtcatcatgaaatatattcctagatacgactttttaggttcgaaaaaaatatattcgtagatttgtcaacaatatgtttaattaagctatataaatccaataattttgaccaataaaaaaaaaaaaaaaataaaaaaaaaaaaaaaaaaaaataaattaattataatattaaatttaaataaa

SEQ ID NO: 12027 - DNA, 292 bp, Zea mays
  Clone ID: cC-zmpo148010f03a1
aaaacccaaaaaaaaaattttacctaaaaaaaaaaacccccaaaaaaaaaaaaataaaaaaaaacaaaaaaaataaattttaaaaaaagggatccccatcaaaaaatcttttccccaccaaacccctttacccaccataaaaaaaaaaaaatacccccccctttctcaaaaaaaaccttaaaaaaaagttaaatcacccaaaaaaaatataaaatacaccccccctccccataaaaatcaccactttttctccccccgcattttaatctgggccccaaaaaacacctttttt

SEQ ID NO: 12028 - DNA, 511 bp, Zea mays
  Clone ID: cC-zmpo148010f03d1
gactagttctaagatcgcgagcggccgccaatgcagtttaaatggtcgccaccgccgccgagaccacgagcacgttggattcgaagaagaaggacgtcgaggaggccaggaaggagaagcaggcgcagcaaagctgaccgactgtccgtgcatgctcgtgccaactaatataattattggctgatgatacctgatgatcagcgtgtgatcgatcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttaaaaaaaaaaaataaattttaataattaaaattaaaaaaaatattattatataaacttttaaaattatatatatttataattataatttttttttttttatcttttttctatatatataaaaaaaaaggggggcc

SEQ ID NO: 12029 - DNA, 495 bp, Zea mays
  Clone ID: cC-zmpo148010f04a1
cacaactggttaagatgtcatttgggttggcacattgatttacatttttttaactccggcaccatatcggaatgcatgagcgaaagaatgaatatgcatgcatgatgcatgttatcatctgcatggttgcttgtgggcatatgcaggttgaagaagaggaggaaaagtggctacttagaagttcttggatgcctggtacgtgacaccgaacttccagtcagcggggagaacgtgccatgaggtggccttgcggtggtcgctggtcatcacccggaacgtcagcgactcgcaggtgaggtcctccccggtctgccacacttgcccccagttgcgcttcatctccgtccacttgacacgcttgctccccttcaccgacaccgccgcgatgtcgccggcgccgcccacattggtgatcgtcaccatgttgaagtacttgttcccggtgatggtgtaccggatgccgccctgcttcgcgcacgccaccctgcggtagga

SEQ ID NO: 12030 - DNA, 481 bp, Zea mays
  Clone ID: cC-zmpo148010f04d1
gattatggctggttcgtggatggcggcgccacaacctttccttctgtcgctgctggtcgccgtgctagggggggcctccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgactgcgcggcctgcggagggtgctacgaggtgcggtgcgtggacagccctagcgggtgcaagcccgacgcggcagcgctggtggtgactgtgaccgacctgtgcccgcccaaggaccagtggtgcaagccaccgtgggagcacttcgacctcagcatgcccgcgttccttcagatcgcg

SEQ ID NO: 12031 - DNA, 455 bp, Zea mays
  Clone ID: cC-zmpo148010f05a1
ctcctatctttttttttttttttttttttttttgtttgttttaattaaaactttctaaacaaaaaaatccaattttcccccataacaacatacaacatcttttcctccatcgaaaacatccattaatcacaagcctcttccaattaaaaaaaaggaaaaaacaaaattatttttggggtgggcgtttggttcatggccctcccttttaaaattccacacaccacatttgcctaaataaacctaacgtaatcaccttcccaaaccaattaaaaacccacccagggaaacaaaatcttggtgaggagatgaataaattattaccggacccccgcccccccttacaaactgggcctatgcacctgctccgatccatttttttttttgggcctaaacaccccccccgaatttggccacgttccttttctttttttccttcaaagccccccccccctttt

SEQ ID NO: 12032 - DNA, 412 bp, Zea mays
  Clone ID: cC-zmpo148010f05d1
cggctcctaggaggccgacaagcaggagggggcgagctttcctttaggagaagaagaagaggaacatggcgaaaggcctcattaatgcctaggcccagcagagcacatggatcggagcaggtgcctaggcccagtctgtcatgccgcgcctcgcttccgtcatcatctattcatctcctcacccagattttgcttccctcgctcgctctctcattcgtttgtgcagctgattacgctaggtctatttacgcaactgtcgtgtgtcgaattttaacagcgactgccatgctccataccctcaccccacacatcattttgtttcttcctttcttttgattggacgactcctgtgattcatgcatgctctcgatcgaggcatagctgtctgatgtcgttatggtgtactattcta

SEQ ID NO: 12033 - DNA, 520 bp, Zea mays
  Clone ID: cC-zmpo148010f06a1
acacttaataactggattgcattgctagtacgtactccctccgctttgtacatgctgattgatgatgattaattaatatctgcatgcatgcattgtagaagcaaagaaatgggaggtagcttaggcatgcatgcatgatgcatggggccttaattaattcatccacggccacgggtcgtcggtgatgatagcttgaaccctctgagcgcggacacgccggcggcggcgcctcgctcttgtgctgcttgtggtgctgatgcaggcgcttctgctttcgctaatacagccgacgtacctaaggttgtgatcccgacttctccgtagcatgcgctggcacaggagagctggcagacgatggtccagccgttgcatgcagccatgcagtcgtcgcggcagttgcccagcgcgacccgcgtagacgccgccaacacaaccaagcacagcagcaacgccgccgcctgcattatctgcatccccgtcgtcgttgccgccatggcgcccatcttcttttaattaattt

SEQ ID NO: 12034 - DNA, 371 bp, Zea mays
  unsure at all n locations
  Clone ID: cC-zmpo148010f06d1
ctgcaaccgcaattaagttaaaaaannaaaagaagaccggcgcgacgggcgcaacgacgacggggaggcagaggacgcacgcggcggcagagcagccgcgcaagcgcgcgcaggccggcgccaacgcgggacgcgcagggcaacagccgcgacgaccgcanggccgcacgcaacggccggaccaacgaccgccagcccacccgcgccagcgcacgcaacggagaagncggcagcacaaccagaggaacgacggccgcaccagcgaaagcagaagcgccagcagcagcaccacaagcagcacaagagcgaggcgccgccgccggcgcgaccgcgcacagagggngcaagccaccaacaccgacgacccgagg

SEQ ID NO: 12035 - DNA, 241 bp, Zea mays
  Clone ID: cC-zmpo148010f07a1
gttatcatctcctttgcaaaattgcataggtgagggggggggacaacaatgtataaacatatatcatgacaaaaacataccaagtattattaatcggctagcaaagggaagttaaacatacgacatgaactgaattaaccagtgcgcacgactagcaaaaaaaaataacttcttttgacaacaagtttctaattaaatcataacactgcccacccgtcgcagacacgttttactaccacac

SEQ ID NO: 12036 - DNA, 400 bp, Zea mays
  Clone ID: cC-zmpo148010f07d1
ctactcctgggcagcgctatgatttaattagaaacttttactcacaacaagttattaattaaatcttgtctagctcatcttttaactcacatcatgtcatatcatacacttccctataataacctattaataatacgttaatctgtctctctcatgatatacgttcatacattattttccacttccctcatttatgcaattattcatactagatacttccaaaaaataataaaaaggtctacctctctatacgatccaatcttacatacactttcatacaacataatctctcttatataatgtcacctaacttcaattcactaacctccaagttacaacgctcttacttgcaaaacccttacttttccatacttaatcccctttcaacacatcccccttt

SEQ ID NO: 12037 - DNA, 410 bp, Zea mays
  Clone ID: cC-zmpo148010f08a1
gacaactaaaaaatgaatcctgccctcaatttggggtatttacatttttcaggagcacataagtgacaagcctggaaaaaatgaattttcaagaaactatttcaaaaaaaaagcttcatagagcatttccaccaaattgaacatcccatttccctaaattttgcaatagggcaatccccttcaacttaaaaaaaatttgagggagcggtgcttcaggaaattgaaaaaaactcatcccctttgcctaccctgacatatgggagtatgggacccacacatcagtggctaatatttatccaactcccttttttcctttccctttcttctcttgggtggtcccatgcctaaaccttaagccatttgccgtccacacaacccagaatacaaattccatgtggggccattctgga

SEQ ID NO: 12038 - DNA, 583 bp, Zea mays
  Clone ID: cC-zmpo148010f08d1
tcggccgaatcccagccatgccaatgctgtgcccctaaatttggtcttgcttctgcgccatgcccttgcagaaccgcattccgtgatgcaccttccttgctccacgttagcagctgccccacaccaccgttgagccgtgacaaacttcaagaggatgacgttactggaggccgcctttcccgtgcttggcctcctctccctgcatgttgctttagggcagcgggcgtcacccatataaccggccctccagcatggccccacatggaattcgcattctgggttgcgtggacggcaaatggcttgaggctgaggcatgggagcagccaagagaagaaagggaaaggaaaaaagggagttggataaatattagccactgatgtgtgggtcccatactcccatatgtcagggtaggcaaaggggatgagcttttctcaatttcctgaagcaccgctcccttaaatctcttctaagctgaaggggattgccctattgcaaaatttagggaaatgggatgttcactttggtggagatgctctatggagctttttcttgaaatagattcttgaaatcattttttccaggc

SEQ ID NO: 12039 - DNA, 556 bp, Zea mays
  unsure at all n locations
  Clone ID: cC-zmpo148010f09d1
ctcagccgccgcaagcgccacatcagccatgggcgctctgtttttcaagcccaagacgcttgaggggggcgcgccagcttaggccgccgtctccacacccaaggttgcgcccgaggccactccaatctccgttgaagttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgtgaaggagaagctggcgcagcaaagctgatcgactgtccgtgcatgcgtgccaattaatataattggctgatgatgcctgatgttcagtgtgtgatactgtgatcaagcaggagactaccttgaattctttacagttggcatangtcgggagagacac

SEQ ID NO: 12040 - DNA, 412 bp, Zea mays
  Clone ID: cC-zmpo148010f10a1
ttatttatacatcttttcacccccaacattttttttttgttagtttttattaaaatataaataccgcaccaacaccaaataaaaattttaaaccattataattaaaaaaaaaaatattacaaaaattaaagaaaggggaaaatacacaaaaacaatttaacctcacctaaaaaaaaacattaaactaatataaattatataaaatacaaaaatccctataacatccatacctataaaaaaaaaaaaaactaaataaactttccaaactaaatcaatttaatatcaatacacaaaaattcacacccccaaaaaaaataacccttctatgacaaaaaggatagaaatttatattaacatcaaaaaaaaaacaaaatttcaaaaaaaaaaaatcccaaatctattattgtcaact

SEQ ID NO: 12041 - DNA, 263 bp, Zea mays
  Clone ID: cC-zmpo148010f10d1
gctctatggaatacctactttccccaaccatatcttactaacttactttcacaacaccctaaagacattttatgacactgctatgaacccaacaactaatttcataagactgaggataattacactcaaaaaccttttattttttgcaaaaacataaccctcttctttcaagactcttattctaaaacaccaataaatgccaactacataataatacccatttgtccccgtgcgaataaacaatctaaacatccttactcaac

SEQ ID NO: 12042 - DNA, 258 bp, Zea mays
  Clone ID: cC-zmpo148010f11a1
ccgaagcgatccttagcggcgctttttttttttttttgctcaaaggtggtgtacctttgcgcctggtcccgaatcgacgaccgaggtacagttctatgggcgattaactgcgaatatggtatactgttctgggaaattgtatcgtacaattccacacatacaccgaagctaagtaagctggggctaagggactactacaaattggtggctactgccctttcatcgaaacgcggccctgcttaatgaatcgcaacccgg

SEQ ID NO: 12043 - DNA, 250 bp, Zea mays
  Clone ID: cC-zmpo148010f12a1
aaaaaaaaattttcacagggccgaacattgggcttttattggggaaaggaacaggagttccctcccccacaattttttcttcaaaaaaaaaactggcaaaaaaagaacccaaaaagccctcccccccgatgctcaatcaagcaagggcctatcttttttaaaaagggaaaaaaaaaaaaaggggggattggaattgcctcccccaaaaggctgcccttaaaaaaccatcggctaagagggggaaaccctt

SEQ ID NO: 12044 - DNA, 522 bp, Zea mays
  Clone ID: cC-zmpo148010f12d1
gatcctgttgaacaccacctgctgcacccccgcgtacttagttctcggagatcatcaacaagaagggctaggagggggccaaggccgacatctggtcctactccaaaatccttttcatgcttctatgcgcataccttccattctacaacgccaacctggaggagatgtaccgaacgatcagaacaaccgacggcaagtacccacagggtatataccctgagctccggcggataatacccaaactacttacaccgaacccaaacaacaggatcacgatcgacaagctgggcaagcacccatggttcaagaaggggtacaggccgcacgtcatgctggcacagccagaccattccaccagtcataaagatgtccaggtacgcttcaacaacgacgaccacatggacagcagcagcaaggtggaacagccggcggacagctacttgaagccgtcgagcctgaacgcgttcgacatcatatcccactccagagggtttgacctgtcaagcctgttctaggtggacc

SEQ ID NO: 12045 - DNA, 383 bp, Zea mays
  Clone ID: cC-zmpo148010g01a1
attctcctcgcctaattcacttacttttaatgaaaaggaaaagagagagagagagagacaagaggtaacacctgaatttggttggtatttagagaaaaaattttataccctcaaattcagggtgttacaccgtcgaacataatatagctgtcggatgtctgtcattttactgttgtgcgttaccaatggatagcatgtaatgggcaatgcaaggacgagagaaaaattataactagagagatgggtcagtcgacggagggtctagaagcatgcaagctccttgaggcaacccttggtgctgcccttggcgttcgtgcatatagccatggtcttgttgttggtgcctctatactcgacgttgacgtcatccatggtgacccctg

SEQ ID NO: 12046 - DNA, 529 bp, Zea mays
  Clone ID: cC-zmpo148010g01d1
gagaatatcaagatggaggactcagccaaccccatctttatcttcatgaagtactgccccaacaagttgggtagggccaactgcgcctccaaggtcaccgtcaaggacgtcaccttcaagaacatcaccggcaccttctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataactcttctctcgtccttgcattgcccattacatgctatccattggtaacgcacaacagtaaaatgacagacatccgacagctatattatgttcgacggtgtaacaccctgaatttgagggtataaaattcttttctctaaataccatccacattcatgtgttacctcttgtctctctctctctctc

SEQ ID NO: 12047 - DNA, 262 bp, Zea mays
  Clone ID: cC-zmpo148010g03a1
aaaacatgccctttattcattgaatcaacgagacaaaaaattaccgcaaatgcttatttgcgggaccttacattaattgggctgctatatatgtgtataaaacaatcgacgaaactatacatcgtcggtcatcaaattggtaggtatacccatgcatgcatgcataaaatcgtcattgaatcccatgcatgcatgtatatatgatgtatcaatgattcaatgtcacccaagcaggcaaaaaaccacgaccggcgggcgttct

SEQ ID NO: 12048 - DNA, 601 bp, Zea mays
  Clone ID: cC-zmpo148010g03d1
ttctccgatccatgaacaatcgccgagagcgatcgttagattaataaagatgaagaaagtggcatcagcgtgagccgttctcttcgtgctagccctgacgctagtttgtgccccgctgatagcagaggcaaagaagaagagagtcgccgtcgccgccgccgaggagaagaaggtgcaggacaacttctgctcgacgctgtgcgagggcaggaaggggatggacctggtggcgtgcaaggagtcctgcgacctctcacagcgctccaacctggtgctgtacggccggatccagtgcaagggcaagtgcaccgagcagaagggcatcaccgcgccgcagatgaaggcgtgccaagaggcgtgcgacaaggactacgtggtcaaggcggctgaggtcaccaaggcctgcaacaccacctgcgccaaggagaagcagcctctgctcagcgagaactgcaggacgttctgcaccccttctccttcctgaacgcatagcacgcccgccggtcgtcgtcttctgcctgcttgcgtgacactgaatcactgatacatcatatatacatgcatgcatgggatgcgatgacgatttgatgcatgcatgcat

SEQ ID NO: 12049 - DNA, 416 bp, Zea mays
  unsure at all n locations
  Clone ID: cC-zmpo148010g04a1
gtaaataggaaaaaatgtttcacagtgctgagtgatggtgcttctattggtgaaaggaacaggacttccatgcccaacaacttctgctacaagaagaaaactggcaaaagatcatcacaaagagccctacagcctgatgctcantcnagcaaggtcctagctctttgagaaaggggaaaagaaagagaggatggactgtaattgcatctccgaagagactgcacttaaataacaatcgactaagaggggtgagtaaactgtcggagacggtctaagaggatggctccaattgtgatggctgaaccactgaaggagccatgttctcctcagatcggctgctccagcagatgtcgctgagtgaaggtcttaggcccttgctgcaaaacatcttatactccagcgtgttgcctgccgac

SEQ ID NO: 12050 - DNA, 450 bp, Zea mays
  Clone ID: cC-zmpo148010g04d1
gaagggctgcgacggggccaaggccgacatttggctctgcggcgtcatcctcttcgttctggtcgggggctaccttccgttccacgacgccaacctggtggagatgtaccgcatgatcagcagatccgacttcaagttcccgcagtggttctcccctgagctcctgcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcatcaccaaggtggaacagccggctgacagctccttgaagccggcgagcctgaacgcgttcgacatcatctcccactccagagggttcgacctgtcaagcctgtt

SEQ ID NO: 12051 - DNA, 443 bp, Zea mays
  Clone ID: cC-zmpo148010g05a1
ctggaaacaccaattttctttataattcgaaaggtcacattttttatctttgaaacacaacacaatccttaaagacatacacgatcgagattcgtacagagtacagacgttgccgaatggaaagctcacttcgaccgagtttaagtggattctgaacacaaataagccaaaacaacagcacacatgttggctgacgcacatctctgtcgcagcaataatggcacaatggtccgttaagcagccagcgtggccgtggccgtggcatcggccgggccttctgcctccggagccaccagctgggcgatgttctccacagcacatatcctgccgctggccagtccggccgtcaggtcctcgacttccattttcaccacatcacggcggttgccaatatcagctgcatacctgctcgcgcagtacaccccgacggccatcaccgccat

SEQ ID NO: 12052 - DNA, 439 bp, Zea mays
  Clone ID: cC-zmpo148010g05d1
tggctgtgatggccgtcggcgtgtactgcgcgagttggtttgcagctgatattggcaaccgccggggggtgcttaaattggaagtcgaggacctgacggccggactggccagcggcaggatatgtgctgtggaaaaacatcgcccaactggtggctccggaggcagaatgccctgccgatgccacggccacggccacgctggctgcttaacggaccattgtgccattattgctgcgacagagatgtgcgtcagccaacatgtgtgctgttgctttggcttatttgtgttcagaatccacttatactcggtcgaagtgagctttccattcgggaacgtctgtactctgtacgaatctccatcgcgtatgtctttaaggatcgtgttgcgtttcatagataaaaaatgtgacctttcgaatttattaagaaaattggtgtt

SEQ ID NO: 12053 - DNA, 433 bp, Zea mays
  unsure at all n locations
  Clone ID: cC-zmpo148010g09a1
ggatacaattcattcagcttatgtaataatagcaagccaacacaacaaggcatcataaggcacatgtagcatcacatatttcttgggtggtttggcgccacaaaataaccatagaaaaaatattgtcttgctaacgtgagcgccaggtgagctcttttgaaatataattcatcatcagaggctgattatatgctgagtgaggtcttgaaggtggtgccggcctctaaatcggcggggatgacgtcttcggcgatgcggtagccaccggacttgacagcaaaacggatgcaaagggggtacttgagcggagccttggtgtaaagcgttcaggtgccggtcgggccctccttgagcgtaaaggagaagtcatcgcccccgtgctctttgatctacacgttagatatggntgcaacattgtgggtgaggatcacgt

SEQ ID NO: 12054 - DNA, 401 bp, Zea mays
  Clone ID: cC-zmpo148010g10a1
aagactcttaagcactggtccatgtaagggttcgttcattcgtcacacacacgcacaggttcacacggcttccatgagagaaacagacgagtgcgcgcgatgggggccaaaattgtaaaacgtcatcgtccccaggcaaacatgggacaagcacacaaatgaaccatggaaactatacaccgggaagccatcacacatcgtttgcccacttccacttgtgtcactaggacgtactggcatcagcggctgctaacactttcttctcgagctcaggtttgttcgcgcccacgagcttgtcgatctgctgcccgttcttgaggaagaagaatgtcggggttgcacggatgtcccatgaagagctgaagtccatcaggtcatcaacgtctattgtcaagaacatg

SEQ ID NO: 12055 - DNA, 415 bp, Zea mays
  Clone ID: cC-zmpo148010g10d1
gactatcctaactgatgttcttacaatacacgttttgatctgatggacttcagctcttcatggagcatgcgttcaatcccgacattcttcttcctcaacaacgggcagcacatcaacaagctcgtgggcgcgaacaaacctgagctcgagaagaaagtgctagcagccgctgatgccagtacgtcctagtgacacaagtggaagtgggcaaaccatctgtgatggcttcccggtgtatactttccatggatcatttgtgtgcttgtcccatgtatgcctgcggacgatgacgctttacaattttggcccccatcgtgcgcactcgtctgttgctctcatggaagccgtttgaacctgtgcgtgtgtgtgaccaatgaacggaactttatatggaccagttcttaagagtcttccc

SEQ ID NO: 12056 - DNA, 571 bp, Zea mays
  unsure at all n locations
  Clone ID: cC-zmpo148010g11d1
aaacaggcganccaccacctccccctctttccatcganccattctccaacacanctaaagaaacgatttttttatcaatcaaccaccccatcccacccctacttttactaacaccttattttctacatctatctccatcacctcctttcttcttccatcttaaccacaacttttcctccttttctcaaaacactacactcccctacttcaatacctacgacattaccaacatcatcaattacttctaccatccaatacactcttctcctacattcctattcctttcactctaccaaattcatcttcatccaattctaaccttatgccgtcatccgtgacaataatctatcactattcatcaccctcaataatacaattcatgcactcatttatttcatctactactaaccctatacaccttttcatttccaacattctgtcttaaacgcttttctactaccctcttaaacatttcattttactactaccaactactcttaaatcaatttaaccaccataccttctaatttttactttcaataatttctacaacaaacaaatgccttcttcc

SEQ ID NO: 12057 - DNA, 345 bp, Zea mays
  Clone ID: cC-zmpo148010g12a1
gggggggggaaagtcacttcattaaaaagaaaaacaggaaaagccccatcaatatgcatcagcaatcttcactcgcttccaaaacaacaacagccacattaattaatgaaacgaaacatacgaaccctccacgcctgcacagttgagtagtactcgtacacattttcatgagccaaagcagtcttttgacatcacctcgttctgatctcttttcagccagacatggcagtctcaaacctcccaaccaaggccatcaccttgttcttcctctcctgggtggcagcaatagtggtaaacttgcccctgccctcctctgtggcttcgttgctcctcccttcatccttc

SEQ ID NO: 12058 - DNA, 571 bp, Zea mays
  unsure at all n locations
  Clone ID: cC-zmpo148010g12d1
gtccggccctaaaaagcggggcacttcgtagccgcaagcatttttctttccttctccattccatcggtgaccagggagtgaagacattgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgcttcgtcgtccgtgggtggtgcaagtgcaagcgcaaggcagacaaacgcggcgagaaggagagcagagaagcccggtgccacatccgtgtggcctgcggccggcggcgcggttacgaacgcctcgtcgtctaaggatgtggccagcanggcagcaaaatcg

SEQ ID NO: 12059 - DNA, 322 bp, Zea mays
  unsure at all n locations
  Clone ID: cC-zmpo148010h01a1
gaactcccgaaatgttagaaattcccccttcgcccatttccagcgttcatgacattactagtatgtacataacctcctccgccatcaaaccaatctgaaaaccaatgggaaggcgaccaatgctaatccacatcctctattctaatgttccacggctcctccctctccggctcctgctgcgcctccgcccgcccgcctccgaacacgaggtagctgacgacgaccgcggccctgggcctccgcctctcctcctcgccgccctccgccgacgccgngctgtcctccttctcctccttggccggcgctggcagctcgcggcggc

SEQ ID NO: 12060 - DNA, 444 bp, Zea mays
  Clone ID: cC-zmpo148010h01d1
cgcggacgcgtgggcggacgcgtgggcggttccaccttttccttctctctcgtgctcgatccatcgccggggccgaatccccatggcctcagcgaacaacgacaaccgcgaggcggcgggcatcctgcggctgctgatggggatggcggcggcggcgcccgcctcggcattgcctcgggggggcggctgcggcggcggcggcggcctgatggtggtgcagcacgtcatcctcgacgtcgacggggaattgttctcgggcggcgtcggctgcggcggcgtgccgccggcgtcgatagccgcgatcgccgtgctgaaggaggtgaaggccggggagggcgagggctatggcgaggacgcgctggcgaagtgcgccatctgcctgaacgcggtggaggcaaccggcaaggaaatgccttgcgggcaccgtttcacggccgctgcctg

SEQ ID NO: 12061 - DNA, 238 bp, Zea mays
  Clone ID: cC-zmpo148010h02a1
gttaaaatcgcctccaaaaatggcatgtatatttggccttgggcttgttttccactctttggaattcgatcatgaacccgaacaaaaggattacatatactagaatttggaagtctcagtagtatataaggttagcggtgcatgctgccaacttaattagcttgctgctgaaggtccatagcccgctgtgccggatgaatcgaagggaattcaaagtctagtagaattggacctttga

SEQ ID NO: 12062 - DNA, 303 bp, Zea mays
  Clone ID: cC-zmpo148010h02d1
cggcatgaaggtcatcgccaaagacgtcatcccggctttacctgagacccgatgccgtctacacttcggacgtgcaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaagcaaaaggttaaatatacatgccatttttggaggcatttttttc

SEQ ID NO: 12063 - DNA, 204 bp, Zea mays
  Clone ID: cC-zmpo148010h03a1
acaaaaaccataattttttaaatcttgataccatgagtctatacctttaactaacaacttgtttaccccatgaaaaattaaaccgaaagaaaaatagggaaagcaaggatgtatccctggatgaatggatgaccacacattttcatggttttaaagacattgctctcatttttcttccatgtcttgttccaaatttaaccgggc

SEQ ID NO: 12064 - DNA, 408 bp, Zea mays
  Clone ID: cC-zmpo148010h03d1
caccaagcgttgaactcgcctaagcagttaattccaaccctagaaagctagacaccggacccgtggctctcgctagcgtcgtctgtgtcattgccgctctcctcttcgtcgccatggtcgtaacacccaatggccgaggcaaagtccgccgatgcccctgtggctgactcgccagccgatggacctagcgggccggctgctgcacctggcccccagggcgtcgaaggcctgtcaggcaatgaggatgacgatgatgactccaccaattgaggccacacacgtctgcccggttaaatttggaacaagacatggaagaaaaatgagagcaacgtctttaaaaccatgataatgcgtggtcattcactcatccatggatacatccttgctctccctctttttctttctgct

SEQ ID NO: 12065 - DNA, 481 bp, Zea mays
  unsure at all n locations
  Clone ID: cC-zmpo148010h04a1
aatacataataaatgaataaggcttttagggagggtgtttcttctcttcatgcatgtaacaaggccggaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcacatcgatgcaagaaggtcgagaagcgatcgatcatagtagatagcatgcatatatatatataataattaatcgattcatgcggcggcggcggcgacggcggcgtggtgtgtgaatccgaaggcgatgtgcgccatccgaccgtactccctgtcgtgcgcggcgacggggacatcctcctcctngcccttccacgcgtcctcgcagctctcggaggcgcccattgcggcggtcagctgctccatggccttgccgt

SEQ ID NO: 12066 - DNA, 488 bp, Zea mays
  Clone ID: cC-zmpo148010h04d1
atcgtccatccgagctaagtaattaggtcgaaaattttccctagccagcagcagtagcagcagccggggtgggactctggtactgctcggtctccgcctgctgcttctggttggtgttgcgcaggcggtagtggagtttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgtcagcaccgagtccaagatcgacgacctcgctgagctggaggcggcgtcgtctgatccgaaggcgctcgcccgcttcaaccactgcctggagcagtac

SEQ ID NO: 12067 - DNA, 429 bp, Zea mays
  unsure at all n locations
  Clone ID: cC-zmpo148010h07a1
gcagggcccgctgctgcattcgccggaggagcaggcgctggtggagatggccatcgcccggaaggcctcgctgcggcgcttcctcgccaagcgcaaggaccggtggtcctccgccagctctacggcctatgacgaccgccgccaggacgacgacgacgacgaggcggaggaggaggaggagccgccggcgcccaagaaaggcaagatggcggcggcggcgcgcgaggacccttcttcctcttcctggctcgcgctcggcagcatgtgctccatgcacggccgctgatgagggagccagcggtggttattagtagtgcagacaagagctcgggcgcccgcccggccatgggatgggatgggaggcgttgcagcagcaatttatgtgctacctacgtactagtatttattataattgntattactaacaac

SEQ ID NO: 12068 - DNA, 453 bp, Zea mays
  Clone ID: cC-zmpo148010h07d1
gggaaacaaacttatagcaatttttgagtcacaaagcatcaaacgttccacactgctgggcttgacttctcttgccgtccaggtccacccgtcctgttagatttagatggtcgatacaccaccatcctttcatggaacgaaaggacaatgaaacgaaccaacgatcgaatagcgtcggtctctgatcgatactaccagtcgttgttgttagtaataacaattataataaatactagtacgtacgtagcacataaattgctgctgcaacgcctcccatcccatcccatggccggtcggtcgcccgagctcttgtctgcactactaataaccaccgctggctccctcatcagctgccgtacatggagcacatgctgccgatctcgaaccaggaataggaagaagggtcctatcgcgccgtcgtcgccatcttgcctttcttgggcgcctgcggct

SEQ ID NO: 12069 - DNA, 201 bp, Zea mays
  Clone ID: cC-zmpo148010h09a1
attttaaacaaacatacctccccacccaatgcatgcattactaaatcatttcaacaaatccaacccaatctagactacctatcataggtcaccttaaactattttcattcactaaagttacaatatttgtcttaaattctgctttaaccttacaattttcagcaattacatcaccttacacggacttatagcctccctcaa

SEQ ID NO: 12070 - DNA, 111 bp, Zea mays
  Clone ID: cC-zmpo148010h10a1
ctcctctctttttttttttttttttttttttttgtgcgggtacaataacaaaaatccaccactccaaatttggtacagccacccaattacattttttttttccccgacccc

SEQ ID NO: 12071 - DNA, 70 bp, Zea mays
  Clone ID: cC-zmpo148010h10d1
gggaaaacaaaaatgtaactgcgtggctgtaccaaatattgattgctggattcttgctattgtcacccag

SEQ ID NO: 12072 - DNA, 330 bp, Zea mays
  Clone ID: cC-zmpo148010h11a1
ataatctctttttcccctctcacttttttttttgtatggtttttttttaattttcggtaaaaaccccaccaagcgtttcaataaaaatgaatggaccctaacaaattgtgaccaaaaaatcacaaggtaaaaacataggttaccacaaatattccacccttaataaaaaagggaaaaaaactgctgcccaaaaacccgcacaaaaattttttttccctaataaaaaaaccgcaactaaaaccggggcaaaaaaagcttacaggtaaaacaaatcccccaaagttttcaaccaaacgttcgcccaccgcgtcgaaaaccccttgtactacc

SEQ ID NO: 12073 - DNA, 328 bp, Zea mays
  unsure at all n locations
  Clone ID: cC-zmpo148010h11d1
gggacacntgggcggacccctgcnnccaagccgnggtgnatctttaccgccgccagcctctcctgcggccggttttttttccatttcttcattagcaccaacaaagttttgtgcctgtctatcagccgccgctttcctcccctattcatcaagactgcaataactgtccctacctatgcttctcacctgtgattttttggacacaatatgttaaggtccattcaattctaatgagacgcctgatgaggctactagcaaaaaaaataactataaaattataaattaaaaataaaatataacattaaattatattacaattaataggcct

SEQ ID NO: 12074 - DNA, 458 bp, Zea mays
  unsure at all n locations
  Clone ID: cC-zmpo148010h12d1
ggacgcgtgggcggacgcgtgggcggacgcgtgggtttactttggagacggtggacgacgcgctcagggggggggacgttgacacggcgcacaccaacctccactcggtggagacggacatcaccacctgcgacgacggcttccaggagcgcggcaccccgtcagtcatgaccgaccacgaccaggagctccagaagctcgccagcaacctcctctccatcggcgccgccatccaccactagaaagagaggagggaggtgcggcgtccacacacgcatgcatgcatgcatgcatgcattgcgtttgcgtctcaagagttcacttgtaaatttgtaatcgaggaagaaaagcacctctcgatcgattaacatgtctagctgctacgatcctgtgattcgacgatgttaattaatcggcagctttcattaacanaaaaaaaaaaaaaatatatataaaat

SEQ ID NO: 12075 - DNA, 553 bp, Zea mays
  Clone ID: cC-zmpo148016a01a1
gatccagttcattacttcattttataggggaatgacagaaacgggaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaggcgtcatcggctcgtcgtagatgccaaccacgagtgcctgccctgtcttcttcacggtgatgcctcctgatcccttcttgccacggatgacggcaccaggctcgccttggatgaccatgtacttggtaggtccgaggaacaggcctgtcggcgcgaggtgccctggctcgtcgaagtccttcatgat

SEQ ID NO: 12076 - DNA, 579 bp, Zea mays
  unsure at all n locations
  Clone ID: cC-zmpo148016a01d1
gccgagcgancncggncctctccctctccgatccattctctatgttttcgaagtaaacatgtctgaccggggaaaggggtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggtcaacatcatgaaggacttctacgagccagggcacctcgcgccgacaggcctgttcctcggacctaccaagtacatggtcatccaaggcgagcctggtgccgtcatccgtggcaagaagggatcaggaggcatcaccgtgaataagacagggcaggcactcttggttggcattctacgacgagccgatgacccctgggcagtgcaacatggtggtggaaaggctgggcgactacctgcttgaacagggcatgttacttctacctaccagctggaatgcatgtttacgacgatggtttcgagtttcaacttcaataatagtaacaacaaagcaaaggcccttctcccggcgtatttgctttt

SEQ ID NO: 12077 - DNA, 507 bp, Zea mays
  Clone ID: cC-zmpo148016a02a1
atagagaccaaatagttggtatcatccgggaggcatcgtacaccattttctagaatagaataggatgatgacagggcacacaaaccaggaggcgcatcgcttacaaaacaatttacaatacacagctgcatggcaaagctcttctctgcgccaaggcgttggcagtcacgacacagcaacaccaacgctccacaagacggtcctttttcgtgaacccaaagttgtcgcagcgatgggaaatcacagtccggatcgctctgctgctgcggcagcgtgggaggccgacgaggcagtagggcggttgccagaccggctgtgcagcaaggggttcagagccttgacgacgatgctcatgttgggacggaattcaccctcgtattgcacgcagagggcggccacagcagccatcttggctacagcctttggagggtattcgtctccgagccttggatcgacgcattgcctcaccttgtcttcactaagcctcggtgtagcccatgtcacaag

SEQ ID NO: 12078 - DNA, 533 bp, Zea mays
  Clone ID: cC-zmpo148016a02d1
gcacaacacaaggagaaggggaagggcggcgagggaagggctctttgttttgtcccttctcttcctcctcctcctgctcggctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgaccatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcaatgaagaagctgactccagcaaacaacctgatcaagaatt

SEQ ID NO: 12079 - DNA, 444 bp, Zea mays
  Clone ID: cC-zmpo148016a03a1
gagagcatatactagtaaagggccgtttcatttcaattagctgacaaacgacccaaacaatacaatagcttctgcttaatattgcacaacactggagtagcgagttcaccacgagagcagcaagacacaaacgagaagaaaatagcggcagagcacagggctcgcaatcatatacggccctttatttaaccgaccacggactcacgggaggacgaggcacccttcagcgacgggcagaggggtaaccttgacaggaacataggccgtagggccctcaccgtcgctggcttgctcctcttcctcatcatactgaaccaggccagcagcgctgaagatgtacgccttcacttcctcgaagcgctcctcggagagagagacctcagcgaggagtttcacgcggaggtttcagatgcctactaatagtccatcctccgtttcagcacc

SEQ ID NO: 12080 - DNA, 350 bp, Zea mays
  unsure at all n locations
  Clone ID: cC-zmpo148016a03d1
gaccgngtgctccagccgtttgtttctctgtctagttcaatttcacaaaagttgggggggagtaggttctcttccattttgagaataatggccgtgatgacagctatttcctgaacaacgctccaatcattgctgtncatcgggctccaaatgttattgctatcaacgttagcccaattgaatatggacatgtgcttctcattcctcgtgttctggaccgtctgcctcataagatttatccatatagcttcttgcttgcactgcaaatggcaacctagggaggtagcccatacttcaagcttgtttacaatacccttgtgtgcgtttgtcaccattaatcacttccactt

SEQ ID NO: 12081 - DNA, 514 bp, Zea mays
  Clone ID: cC-zmpo148016a04a1
gacccaaatcataggacgtccgtttaggtatcaaaagtgtacaaaaaaccccacaccacagtaacaatggcatgttcagtttcttttgttcaccacgataccatgttaacaacaacatagacaaataaataaacacgtttatgtataggccagcgagggcgtgagtccatcccaggaagtactccgtattttgtaggagtattacacaaggttttgccggagcagtggctgcacctcaccaccagcatccgcgttactgtcctgtgccttccataggtccttgaagaggccgtgctacttttgatgctgctgctctggtttaggagtcgaaacagaatcggtcaacacgcctgatgcctgcacgggtagcttcaacgcatttgaagatgaattctgcacgtgctgtaggcacacttgcacggcgttatgcactcgcacaaagcaccacccagctcctaccaagtcaatgatgcccgatcttgacaacagaaggtacacttgccggttcgggtta

SEQ ID NO: 12082 - DNA, 208 bp, Zea mays
  Clone ID: cC-zmpo148016a05a1
aactaaaaaaaaccaaaaaaaaacacaataataaaaaattaaaaaaaccaaaaaaaaaaataaaaaaaccaacaaatcaaaaaaaaaataatctccttaaaaaaaaaaaaaaaaaaccacttcaaaaaaaaaaaaaaacacaacaaataacttaaaaaaacaatataccataaattaacataaaaaaaaaaccatattcaacatatct

SEQ ID NO: 12083 - DNA, 272 bp, Zea mays
  Clone ID: cC-zmpo148016a06a1
aaattactattgcatccatcgcttaccattatacgattgtttttgtctcatccacacattcaaccatcataattgtcattatcgcaatgcttaccttaggaatgagcactaacacaactgaaaaggtcttcgttcagcttgtgggttcagtgtgaaggtcaacccaaacatctccttgatgacctgccccttctccaggtgttctactacttttgcgacaagagcgacactttccctcacgtgttacatgtcagtctgtgtccagatgctca

SEQ ID NO: 12084 - DNA, 507 bp, Zea mays
  unsure at all n locations
  Clone ID: cC-zmpo148016a08a1
gccgnctccacctttgtgttcacgtcctcaaggcctagcacagggggtgggaacgtgaggccccaggcccgtccgctcctaggcaggccgtcgccgcgccggaggctgcagacggccttggccgcgacgggcaagacgccgggcgaggcggaggagcaggtccccgcgtgggccaagcccggcgcggacgagccgccaccctgggagcgcgagggcggggccgcgcgtggacaggaggcccggcaggtccccttctacgcgtacctgctcgcgtccacgatcaccgccatcgccgcgatcggctccatcttcgagtacaccaaccagcggccggtgttcgggatcgtcggccccgacagcgccctgtacgcgccgctcctgggcttcttcgtcttcaccggcatcccgacctccgcgtttctgtggttcaaggccgtgcagacggtcaacaaagaggccgaggagcaagaccgcagagacggattcctgtgagaagctgtgggtgac

SEQ ID NO: 12085 - DNA, 191 bp, Zea mays
  unsure at all n locations
  Clone ID: cC-zmpo148016a09a1
taatgnctgactaatgatagatggggcagggctgcatagggcacaaatccaagaacacctcgtatacaacaacctaataacgaatcagccaaaaaaaaattaaccagaagaccttattagtcaatcttgaggtcgttgcaccatcaaagattgggcgactctctctttgattcttaactctttcttgttag

SEQ ID NO: 12086 - DNA, 369 bp, Zea mays
  Clone ID: cC-zmpo148016a10a1
gataagatactgatattcatgtaaagtttattctacctcacacaatattatccgtatttcaattgaatttgaagagaaaatatgaaaaagaaatatggaacgagcaatgtccatctatatccggttacattcctgtgggtgactcattgccgtcacctggggttgaaattgattgttgagcacatccccattgttttcataccttccgaagcaggattccttttaatcatttacccgtagatggcattcttgcctgaaccaatacatccagctagcgtttcttgcttcttgttgcctcaggtctctttcttctgcattgcccgaggtgcgggcactgacctccgtagagcctcctgcaagttccaggtt

SEQ ID NO: 12087 - DNA, 419 bp, Zea mays
  Clone ID: cC-zmpo148016b01a1
aacccaacaaatttacatttatttaaggggaaactgtccattatttggactacaaaaccacatgcagcaaacatgcaaaacatcctaaatggaaaaaaaaaaaaaaaacattaccccccaaaactttaaactgtttatttatcggaaaaaaaaaatataaaagggctttcattccttaatgaccccggatttttctgtttttttaaaacaactacaaaaacggtgtttgctgtgtggaacccacaggatttactgacaaacgtaaaacttgctccattttatgctactatgccgaaaccggttaaacaacccctttcccgaagggagtgctttcccctgtaacaaaaacattctgaaaataccttgacaagttcttgtctaccgttgaagaaacctgccgtccctccgtgatggcccaa

SEQ ID NO: 12088 - DNA, 458 bp, Zea mays
  Clone ID: cC-zmpo148016b01d1
ggcatcaagaagctgctaccaattttgttaaggatccaagaacttacgaagtggtgacgaatcgttttattggcgatggaaatggcaaggtgaaggcccttgaggtagtgcgtgtgaagtgggagaaagtagatggaagatttcaactcaaggagatggaaggatcagaagagattattgaggctgatctcgtcctcctagctatgggattcttgggtcctgaagcgacaatagctgagaaattgggtttggagaaggacaacacatcaaacttcaaagcgcagtttggagacttcgctaccaatgtctatggtgtgtttgccgccggggactgcatacttggacaatcactggtggtttgggccatcacggagggacggtaggctgctgcatcggtagacaagtacttgtcaagtgatgatcagaatgctgctgctacaggcgacagcacttccttc

SEQ ID NO: 12089 - DNA, 301 bp, Zea mays
  Clone ID: cC-zmpo148016b02d1
cggggaaggaaagcaggccagcaaagctgaccgactgtcgttcttttcgtgccaactaatataattattggtgagataccttatgatcagcgtgtgatcgatcaaggagacgacacttgaattctctacagttggcatagcggcatacgtcgggagagacactctcgactggccacaccatgtaacaaactaaccttcttcgatgtctcccattattttcctccacggagttcttctgatgaaacaacatgttctaattgggcttaaaaaaaaaaaaaataaataacatatataaaaaggg

SEQ ID NO: 12090 - DNA, 501 bp, Zea mays
  Clone ID: cC-zmpo148016b03a1
gtatcttcgttaaaaattggaggggtacaaatcatagcacattctgtaggtgtaggatacagtaacacagcagcagaacatcaaacccatctcctgccaggctctgagcaaacgccaaagcctccaacgtggcacctacgtaccgtaccccactcctggtacccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcgtcgcagcgtgccaccccgtctagcgatcgaacacagtcgacggggaacgccggccggtccggtcagttggtgagcgcgacggcggcctcgtgcacgagggctgggttggcgtgcgcgacgccctcggcctcccgctccacctgctcccggcacgccttccgcgcgcccggttccgtcatgcgcttgacgaacgcggcga

SEQ ID NO: 12091 - DNA, 346 bp, Zea mays
  unsure at all n locations
  Clone ID: cC-zmpo148016b03d1
gacagggccgccgaggaccgcatggtggccttttcgtttctgcgcanggggcccgacctgtgggaggcggtcaactgtcgccgcttctccgctcttctacaagcgcatgacagagccgttcgcgcgggaggcgtgccgggagcatgtggagcggtatgtctagggcttcgcgcatgctacccatcccctcgtgcacgaggccgccgtctcgctcaccaactgaccggaccggccggcgttccccgtctactgtgttccatcgcttgacggggtgtcacgctgcgacgactacctgttttgcgagtccctatacttactcatacataagctgcgccgccgtgtcgtc

SEQ ID NO: 12092 - DNA, 443 bp, Zea mays
  Clone ID: cC-zmpo148016b04a1
ggtggtgtccttggccgctcgcttccgctcccctcggagcttcccttgggttggcggcggttggacttcttgggaacggcggggaggtcctggcatgtgcccgaggcgtcgtcgccggccgacttgtcctgcttcttgcggttctttcgggtgcccttcttgctcttctctgctgggaaaccttaaaactctgttaacaagattgtccaagaatatgttggcaattcttgttaactggttctcaagcttcctcaatgggccagtgccattttttctccctgcttctcaatctctttcttttctttttttttctgaaggctagctcagtatttgtctagcctcaggcatcgccaagctatgattcagaaacctacactgaccgcagcggatggccctttgcggtcaatgttgcttggagggttgggtgagaagggaaggattct

SEQ ID NO: 12093 - DNA, 378 bp, Zea mays
  Clone ID: cC-zmpo148016b05a1
ctttaccattttttctgtcttccccccgacaccacaaaatcccgtcagatttttttaatagcctcgctgactaccaatccccttgtttttacttttcaatagaccacatccccaaaaaaaaaaaactcacctccttttattgtatccaaacaaacggcaaaaatttttttcactttaccacttgttattatttgtgaaacacattcaagcatttgcctcaccaaaaccaaaaataccatcaagacctattttttaacttcccaaaaccccaccttttctaacacctccccccaaaatttacactcccattaggcgggtgtgtgtgcccatccctatacaccctatcaaaactcagcacatccattacaaaagaaccta

SEQ ID NO: 12094 - DNA, 389 bp, Zea mays
  Clone ID: cC-zmpo148016b06a1
ctctcttctttttttctttttttttttaccaagcttggccctttttaatggcccacaaaagtccatccaaaggaaccaaattaaaaaatcaaccaacaacgacgacacacacatacccacaacatgatctgagtacatattaacaagaacacatgaaccccaacggacaacaaacccacccacccataaatttcagcatccacgttccaatccacacacacaccccttaccggccaatcgtgtgaacaaacttctaaaacaccaccctgttagtgatatcctcctcgtccatttccctgctgatcagctcaagcgccccaaccaaggcaaccatgctgtctgccataaacaccgggccactttcattaaaacatccttttccacccttc

SEQ ID NO: 12095 - DNA, 462 bp, Zea mays
  unsure at all n locations
  Clone ID: cC-zmpo148016b09a1
cccccnnnaacaggcataaaaaagtcagagatttgatattattcattgaaaacaccacatgtatttttgcaagtagcctcatcaggcatttcattaaaattgaataggtcgaacatgtgtccaaaatgacaagtgagaaacatttggtagcaacaatagacattacagtcttgatgaataggaaaaagcggcttcccacagaccggcaaaaaactttgttcatgctaatgaaaaaacaccaccaaaaggagaaaaaaacggggcgggaggctggcaataatggctcctttcggctttgcatctcttgggcccaaaaaattataagcatttcctgtgcacaatggacgggccaaactcgtcttactcagccttggcaaattcacatcttcttaaaggtgcttagccactccaagatggatcctccaatccaaacactgtacttcctttttgaagaacaaccac

SEQ ID NO: 12096 - DNA, 306 bp, Zea mays
  Clone ID: cC-zmpo148016b10a1
aaagaaaaaattggggccgttaaatttatggtgttacaccgtccaacataatatagctgttggatgtctatcattttactgttgtgcgttacaaatggatagcaactaatggacaattcaaggactagagaaaaattataactagagagatgggtcactccactgagggtctataagcattcaatctccttgaggcaacccttggtgctgcccttggcgttcgtgcatatagccatggtcttgttgttggtgccactatactcgactttgaccacatccatggtgacgcccgtgcatgttaccttg

SEQ ID NO: 12097 - DNA, 455 bp, Zea mays
  Clone ID: cC-zmpo148016b11a1
taaacttgcatattgggtgggaatggactgctacacggagtgactgtacaccgtactaccgagcactgtactcaccgagcactgtcatagagtttacatggagtaagagaacactggcaccggcggtcaaaaaacggacacgggtacatgcagaggccgccggtcgatgatgcaagacaaacagctagcactgctctgtcggttccggggcatgcatggcgatcgcgcgagcggatgcgcgtcttcctcttcagagagctcgcgccctgacaatgtccatgctcatctcgctggggtccgtggcctgcagcttcagctggatgccctccagctccctcttgaaccggtccttggagctcgcgtacagcatcttgctcctgaccctcgaggtgtccggggaccaagagatgaacaagatcttgctcttttggcacgtctcgtcggtggtgaagtct

SEQ ID NO: 12098 - DNA, 517 bp, Zea mays
  Clone ID: cC-zmpo148016c01a1
attgaaattattatgtatgcaaggggtgcgatccgcaccgccttctgtctgtacaaaattcttgagtacaaagaacgtgatatacacactaccggttgcgctcatcctgtactcaacccactagcctggcaccatcagtctccgtgtatctcaggacatgtcagacgattaccacctgtgtccgataaatcttcactcaaagttgtgtgtagaaaatggtcgtgtatgttgaaatggtaacgatagccccattggggacgtgtgttccatggcacgtttaaggtttctttgcttgtacctttttcaggtattttttgtgaagtttcaatgctccagcgcaagctttcttagcatctaagttcccatttacatcgttcaatatcctgataagatcatccagtcctctggcttcttgtaacagcttttctctcttctccttgaggacacttgcaaccatgaagactgaaatcggaaccggaccatctttaccgtcctcagccccattcttatcatcttc

SEQ ID NO: 12099 - DNA, 303 bp, Zea mays
  unsure at all n locations
  Clone ID: cC-zmpo148016c01d1
cacgctccgtctttattgggaancgtaagcttacaggaacatttgagtgcatcatggacggattggtaggcctcttgaaagtccgggtggtgaggtgcatcaaccttgcctaccgcgacgcaagatgcagtcatccgtatgtcgtcctacgacttgctaagaagaaacttaagactagcgtgaagaagagatctgttaaccccatctggcacgaggagcttactctgaccgtcacacattcccatcctatctctgaagctggaggtgttctacatggacacgttcagcagggacgacccgatt

SEQ ID NO: 12100 - DNA, 291 bp, Zea mays
  Clone ID: cC-zmpo148016c02a1
attatcaactcaccatccctttcaatatgggtaggatatagctttttataatttttcaccctacaatacaaaattgttctatgaaggccatggtacatcatcatatcctatattatcaaccaaggatttgtctatttcgattaataatggcattgagtcaaattttggttgtttcaaatgatagacttcgacatttgttatgatttatgagttgattcttgatagcattactaaaaaatgacctgcatctgaaccaattgactaacatgcatatattatatactaggtata

SEQ ID NO: 12101 - DNA, 355 bp, Zea mays
  Clone ID: cC-zmpo148016c02d1
aatttaatttaaaaaaaaaaaaaaaaaaaaaaaaggaaagtttaatttaaaaaaaatatataaaaaataaacataaaaaaaataaaaaaaaatatataatatatattaatatataaataaattttaatttttttttataaaaaataaaattataaaattattattatataactattttttaaataataaaaataatattattaattaataattattatataaaaactatattttaatttaaatatttataaattttaatatactaccttatttaaaaaacatatttttaattccaaattattatttattataatactataaatttgggatgtaaacaatatttttttttttataa

SEQ ID NO: 12102 - DNA, 411 bp, Zea mays
  Clone ID: cC-zmpo148016c03a1
accttcctggacgtcgtccctttctgcgacaggccggccatctggtcggcggcgatggagctgatccgtatcaccgacgtgctgccgctggtgttctgcgggttgttgaactcggagcacgtcttcctgatctcgccgtccttccccgtgagaaccttgagggcgctgagcttctccatggccttggcgaagatggggacgaagtcggtagtcttgtccgacatggccttcactatgggctcggtcgtcttgtccatccccagcaggcggtcgatggtgaggggcatcttcttctccagcaccaggccgaagtagctcccgtccatgtcgttgggcgaggtggagtccatggggacggagcccgagtccttgccgtcgcaggcgtcgctgatcttcttcttgaacgcttcg

SEQ ID NO: 12103 - DNA, 363 bp, Zea mays
  Clone ID: cC-zmpo148016c04a1
ggaggaacccatcattttccggggatttttgtaggaaaacgatatattccccggacaaactccggggatggccggagcctgaaacctgacaaaacatctttggcctcccctccctgctttcccttccggcttgggcacaatacaatttcatttaccccggagctgcactggactgcactggactggactggaccaaaaaatggttgctggcttttgaatgggctcccttgtttttcacccaaaggaaaacccaacaagaacccgagcttccttccaaggcccaacccctgtatgtacaggccaaccgaggcttcccttccgtcccgtcccgttccggccggtcaatttcccaaagcgaagggg

SEQ ID NO: 12104 - DNA, 544 bp, Zea mays
  Clone ID: cC-zmpo148016c05a1
ataaattcatacacaaaggtcacctttttttggcttggaaacacaacacaatacttaaagacatacacgatcgagattcgtaagagtacagacgttgccgaacggaaagctcacttcgaccgagtttaagtggattctgaacacaaataagccaaagcaatagcacacatgttggctgacgcacatctctctcacagcaacaatggcacaatggtccgttaagcagccagcgtggccgtggccgtggcatcggccgggccttctgcctccggagccaccagctgggcgatgttctccacagcacatatcctgccgctggccagtccggccgtcaggtcctcgacttccattttcaccacatcacggcggttgccaatatcagctgcatacctgctcgcgcagtacaccccgacggccatcaccgccatcccatagatgttcgtggtaaccaagcggaatggggtcgagaccaccgcggcgagaggtccaccgatgatggagatagcctgcccgctctgcccgacaacgccctgcttagcgacaa

SEQ ID NO: 12105 - DNA, 412 bp, Zea mays
  unsure at all n locations
  Clone ID: cC-zmpo148016c08a1
gagcggncgncctnnnnttttttttttgttttaatatcaagatcaatatatacaataactcagggggtatagactaatgtcataatctttattacataacaaaaatgtcttacaaaataacaaataataagtaaatcgaactaagataattattcatcgacgccagcagctgactcggagacgacacctacatctcgtcgtagtaattctcttccggtggtacctcctcttcaccttcagcgagctcctactcggaatcttcaacctgctgtgctccaggctcctcggtcacttgctcgttaaagatggaggtgtttagatgcatagccgcggcgcaaggcggattctttggcggagattcacgccggtgaggaattctgggcactctgattgaccatgcgcccgacggttc

SEQ ID NO: 12106 - DNA, 335 bp, Zea mays
  Clone ID: cC-zmpo148016c10a1
gaactgggaaaaatcattttttggtactgtacctgtccatggatctttaatggccacaggtgccataaaaataataccccacaggattagagggggttttaaagagtgatttacatgccgacggacacatttatcattggccgcaaccgtttattctttattggccggtgaggcatccaggaccccttgccacccaattgttcccccctattggcagccccccaacaggcactggcaatacggcctccacaaccatgcccagttgcagcggccctccgcgtggcccgcatcctgggagggcgccacccaatttttggaaaaacatatagggtggg

SEQ ID NO: 12107 - DNA, 474 bp, Zea mays
  Clone ID: cC-zmpo148016c11a1
agaggcgttgcctgtcggaacccagcagggacagccgagcgtgttgccagggaggcgaggaacactctcatgtcacaggcgcatggcctggacaggaggagcaggaagactacagtgaatgcggctagcatgggggcatgcatcagcacgcgctggcgggaggagcgcgctgtcactgcctttgccggagcgcccgctgttccgtccgtatatggataaacaacagcaggcgatgccgggagcagtggagctgctgttgctactaccaagaccgcatcaagagctcgtctttattgcgctttctttctccgtccgatcggaggagccctgcggttgacgcgatggaatggaacccactttgcgacagtgaggagaaaggtaaagttcttcgatagaaggtttaacacacacacacacactcattataattatgtccgattccatctaatcgatacccggggatcggtggaacca

SEQ ID NO: 12108 - DNA, 423 bp, Zea mays
  Clone ID: cC-zmpo148016c12a1
acgaacagcagtcacacttctccatgaaatgagaagggatgggatatatataatgaagtcgacgaaacaatttggcaggatcgagtcggataatatatattcggaggcatgcaatagcatgcatgtgggtaggcttggccacactttgcgtatctatatataattatggcaagaacagtagtagccggacacacaatcgagcccttaattagttctcggttttgaccaccttgcttggctggacgcacgcttctcagttcaaccggacgacggccccggcgccggcgccggcgccggcgcatcggattccgtatcagccagcttcatgtccgcgtagacgacgcggccttcggactcggggctgctgccgtcgctggagccgtcgacgctgccgaggacgtggttgtctttctggtgggcgga

SEQ ID NO: 12109 - DNA, 344 bp, Zea mays
  Clone ID: cC-zmpo148016d01a1
ggaataagttccaaggtggggaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcaaatgcaggcgagctcctttgccaagccgatggacttgccgatggcgttcttgcagacggccatggtcttgttgccggatccattgtacttgatgtcgacgttgacgagctgcacgccctggcatggcaggttgttggcgcaattgagcgtg

SEQ ID NO: 12110 - DNA, 311 bp, Zea mays
  Clone ID: cC-zmpo148016d01d1
cacaacagccatgggcgcctgggcaacgaattcttttacgcttgaggggcaggccccacctgaggccgccgtcttcacacccaatgttgcgcccgatgccactccaatctccgatgaggttgcggctgatgaacaggtatctgataaggtggtggttgaggagccggctgcggcggccgacgttgagcatcataaggctaatgacgtggtctctccaaatgctgtcgtcgccgatccccatcactaggaggaggaagccgtggataataccttcttctttgatgataagccagcggcagccgccaattcat

SEQ ID NO: 12111 - DNA, 518 bp, Zea mays
  Clone ID: cC-zmpo148016d02a1
gcagaaacgcttttcatgccctgggtttgatcaaaagtagttttgtttctcgtacccatgagacccatcaaatcaaattaatgaagcacccatcaacaattagcaagaccgatgaactagcaaggcttcttgcagaagcacttgcgcgtggccacgacctgcttgcactcgccaccgggaaagctctccttcatgcacacatcggcgcatctgtcgctgttgaagcagaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggagaaacaagaataggacagctccctgagacactgccatccttctctcgttttagcaagaacaggaacggctgaacctgctggcggccccaaccttgatgggtgggtgacaacgcaggct

SEQ ID NO: 12112 - DNA, 508 bp, Zea mays
  Clone ID: cC-zmpo148016d03a1
aatattgcgctgtatcgtgtacttaaaagacaggatcctatcacttgacttcaattatgatgcatgtcctcccaaactttacaaagccatccggcattatctcccctacgatcgaatcgaagcaacatgaactaccctgaccccgtgcttcagagagttcctgttcctgccagcaggaggcaatggcgacaggaacagcagctaccatcgatcatcaggtcacctggttgttgcagcagcaggagcaggaccaggagggaagttcacccactgcagctgcagctgtatctccccgctctcgacgttcctgagccggaggatcatgtcctgcgcgaacttgccgttcctccagcacacgtggctctcgtcggcgaggcagttcctggcgctcggccgctcggacctgatgatggcgccgttcctcagactctcctccgcgggttcatgctcaccgcctccatcagtggcgccacgtccacctccgcgtctcccatgggtcgtctctgct

SEQ ID NO: 12113 - DNA, 526 bp, Zea mays
  unsure at all n locations
  Clone ID: cC-zmpo148016d03d1
gggacaanangatgaagatgagtttngttgcgcagacgatgagaaggcaacctagaggganctattttctgatatagaagagagtggatcacagtacatccctgactctgatgatgaagaccacgatgattgtgttgtagatgacaatggagatcctctgtttgtcacaacaactgacttagagaaccctaatattgcagtaggtgttagatttgaggatgggcctactttcaaaaaggctattaggccgtgggctatcttacatgaggttgaaattggggctcactatagtgaatcttctaggtatagaggattctgcaaagcaaagaagtgcaattggaggatccatgcatcacaattgcctgatggtaaaacttggcacgtaaagaagatgtcaaagaggcactactgcaggagcagaagcaagatggagaagaattgcatggccaatcagtattgcgttagaaacaaaggtagtgccgatgcttagggaaaattctaacctaagtgctggagctctggtgaa

SEQ ID NO: 12114 - DNA, 610 bp, Zea mays
  unsure at all n locations
  Clone ID: cC-zmpo148016d04a1
aaacatgggccgcatgatcgctttgtcgaacttgcgccagtagtagtgggccgggtgggttggcttgcttaggagcatccggaggctggacggcctcacaatctgtgccgaccccgtctcgatgtccgagccctgcatgctcgtcaggagaggcgagtgcagggacttgggtgaggacggctcggaggtggccgtgttgctgcaggcagggagcagcagccgcatcaatggcttcgtcatcatcccaaacaccatagtgctaaacaggaccacagtgatcgtgctggtgatcattatcgcgttgccgtgcagctcagtgtgtccagatctcgtgaacttgttgtaagcgagagcaatggacacggcacctctcatcagtccggcccaccatattacaatttgctgtctaaatgttattttctccaatggagacttctttgtcaggttggacaaaaacgacaatgggaaaacaaatgcagctctcctcaccagaaccaaccctagcanaatcgagcttatgccgatggatttaccggggctgtcacttgcaaactcccacttctcgatgtcgagggcatccatcccacatacaggaagagaaaagtctaac

SEQ ID NO: 12115 - DNA, 611 bp, Zea mays
  Clone ID: cC-zmpo148016d05a1
actcctatatttttttctaccacccccatttctttctagcctagtttttatttaaatactcggttcttaaccccccacaaaaaaaccggacgaataaaccacaaaaacacccaaaccccaaacataaaaaagcacaacaacattaacataaaacacaagtccacatcaaaaacaaacggtgcatacaaatcaaaataatacccccacctccacgaaaaacactattaccaaactcaaaaatcccacaaaaaacaaacaaacaccttaaaaaacaaaaaaaaacacctctcatgccaaacaaaacaaaaaacaaacaaaaaaaaaactgctttaaaaaacactagcaactttaaaaatctaaaaaaacttcataccagcaacaaaaaaaaaaacccaaaaaccccagaaaaaaaccccaccaaaaatgtcaccacgatctttactacccttaaaaagcaaaaacaaataataaaaaatttcaatcaatcaaaaaaaaaaaaaaattaaaattacaacccaacaaatccataaccccaaaataaaaacataattacaatccaaaaccacaaaataccatataacttaaaataaaacattataaaaaaccaaaa

SEQ ID NO: 12116 - DNA, 402 bp, Zea mays
  Clone ID: cC-zmpo148016d06a1
caagcactctgttacatttttttagttggttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcaaacggggagcggcacgtccttgaagtagccgagcgggttggcggggcgcaggctgtcggagatgccgacgttcctggtgagcaggacgccgtcgcggtccctgagcgcctggacctcgttgcagtccttgcgcgggctggccaccagcaccacctggcagatgtcctcctcgtggctgaccttgagcacgatcgcgtaggtgcctgtcgcgt

SEQ ID NO: 12117 - DNA, 123 bp, Zea mays
  unsure at all n locations
  Clone ID: cC-zmpo148016d07a1
aagccangattaagggcgcaaagatttacaagcaaccaaccacagggctccgttggacttgacccatgaatacattacatcaaagtttactcaactccgattgatatatgctcattagaactg

SEQ ID NO: 12118 - DNA, 481 bp, Zea mays
  unsure at all n locations
  Clone ID: cC-zmpo148016d09a1
gagcggncgccctnntttttnnnncccttttctttttctttctctttttttttttttcaggctggtttttatttttttatccttccttcccccttccttcttttccttttgaaaaacccaaaaaaaaaaactttttccaaaaaaaaaaaccccctttaaaaacaaaagccaaacaaaaaaaaaagtttatctattaaaattattctccaatcaaaaaaatctccccccaccataccccttattccaaactaaaaaaaataaaaatttcccccccttcttaataacccccattcaattatttattacatccccaaaaaaattactttttggtacctccaacccccctaaattaaatattatttttacacccctatatacttcctagatcataaaaaacaatatttttctcccccccacaataaaaaagatctttaactactataaacccttatttttctattttacctctactcttatatta

SEQ ID NO: 12119 - DNA, 470 bp, Zea mays
  Clone ID: cC-zmpo148016d12a1
gcataaatactagtcttcaattgattattgatgggagcccgactacctggtagacttgtagcaattgtttcatgattactgttacaatttacaacagaccatgaccttcagcctgaattcacggaatctacaatctatccacatcctcaacgatgcagcacctttcagcagccttgcaggtctctccacttgaggtacacaagccctgcgtggtagtgtgtgtaggctccggcaacaaccaagacgtggaacagctggtggctgtgcccggcgatgtcaaacttcccaggcatccagcgctcaggtacccgtgccgcatataccaatgctcccagcccgtagaagagccccatcagaatttcgtatccggtcgtgtgcaatgcctccggttggtgccagaagaggaccagcttgtgagaacaggtatcacgccagatgcacccatgccaaagaagaggcatgctctgatg

SEQ ID NO: 12120 - DNA, 442 bp, Zea mays
  Clone ID: cC-zmpo148016e02a1
gcagcttaatactggggatgtttctcaattggagctacacagtgacagctacacaatcctgcaacagcgagcagtccgatagaaccttgaccttacctaagatcaaaagattaatcacaaccgacctcacatttctattcggtttgactgtttgaggaatggatcagcacattctatcaaatacaaggtcttttttcatctttgtctatggaggaactctcctcgtacgtacgatcagtctcattcttgagtcatcacagagcaagtacccattatcccttgccttatcacaacattgttaaaccattccttgctaaggaaatcttcgtataattatgatggaatcatctcaaccctgatctgtgacactctaggacagcaggtatattgttcagaagctttcttagaatagctcaccattcttgatcaattgcaaaggata

SEQ ID NO: 12121 - DNA, 374 bp, Zea mays
  Clone ID: cC-zmpo148016e02d1
gggcgggggagcccggcaccgacgcccaccacgtcgtggtctttttgttctcgaggtagcacgccggcgggtgggggtgaggaggttcgtgcccccggtcgcggtctatgaggactagaccgtcgcagtcgttcaagatcacgttgtgttgccccttggcgtcggtgtgcagctccgccttccctgatacgttgactaaccgccgcatggtctccttccgctccaggaccatggcgttggggcgtgtgagactcgagctcttggtgtcttcgtctccgttcactcggcataggaaccccgccacggtttgctcgaacagtttttcttggaacgggttctgtgacgaggccgctccataccttggagactcactt

SEQ ID NO: 12122 - DNA, 375 bp, Zea mays
  Clone ID: cC-zmpo148016e03a1
ctctcttattaaaaatatcctcttcttctaatggtcggttttttttcaaaacactgcccctccactcacaaaaaaaacaaacattacatgcccaacaatttcttctacaaaaaaaaaactgccaaaataacatcacaaaaaaccctacaatcagatgctccctcactccaggtcccaactcttttacaaaagaaaaaaaaaagataggattgattgttattagcttttcccaaacgactgcccttaaaaaacaaccgactcataaggggaaaccctatggataaacccctaaaaacactccaaaaagaatgcttcaattataatggccaccaccacttaacgatccatactttcctcaaaactacctctccacca

SEQ ID NO: 12123 - DNA, 388 bp, Zea mays
  Clone ID: cC-zmpo148016e04a1
ctgtgttctcaagaacacaagaacgataattgggtacatcttgataccatgagtcgatacagttaactaacaacatgataacacattgaaaatcaaacagaaagaaaaagagggagagcaaggatgtatccatggatgagtggatgaccacacattatcatggttttaaagacattgctctcatttttcttccatgtcttgttccaaatttaaccgggccgacgtgtgtggcctcaattggtggagtcatcatcgacatcctcattgcctgacaggccttcgacaccctgggggccaggagcagcagtcggccctctaggtccataggctggcgcgtgagccacaggagcatcggtcgactttgccatggccatcggtgctacgacca

SEQ ID NO: 12124 - DNA, 139 bp, Zea mays
  Clone ID: cC-zmpo148016e05a1
aaacgacccataacggggttatggaagggaacaatcactacttgaatgtcaaatggagggcgttataaaactgtggttgagaccaaaaagaatcacccgtattattgggaactaatctaaaaaaagtcaaaggaatttt

SEQ ID NO: 12125 - DNA, 248 bp, Zea mays
  Clone ID: cC-zmpo148016e06a1
cccatcaatatttatcgggggcctaccatatcaaccatcttagtgctatgagctgttaatcacatcatcacaaaagtgcatcgcaactttgctgatgaaagatcgaccaaccgctttcacgaaggttacctgctgtacactccgaggctgccttgccacttatcatgacactcggacccttttgctccagaagacccaactaaacccttgtgtcagtcaggactaagaaacctgctgcagggaagtgc

SEQ ID NO: 12126 - DNA, 413 bp, Zea mays
  unsure at all n locations
  Clone ID: cC-zmpo148016e10a1
gagccgaggcgcacacatttccccgatggttaaattgaattgttgaactggtccaaacaaatggcaagcaatggtacaggtgtccatcccttttttgagggaaaaaacaaataacggggcaccaaattaaactggtacatcagcgatcccaattagttaaatgaaaatcaaaaagaggaagggaaaaaaacaaacaaaaggaagacgaaggtgtgccactgccgtgcccaatcagagcacacccacccacccattggaaatgcccggaagcagcaaagcagcccancccaaccaagtttttcccccccttggttttttccttccggcagtccggttcctcgtccggcggtttattgaatgtagtacggactgaggaaggaggccacggcggccccaacaatggcgggtgcaac

SEQ ID NO: 12127 - DNA, 247 bp, Zea mays
  Clone ID: cC-zmpo148016e11a1
aatggattcaaacaagcggcgtgttattaaatgattcacagcccaatccctctctcatgggaagaacattatcgtcatccatcaattccttaaattaatgagaaagatggaacaaataaaaatatgacaaatggtctgtcaaatcaaaaaacatgcccacccatctgaatgcgcccagccatgtcactctctctccccttcgattcttcctcgtcctccggacgccccactcggcttctcttaatgt

SEQ ID NO: 12128 - DNA, 452 bp, Zea mays
  Clone ID: cC-zmpo148016e12a1
acaatataaaacaatgggtcgtttctcttttttttttccctctaaatcaaaaccaaaacctgcatgctttccacccttacctatacaaaatcttattacaccttctccaaattatcctcataacttcttttcttaaaaaaaaaaaaattcattcacaaattcatacaacattcgaaccttaagcaaaaacataaaacccaaaaatccccaaagagaaaattaactcacattaaatacctttcactaatttccccccttccagtcctaaaacccatttttcccactgccttaataaaccatccaaaactcgataaaacttccttttcaaatatattaccaacatctcttttctcttaaccaaaaaaaaattcaacaaatgaattccctcatcttcctttccctacaaaaaaacctcaaaccctccacccctcttttccccaacaacctaaaaa

SEQ ID NO: 12129 - DNA, 493 bp, Zea mays
  Clone ID: cC-zmpo148016f01a1
caatcacacacatatatatattgggctgggtttacaaaccatacgacaaccaaactttaatttgggagtggaatcacaaaattatttgccaaaatgcatggtaccaacaaggaacaaaaatctcaggggagaaatggcagacgaaggatgagagatgattaacagagccacgcacaatccaagggcgtgtaggagactaaaaatgcgtgcgtagctagaggaggctaccaattaaataatgcgggtgttggtatcgttgctgcgaaccatggacaagcgagcgaggttaaatgaatccattcacaggccttgctctacgaggtagtcgccgagcctctcgaccaccatgttgcactggccgggggtcatgggctcgtcgtagatgccgaccaccatcgcttgccctgtcttcttcacagttatgcctccagatcccttcttcccgcggatgacaacgccgggctcgccttggatgaccatgtacttggtgggg

SEQ ID NO: 12130 - DNA, 481 bp, Zea mays
  unsure at all n locations
  Clone ID: cC-zmpo148016f01d1
cacccgggcggcanagncggccacgacggcnccgnttgggcccagatttctctctttcccacagttcaagacagaggagagtaccgacttcattaaggacttcgacgagccctgcttccttgccccgaccggcctcttcctcggccccaccaagtacatggtcatccaaggctagcccggcgctgtcatccgctggaagaagggatctggaggcataactgtgaagaagacagggcaagcgatggtggtcggcatctacaacgagcccatgacccccggccagtgcaacatggtggtcgagaggcttggtgactacctcgtatagcaaggcctgtgaatggattcatttaacctggctcgcttgtccatggttcgcagcaacgataccaacacccgcattatttaattggtagcctcctctagcttcgcacgcattttttagtttctacacgcccttggattgtgcgtggctttgttaatc

SEQ ID NO: 12131 - DNA, 308 bp, Zea mays
  Clone ID: cC-zmpo148016f02a1
catctgagccccctaagctgatcctagagcggcgcaggtctggttttcgacgccggagaccgataggtcggtcggcccactcggcagcgggacctgaggaacgcccggccccgcggccagactgcgcagagcgggacgctgaggagaagagagagaacatggcactcgcccccggcagcagtgaatggatcatcgcggtaggtcgcctcgctgcctgcctggccggtcacccagatttttctatgctttcgtgcagaagacagcagactccgacggtactaatgatatacgcatgcggtcagttctaa

SEQ ID NO: 12132 - DNA, 464 bp, Zea mays
  Clone ID: cC-zmpo148016f02d1
ggcggccacgcgtccgcctagcggcctcccttttttttttttttttgtatataatgaaaaaaataaattcaaaggtacgttctttattacataaaccattcatacccacattttcacgcagactttcactcagacaattctaaatcctaaactatatactacacttaaacatccctttataagacatcgtctaacccaacaaggacaccaagaacgtacctgttgaaatctttactaaactcgccacaacattcacttaattattcaattgacgaatctgcttaggtaggtcctttttgcgcacacttattgaaacaacgaaaaaaaaaaattactaaaaaaaccacttgcatgacctgtcacaatcccaaagcccgaccaaatgctccaacaactaatcatacaaagatccatctacctcttggcccgacccttggccccgaacttgttcatgttcctcttca

SEQ ID NO: 12133 - DNA, 402 bp, Zea mays
  Clone ID: cC-zmpo148016f03a1
gcggcctcccttttttttcttcttctctgcttcgccggaacaacaacatatctcggtcgcttaaacaacatgtcagcctaaaacccccacaacgatcaatacaatgtgcagggcaaacaactgcatgcacctcattcccagaaaaatactccatggctgagcacatacttacctttacgctcatcacacggatcgcctcttcattacgactactaatcgcaatttaagctttttcacacccttttcagcattaccactgacctcacccaacgacatgtagtctactttattggccttagaatttcatattcgcactaagctcccatttttctaaatatgcacttgactttggactacgaactaacccgacaggctgatttaaccttaactttttttctgtta

SEQ ID NO: 12134 - DNA, 313 bp, Zea mays
  Clone ID: cC-zmpo148016f04a1
aagcttcatccttagagcggccccctttcttttcttttctttatctctcccctcgtatgaatcaagcagtctgatacatttttaattttccttcacttcctttactttccgtaaatactgctatccattccatgcctcccctctgtatcgctacaactccgtccatcatgtcccctactccctcttcttttatgttaaacctcaaaactctcgtcccaagacagctccataaacagctcgcaacaaacggaaatcggtaccacctttaattaacctaccaggttcactgggcccaccttcttctaaatcccaa

SEQ ID NO: 12135 - DNA, 388 bp, Zea mays
  Clone ID: cC-zmpo148016f05a1
cattcatcttcttttgtcaaattaacacaaatggatggacgacatatatgacagatcaccgtggtcaaacaaattttgtcgagaatttaaatacgggtatatatatagagagaagctacgcacaacgacagcaatggcagtagtttttttcttttctttttggggtgcgtatgtgtaattgcgtatatatatactgtcgtagcgccaccgcctcctccaccgtccaacggcacgtacggccgcgacgacgacgtcaatgtatggtgtgcgatcggtggagccaggctgcgtgacctggcaggcaggcagaccataccagaccagaccgaccggctcggcgacgacggcgcgccccggcagcagctagcgctgggctcatttcatgttg

SEQ ID NO: 12136 - DNA, 269 bp, Zea mays
  Clone ID: cC-zmpo148016f06a1
ctttctttctctctcctttttttcttttttttttttttttcgtttgtttttatttattttttcctcccttccctcccactctttctttattattactaatccccctcaaaaaaaaaaaaaaatactttaaaaaaaaccccccccccccttacaaaaaaaaaaaaaacaactaaaaaaaaaaaaccaaaaaaacaaaaaaaccaaaaaaaaaaaaaaaaaaaccaaacaacaccccctcccaaccaaacaatccctcaaaaaaaaccaaa

SEQ ID NO: 12137 - DNA, 303 bp, Zea mays
  Clone ID: cC-zmpo148016f07a1
aacttcatgctgcattgctgctaggagatcgacatcgttcaataactccttgaatgatgttacatcctgcctacgtggtgtaccttttacgaaaggaagattgaagagagcagacagacagctctgcaaatcctccctttgccatgtttcccgttaattagctccccctctacggtcatctatgcttcatgtcgtcgtctgccctgaccatttcggccctaggaggactgctatcattgtctgtcccgctatgcgtgctcttgtgttcagcttccgtgcctccgggagggtagtatttgcggg

SEQ ID NO: 12138 - DNA, 314 bp, Zea mays
  unsure at all n locations
  Clone ID: cC-zmpo148016f10a1
gaggggccgncctttttttttctttttttttttctccccccacacttcttcctctagaactgttttaattataaataccatacccccccacctaaaaacccccccccctacaccaacatcacaacacactccttcattaaaccacacaaacaacccccctcccatacactccccctctcaattccaaaacaatatcaccccccacacaaatcacacaatcctcccccccccccaacctcttcaaaacaacttctctccaccaaaaaaccatccccatcccacccacattcactccccacccccataaaatcccc

SEQ ID NO: 12139 - DNA, 367 bp, Zea mays
  Clone ID: cC-zmpo148016f12a1
ccctcttcttttctttggtttggttttttttttttcttcctttcccccccctctccttttttttaaaaaaccaaaagccccctcctttccaaaaaaatttacaaaccccaccttcttgaaaaacttcttttttcccccaagctttttcccgtcacaacccaacaccccccaccctccaaaaaactgtcctttttcaaaaccccaatttttccctaccaataaaaaaacccaccccctacctccccaaacaatggaacccccacaaggtaatccgccctttcccaaacccccttaccaaaaagctttaaaaaccctttccaccaattctttttttggaaccaattaccccctctttttccccccaaag

SEQ ID NO: 12140 - DNA, 286 bp, Zea mays
  Clone ID: cC-zmpo148016g01a1
cctagctgatccttaacgcgctttttttttttttttttttttaggagggtggattatgcttccaatgctaatggaaaataactacctactgacaacccattattacatcacttacaaaggaaaatgcattgttggccctgtcttcttcttacctctggtgacagagactaccactgactgactaatctcccgtctcattctgagcgagacattctgccaactccttctcacaacgggtcctggcagcatctgcctggcgaccacggatagcccttctagctgctcg

SEQ ID NO: 12141 - DNA, 320 bp, Zea mays
  Clone ID: cC-zmpo148016g01d1
gacatcaagtacaatgggggcgcgacaagaccatggccggctgcaagaacgccatcggcaagtccatcggcttggcaaaggagctcgcctgcatctgaaccaattgactaacatgcatatattatatatataatcactcttcgtaacctctctctttctcacgtactctcaagtctccaccgaatatataatccgctggctcgtattttctttcttctttggatcatcacaaaaccaaccgatgtaattattattagaccgacgcctcacaatcttggaacttattcagagagaagaattatttaaaattaatttaaatt

SEQ ID NO: 12142 - DNA, 245 bp, Zea mays
  Clone ID: cC-zmpo148016g02a1
atccacacaacaaaatttaaatattaatattattacacatcataatatcctaaaaaaacaacaaagtaatacccaatatacataaaaaatactatagaaaaaaaaaaaaaatttaaaaaaaaaaacactaacacaccctcattcacaaaatagaacaaccttaaaaacataaataaaaaaccatccaacacctaaaacaattgaaaaaaatacaaacgttacaaaaaaagaataatgaaacatac

SEQ ID NO: 12143 - DNA, 439 bp, Zea mays
  Clone ID: cC-zmpo148016g02d1
aaacgagagaagcgtggcagtgactcagggagctgccccattcttgttcctcctcgtaacaacagaagtggtaaccatctattccaaaatgggaatagccatgcccattcatgccttgataatggataaagcgaaacagcacgagacggaaaataatgaggagaaaagcacttataaggaagagagtcaatgcttatctccgagtctccagttcgagggcttctgcttcaacagcgacagaagcacccatgcgtgcatgaaagaaagctttcccgggggcgagtgcaagcaagtctttgccactcgcaagtgcttttgcaaataaaccatgctagttcattcggtcttgctaactgttgaatgggtgcttcatttatttgacattaaaggccttattgttacgataaacaaaaccacctttgataaaagcacggcatta

SEQ ID NO: 12144 - DNA, 431 bp, Zea mays
  Clone ID: cC-zmpo148016g03a1
gttacgtgaccacaaatcaacattaacagtagggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcatttgagcgtgatggcctccggcgtgttggaagtg

SEQ ID NO: 12145 - DNA, 453 bp, Zea mays
  unsure at all n locations
  Clone ID: cC-zmpo148016g04a1
gattaatacagggattgccaggaagccaggacaagcatggaaacgccaaacgtggttgttgtgacaaagttcacgcttagccaaggttatgcggcgacgcaatggcggaagcacggtggttggcggcgggcccagccggccagcccagtgcagataggtgagatcttgggtgggggactgggggcccaagttccaccaacgcacctacacgctcagaaaagctccagcttttacagggaactgcgcgcgagtttacgctgcagcactgagagtaatccanaagagagatgatggagtcgtgaaaaaggcgccgcatctttctcttccctgaccagatgaaccgctgctgcaccggcacgtcctcctcgtccgtcgctgaagctctgccacccctcctaaggaggaggaggaggcaagagagtgggtttccggcttcagtcgtaagggttcctg

SEQ ID NO: 12146 - DNA, 511 bp, Zea mays
  Clone ID: cC-zmpo148016g05a1
gcggcgacgccgatgcctgtatctgccgctcccagtgcagcccagcccgcgacgccgcgaagtagcgggaggaggtgtccacgatggagtggacgctcaggtacgtggccgtcatggccaccaggaagagcgcccacaggaacatggtccccgtggacgcgaagcaacggtgcaggtatcggctcatcgcccccgcccgctccaccttcaccttccccggcgtcgacgggtacaggtcctcctccagcactcgcatcctcctcgcatgcgatccacacttgcactgcagcccactccggcggccaatgcgctaggagcttttgcagctggtctcgctcggtctcgggatcaagccgtcgattccacctcctgctggctgctactcctctatatatgtgacgacgttcttgcatgcgctttccttgcaagatcgtcttctcggagttggcatggtgcacgacgatgagcggaggcggccggcacgcccacgcgtacgctgacgcgtgggtcg

SEQ ID NO: 12147 - DNA, 283 bp, Zea mays
  Clone ID: cC-zmpo148016g06a1
ctcttctctttaccaagacacgctgtgggcatgcacagtgaggaattggtgattgctacaaccacaccccatgaattcaggaagagtttacaggagcaacttacaaggagggaggaggacacttacaaatcttcccggcgaaaatgaaaatacgaacgaatctttacaaatatatatatgtgtgtggattgtatttgcacgcaaaaaaaatcaaatacaaaaactgagtcaagtttacacggtgtacctctgctgaatggtgtcaatgtaaacgcccttaaac

SEQ ID NO: 12148 - DNA, 323 bp, Zea mays
  Clone ID: cC-zmpo148016g07a1
cacccaataaaacaccaaatctttatttttttttttttgtaaaaaccaatcccatcttacaccaaggtcttgctttcatttttaagcgtaattccaatatcccttacttcttaaaaaattttcacaaaacatggtgttaaactaaaatcaaacaaaccaaccttttttgtcttactttttttcggacccttgggtttacccctgaattttttacccgtccctgaagtcctaccacttttcccttataattaatccttttataacttttctttattaattttataaccattaacctttttaaaatatttatccatacaatttct

SEQ ID NO: 12149 - DNA, 265 bp, Zea mays
  unsure at all n locations
  Clone ID: cC-zmpo148016g08a1
gcggccgncctttnnnnaaatttttttttttngacaagaacaaaaatccagcagtcaggatttgtttcaaccacccagttacatttttgttttcctttcctttctcagttacatattatcaatccaattgaagaagatttgtggtttaaagccatccattctgttacgacagatgtcggtcctcaaccacgtgctattacatatcaatcgtcgcccacaattttctattactcatcgtcgtctatcttccgattccaaccgtttt

SEQ ID NO: 12150 - DNA, 279 bp, Zea mays
  Clone ID: cC-zmpo148016g10a1
cattaacagagagcattccaattatatgaggaaaggatacccacagaatctggacaacggtggcaatatatcacaatttcagaaaacaataacacacacgactgtagatacacacacaagctaataacagcagtaaggaaaatacggcagtacatgaatatacatacttaaggtagtaggattgtaggaatacgtagtcgcgatttgtgtaccataggagcgatgaaactgaaacgctttgcaccgatgagttggcgtccagatcaggcgtgctcctcc

SEQ ID NO: 12151 - DNA, 188 bp, Zea mays
  Clone ID: cC-zmpo148016g12a1
aatttaaatacaaatataatgctacgaataacaagaataggtttctgctcgatgatacataaacaaactccagtatatggtttgatttgttgctttccgtagctatatatagtagtataatttttgagctgcataaatagttccgcgaaaataatcgatcaagaaaatggcagtgacctcaagcatag

SEQ ID NO: 12152 - DNA, 470 bp, Zea mays
  Clone ID: cC-zmpo148016h01a1
gcccaattagaacatgttgtttcatggaggaactccgtggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctggcctcctcgacgtccttcttcttcgcctccaccgtcgtcgtggtctcggcggcggtggcgaccttttcctctgcattggcggctgccgctggcttctcctcctcgacgacggtcttctccacggcttcctcctccttgtgatcgggctcggcgacggccgcctctggagcgaccacctcattagccttttgatgctcaacgtc

SEQ ID NO: 12153 - DNA, 230 bp, Zea mays
  Clone ID: cC-zmpo148016h01d1
atgctatcaagggatagctatatttcataacaaatgtcgaactctatcattttaaacaaccaatatttgactcaatgccattattaatcgaaaaatacaaatccttgctttataatatatgatattatgatgtaccatggcctttatataacaatcttgtattgtaggctgaaaaattataaaaaactatattctaaacatatttaaagggattgttacttgtgattatc

SEQ ID NO: 12154 - DNA, 405 bp, Zea mays
  Clone ID: cC-zmpo148016h02a1
gaaacgtgaccacaagggagcggtaacattatggaatgggattacacatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcaacgttgacgagctgcacgccctggcatggcaggttgttggcgcacttgagcg

SEQ ID NO: 12155 - DNA, 329 bp, Zea mays
  Clone ID: cC-zmpo148016h02d1
acatggacgggagctaccgccgcctgttgctggagaagaagatgcccttcaccatcgaccgcctgctggggatggacaagacgaccgagcccatagtgaaggtcatgttggacaagactaccgacttcgttcccatcttcgccaaggccatggtgaagctcagcgcccttaaggttctcacggggaaggacggtgagatcaggaagacgtgcttctagttcaacaacccgtataacaccatccggcagcacgtcggtgatacggagcagcttcatctacgccgaccagatggccggcctgtcgcagccagggctcacgtccaggaaggt

SEQ ID NO: 12156 - DNA, 477 bp, Zea mays
  Clone ID: cC-zmpo148016h03a1
tctttttttttctctctttttttctttttttttttcttttttttgtttgggtttttttttcttttttgggccacacaagaggacaccattacacaatgttcaacaaaaaaacaaaattgcacactgttttacactaaaaaacatgactatacaaaacatatttcccacctttatggcacattacaaaacctagtataatgagtaacataagtaacactacttgcttttggttcccctctggttcttttttttttacactggacttgatggggcaggcaatgacaaaagatcattttttaccaccaccacctttttttttttttgggtaacccttttaggctttggagcatttggggggggcgcatatcaatcatatactgggtcattacatggccccatttggggaccaaactgaccacattttttgcatttgggcctctttttccccgaccctcattttactccaaagaacctttt

SEQ ID NO: 12157 - DNA, 441 bp, Zea mays
  unsure at all n locations
  Clone ID: cC-zmpo148016h04a1
agctctcattgaaacgtgaccacggagcaggattaacattatggaatgggattacagatatacactagcataatgaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgaggncgacgttgacgagctgcacgccctggcatggcaggttgttggcgcacttgagcgtgatggccttcggcgtgttggaggtg

SEQ ID NO: 12158 - DNA, 515 bp, Zea mays
  unsure at all n locations
  Clone ID: cC-zmpo148016h05a1
aacacacaaacacancatacaggggattgctcttcttttagtnttcagcgagttagaacaaccttaccnagggaagctggaaacactaagaaaatntggcgatgtcggaataaaanggccacacanaggcacaacacanccacaacanttacacaacnagaaatattgaaccacaancccaaantcttagctgcatgactgtccgtttggggaactgttactgttattgggcaacacanctgtagcatgcacaccctggagaagcacaccctttaggattgctttgccgacgtcaacattggaggaaatgtgttatcaggcgctctaactcatcaccctggttaggagagtccgcctgtgcttttggagcagacctgttaagcgaattcctgcgggttggtcccttccctgattctctgccaacattatttgggagggataaccgcttcttggctggtgcattcacttgcacaagcttatcttttgaattgcgcacatccttagaacctatatct

SEQ ID NO: 12159 - DNA, 375 bp, Zea mays
  Clone ID: cC-zmpo148016h06a1
gaaaaaaatggcctgggaaaatggcatgtatatttaacattttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtaaaattggaccttggaagtgtagacggcatcgggtctccagttcggcgggatgacgtctttggcgatgaccttcttgccggactctctgtttaagcggatggaaaaggggcccttt

SEQ ID NO: 12160 - DNA, 487 bp, Zea mays
  Clone ID: cC-zmpo148016h07a1
aattacaaacacacacacacagattcgggggcgggtttacacaaagacgcaaggttcctttgctcagtccggcggtttttagcagcccaacaaccccactagagaaattcatactagttactggctggatctgcatcaccacaagtcccagacaatctggatatccattccatccttcaacagagcgctgataacagagaagaatactagtgtgccgtgccaaacgacaagaacactccacccaacaggaaactgaaggcacaaatataccacactcactactgctcgcagtttgcacaatccaaccgcaaaaaaaaaaaaaggttccacttctaccgtgcgcatcgtcacaagctcaacatcattttaacatggtacaaggttctctcttaaaacactccaaaacagtcgcatgaaggcctgagatggagctcaagactggattggcttgatcttgaagtggaggttgatgagtgaaaacacgaag

SEQ ID NO: 12161 - DNA, 480 bp, Zea mays
  Clone ID: cC-zmpo148016h08a1
gaactgtactgatataatatattgggcaaggcaattaaaaaaatatataacatgttcatttacacatctgaaaatgtcgcagcattttgtttgtcaaggtggtggcgcataactttgtccagtcactgcaatctgagaattcgttgtcctggtttggccatagcattgcagggggaggattgaggagtagctcacattcactgataacgttgaggaagggttacaccatagagaaggggccagaaaagaaaattacaagcagacatcagcttgaactgatggtatacacagctaagaacgctataagcagacacccatcagagtaattttctcatttgcaatggctatacatagagcccctgtcactggcaagcagtataggattgaattcgaagagctacgcataaccatcacagaaactgcagcactgcacggttcattagctttcttcagactgtgtgggactgggcgagacacagc

SEQ ID NO: 12162 - DNA, 473 bp, Zea mays
  Clone ID: cC-zmpo148016h09a1
agagttagagaccagattaatcaggtccagtagttacataacggttgaccccataatgttacaagagcaaacgaagtgagcaaagcaaagaaacacttggtccctccctccccaccagacgagagcgattacagcacagccaattacgtgtccaccctaatgtctcaccgcgacacgaccatcgtcggtgagtttagtagaagaagatcatggtagcaacagcagcggcaacgccggcgatggcagctccacttccaagggcagcagcaccggcggagtcatcagcagccggtccctcagccgcaggggacgccgcggcggtggatgctggcggggaagggctcaactcctcgtccgtggaagaagggggtgtagaggcggtggctggcgcggtagctggaccagactttctagacgacgatgatggggcagcggcggcgacgggggtggacgcggctcctggtgcttcagcg

SEQ ID NO: 12163 - DNA, 484 bp, Zea mays
  Clone ID: cC-zmpo148016h10a1
tttagataggaacagttcaatcacacacatagggatggggttctgggtttacaaaccatacgacaaccaaactttaatttgggggtggaattacaaaattatttgccaaaatgcatggtaccaacaaggaacaaaaatctctggtgatcggcgacgggcaggggagaaatggcagacgaaggatgagagatgattaacagagccacgcacaatccaagggcgtgtaggggactaaaatgcgtgcgtagctagaggaggctaccaattaaataatgctgatgttggtatcgttgctgctggatgctcgaaccatggacaagcgagcgagcgaggttaaatgaatccattcacaggccttgctctacgaggtagtcgccgagcctttcgaccaccatgttgcactggccgggggtcatgggcttgtcgtagatgccgaccaccatcgcttgccctgtcttttttaaagttatgccttcagatccct

SEQ ID NO: 12164 - DNA, 451 bp, Zea mays
  unsure at all n locations
  Clone ID: cC-zmpo148016h11a1
gagcggncgnccttnntttttttttttttctctttttttttcttttttttttttttttaaaggattgttttttttttttttttttttttttttaaaaaaaaaattaattttaaatttaataaaaaaaatttaaaataaaaaaaaaaaaaaaaaaactctataataaataaaaataaaacaatataactaaattatataatgaaaaaaaataaaaatattaaaaaaaattaataaaaaaaataaaaaatttaaaaaaaataaaataatttatttttaaatataacattaataatttaaaaaaaaaataaataaattatttttttccacatatgttagaataaaaaataaaaaaaatcaataaaaaaattataaatattatctaaaaaaaaaaaaaaattttaaaaaaatttttaaaaaataaaataaaattcttaaaataaaatataatttt

SEQ ID NO: 12165 - DNA, 487 bp, Zea mays
  unsure at all n locations
  Clone ID: cC-zmpo148016h12a1
aggaaannnnaaaggcacagaacaatttttggttagnanccaaccaacttcaacatctgggatggagttattcaggttcttgacccaaagctacatgaccacctagaaactcttggcggaggtgactacctttttgcgttccgaatgttcatggtgctatttaggcgtgaagtatcatttggagactccttatacctctgggagatgatgtgggctctagaatacgaccctgacattttcttcgcaacatgcgaagaacaaggtgcagtacataaaaataaagtttctaaatccaaactgaaaggactgcgccattttggcaagtgggataaggacaaggataatgaagatgataagaatggggctgaggacggtgaaaatggtccggttcctatttcagtctttatggttgcaagtgtcctcaaggagaatagagaaaagctgttacaagaagccagaggactggatgaatcttatcatgatattg

SEQ ID NO: 12166 - DNA, 457 bp, Zea mays
  unsure at all n locations
  Clone ID: cC-zmpo148024a01a1
aatacataataaatgaataaggcttttattgattgtgtttcttctcttcatgcatgtaacaaggccggaaccggaaaccctagaacatatatatatacgtacgtatccaacagcagcacatacatatacatgtaaggaaattaaaataatttgatatagtacgtacgccttggaaagacctgcatgcggcgtggcatcaatataatataaattataatatgcatgcacatcgatgcaagaaggtcgagaagcgatcgatcatagtagatagcatgcatatatatatatataataattaatcgattcatgcggcggcggcggcgacggcggcgtggtgtgtgaatccgaaggcgatgtgcgccatccgaccgtactccctgtcgtgcgcggcgacggggacattcttctccttgccctttcacgcgtnctcgcagcttttggaggcgcccattgcggc

SEQ ID NO: 12167 - DNA, 373 bp, Zea mays
  Clone ID: cC-zmpo148024a01d1
acgatccgagctaagtaattaggacgaaaatgacccgtgccagcagcagtagcagcagccggagtgtgacgctggtactgttcggtctccgcctgctgcttctggttggtgttgctcaggcggtagtggagttggtgcctgctgatgataatatcgacgtcgccgttgctggcacggcggtggacgatggcgagccgtctcatcagtgcgcgaccccggtgagcgtggaggatgcgtgccgcggcgcgttcgaaacgcacgccggcgtggcctacgaccactgcatggcgttgatgggcgccgacccgtgcagtaaggaggtcggcaacaagaacatgcacgggctggcggtgctggccaccatgatggccat

SEQ ID NO: 12168 - DNA, 279 bp, Zea mays
  Clone ID: cC-zmpo148024a02a1
gaagacacatgacaatttgaattcactactatgctagaattgcactctcttcgagagggtacatatacgcgcatcaacaatgtacatacatatatgtacaaattaatttcaggcagatgttactaactgcgagcgcggcgtgagattcttggagggtattattttgcagcggcatgtacaaataaaggtacggtgcagtgtaacacagtggagtatttcgcaggatgcatgtggggccggtggtaccagcttgtcggagctagctagctgctaagcggc

SEQ ID NO: 12169 - DNA, 81 bp, Zea mays
  Clone ID: cC-zmpo148024a02d1
tcgatcgattcgaaacatcggagagagtatcatataaacatcatagagtttgttgattatccaatctggatctgttcatag

SEQ ID NO: 12170 - DNA, 341 bp, Zea mays
  Clone ID: cC-zmpo148024a03a1
cccccccctccctcttcttctcttctcccccccttctctctctttctctggggtgggttctcaatctcgtggttgtctcccggcaactactccctgtgagccacaggggggagcccgggaaggcagatcaaacctggagaaaagacggggagggaggggggcaaaccgcggtaatgaggggaaatgaaccaccgaccgaggaacaaacggagaaacaaaccgggagcaagaaggaggaagcctggggagccaaaagagaaaaaaaaggagaaaaaaaaaaaaagaccacggggggggctagggggggaggaaagggggttaaaaagcggggggacaagaag

SEQ ID NO: 12171 - DNA, 81 bp, Zea mays
  Clone ID: cC-zmpo148024a03d1
ggcttccgggtcgaccccgcgtccgaacgaataaacaaaactaacaaaataaaaaaaaaaataaacaaaaataaaataaaa

SEQ ID NO: 12172 - DNA, 520 bp, Zea mays
  Clone ID: cC-zmpo148024a04a1
aaaaataaaatggctttaataccgagatctatagttacaaatcgggagtagtagctttatatgctactatcgatatacaaaccgagagcacagtacatatggtcacactactacaggtgcacgcatgtattgccgcttataaatgtgggaaaaaaaaagataacccgtttctctagcaatggaaagaagaaatgacaaaaacacggcacacacacagagaaggatggttttttttcactgatggtcgtctgatggaaacacttgttccgtagtgtatacgtgtggacgtgtggttaatttcatgcaggagctctcccttaaaccttaatcactgcagcagcagcagcagccgccgccgtctcctgatgagcggcggcggcgaccgccgagaaggtcttctccatgactttgagcttttcgggaggcggtgccgcagcgaccgcgtcggccgcctggccgtatgcagcaaggaattttgcgatcttgtccttgtccccctccgcgtaggccttgttgatgt

SEQ ID NO: 12173 - DNA, 581 bp, Zea mays
  Clone ID: cC-zmpo148024a04d1
tcgcaagctccgcgctatggcgttcgcgttcgacggcgcggtggcgccgtacccgggccggtgccccgccgtcgacaagcccttctgcgagacctacgccaagacggagaaggccttcagcggaaccatcgccttcggggacacgcccaagagcaagctggggatcacggacgccgtgctcaagctgaggctcgccaccgacgccaacatcaacaaggcctacgcggagggggacaaggacaagatcgcaaaaatccttgctgcatacggccaggcggtcgacgcggtcgctgcggtcccgcctcccgagaagctcaaagtcatggtgaagaccttctcggcggtcgccgccgccgctcatcaggaggcggcggcggctgctgctgctgctgcagtgattaaggtttaagggagagctcctgcatgaaattaaccacacgttcacacgtatacactacgtgacaagtgtttccattagacgaccatcagtgaaaaaaaaccatccttctctgtgtgtgtgccgtgttttagacattacttctttccattgctagagaatcgggttatcctttctttttcca

SEQ ID NO: 12174 - DNA, 534 bp, Zea mays
  Clone ID: cC-zmpo148024a06a1
gcagaattgtttttctattcttttacaaatttaatatatttaaactccatgaataatcgattcgatcaaatgattacaccaaattaaacatgcctcctccgcccaagcatatacccgtacgcacctaattaatccgtatgccgaccctactacctacatcaacctccggtctcaccgcggcggggcgtcggcggcaccggcaccggcggcgaggactgcctcgagcgtggtgacgaccctggccatggagggccggaccttggggttctggctgaggcagtcgtacgcgaggcgggccacgcgctgcaggcccatctccgagcagacctcgcccatccgccggtccaggatccgctccaactttttgggccggataaggatgggccgcgcccagtccaccaggctgccgtcgcggccccccgcccggctcggctccagcgcgcgccgttccaccagcattttcagcagcaccacgccgaagccgtacacgttgctcatcaccgtcaggtgcccggtggttacgtactccggcgc

SEQ ID NO: 12175 - DNA, 433 bp, Zea mays
  Clone ID: cC-zmpo148024a06d1
tcgtcccacgcgtccgcacaacgtgtaccgtctctccccagcgtgcgcgcgcgcgtggtcggaggctgtcgtcgctcgcgtcggccgcccccggcccccgccggccagcgagagcgagggacaacgaccgaccgaccgaccatctcgaggtgaatgaacagccgcataccgaccctccagaaaatgcaccgctggatcatccctagctgcggcgacatccgccagccgcgcccttcgtcccgccgacgagatgcgttcccgaggccggcgtctgcgtcggcgacggcgtcggcggtcccgatccctcagaagctgtggaaggtggggtctgaggggacgctggtgctgtccgtgcccaaggacgtataggagatccggaccatgtcggcgtacgggcgtcttatgctctttacctaccacgagctcatgaagg

SEQ ID NO: 12176 - DNA, 491 bp, Zea mays
  unsure at all n locations
  Clone ID: cC-zmpo148024a07a1
gctggcagtttgatgattagatgaatagaactaagtatattgcatggaagttacacctcagcattcccgtacccttgtatagtgtatagctgtacaatgcagaattaagaacacaacatgtaggtacatattcacttgatccgatacaccagagtttacaaaaaaaaactcttttgccaccccaaaacccacataagtacacctaaggaaacgaagaacacaggactcctccggccaccgctggacgccgtcggtctccggagaccagcgagatcagccgcatcagcggcgctagagatggtgggctagtcgccggagaagactgtagctacgtatatcttgcgacctttgcgggcctccttcggtgagctcggactgcatgctagtccttgctgcctanaaggtcggaagaggaggtggtggctagctggttgaggcccgtggagtgtctttgctttaccgcccactgtgccttgcgatcggcggccctt

SEQ ID NO: 12177 - DNA, 313 bp, Zea mays
  Clone ID: cC-zmpo148024a07d1
gttagtgacgcggtcccggagctggtcgttcgaggagcggtctttctttctcctgctcttcgccttcttagccggccagctggtggtgacgtgcatcgcggtgtacgccgactgggacttctgcctgatactggggatcggatgggcgtggggcggcgccatctggatgttcagcatcgttacctacatttccgctcgacgtgcttaagtttatgattcgcgccgcgctcaaagacaaggccacgggcaacaacgttcacaacaagtgattcctttctctgggcgtttgtttgggtcggcttttaatgaacaa

SEQ ID NO: 12178 - DNA, 472 bp, Zea mays
  Clone ID: cC-zmpo148024a08a1
ggaccaaatcaacatatttctctctaaaaatattaaatacatattgtatttcaatttatataaccgtattaacccaacacaacaaggtgcacgaagggacatgtaacataacttatttcttgggtggtgtggtgccataaaataaccatagaacaaaaattaaatattagctcgctggcacatggatcagatgagctctttcaaaatattattcctcataagaggatgatcagatgctgagggtggtcttgtaggtggtgtcggccttaaaattttcagggatgacatcatcggcgatgcggtagccgccagacttgatggcaaagcggatgcagagggggtacttgagtggggcctttgtgtcaagcgttcaggtgccggccgggccctccttgagctcaaaggagaagtcattggcaccgtgctccttgatcttcactttggagatggtggcaatgttgggggtgaggac

SEQ ID NO: 12179 - DNA, 517 bp, Zea mays
  Clone ID: cC-zmpo148024a08d1
tggacgcgtgggcggactcgtgggctgactcgtgggcaaagaattcatgatcacacaaacaatacctctctagcgggccaccaacaatggcctctaggttctccatcatgctcgccacaacggcactggctacgttttttgtgataggatcgtgcaccaccccgctcaccttcaaggtcggtaaaggctccaagcctggccacctggtcctcacccccaacattgccaccatctccgaagtggagatcatggagcacggtggcgatgacttctcctttgagctcaaggagggcccggtcggcacctgtacgctttgacacaaaggccccactcaagtaccccctctgcattcgctttgccattaagtcatggctgctaccgcatcgtcgatgatgtcatccctgaaaattttaaggccgacacctcctacaagaccacccttagattctgatcatcctcttatgaggaaataatattttgaaagagtctatttgatccatgtgccactgagctaata

SEQ ID NO: 12180 - DNA, 380 bp, Zea mays
  Clone ID: cC-zmpo148024a10a1
aggtataactggcagcaagcctttttattattacccatttaatcgttgaaaaacactcattggggatgaaattaaatttgggaggttcatcgtatggatatttggaacaaaaacaattagcttagaaaatgccaatttaataggaatacaatttatagttccgtccatattaaatggttatcgcatgcttggccagccggggaaaaccttcgtatagactcgctcagagcctgagctgaacgccacgttaccccggcgcatgcatacatgcttgcttgcaaggttcattcaattaaaggggctttactttaaaaaggaggaggggtgcaagacctcttggaatttttgctgaggcgcgggtttttttcctttggtcaagt

SEQ ID NO: 12181 - DNA, 502 bp, Zea mays
  Clone ID: cC-zmpo148024a10d1
ccacgcgtccgcatcggccgcgctcttggtgctagccctcgcgctagtggcggtcatcgtcccacaggtagcggaggcaaagaggaagagagcggtggagagcggcgaggcggcggatgctaataatatccatgacgtcttctgctcgacgctgtgcgagggcaagaaggggacggacctggtcgtgcgcaaggagtcctgcgcgctttaccagcagtccaacctggttgctgtacggtatgatccagtgctagggcacgtgctccgatcagattggcattactgtgccggccatgaaggtctgtcaggaggagtgcgacaaggccttcctggtgaaggcggccgaggttaccaaggcctgcagcgtctcctgcgccttggagaagaacccgcgccttagttagtaactgtatgaggtcctgcaccccttcttctttttgaagcgaagcccccttgaaatgaatgaaccatgcatgcatgcattttttgcttgccctgggtg

SEQ ID NO: 12182 - DNA, 407 bp, Zea mays
  Clone ID: cC-zmpo148024a11a1
gaatcaagcactctgttacatttttttatttccttttctgccttttctttcagtggatactgctatccatgccatgcgcgcgttcgctctgtatcatcgttatacgttttgtgcagccttgtccgctacgccgtcgtggtacagtttactggtcgtcgtcgtcgttcgagtccagctgcttgagcagcgcggcgcaaacggggagcggcacgtccttgaagtagccgagcgggttggcggggcgcaggctgtcggagatgccgacgttcctggtgagcaggacgccggcgcggtccctgagcgcctggacctcgtcgcagtccttgcgcgggctggccaccagcaccacctggcagatgtcctcctcgtggctgtccttgagctcgatcgtgtatgtgccggtcgtg

SEQ ID NO: 12183 - DNA, 442 bp, Zea mays
  Clone ID: cC-zmpo148024a11d1
gggtcgacccacccgtgcggccaccctcttttcacccttcctccctcacacaaataataaggttaaggttccgcccttatcctacgacatccacgggggggaggggaaaatacgtgcattcactcggcggcaaattatggccttgtttcctgctcctgcgactactatcgtcttcgtaatcctatgcctatgcgttgacctctcctgtgccgcggctgacgaccccaaccttcccgactacttcatccatggccgtgtgtactgcgacacctgccgtgccgggttcgtgaccaacgttaccgagtacattgcggtcgccaaggtgaggctggagtgcatgcactacggcacctgctagctcgagcgcgttatctatggtgttcacctacgctaccggttcctacatcaatcagcttaaggacagtcacgaggaggacatttg

SEQ ID NO: 12184 - DNA, 276 bp, Zea mays
  Clone ID: cC-zmpo148024b01a1
atggtcaaatggagggattctgcaataacaccttaaaactagtgccagatcgacagaatcaagattgcattgtactttggagttgtcttccctcttggagtttggggagagcgttatactatacgctggggtttggggaaagggtgcattttcatggcagccttgtaaccatccatccatcatctatttgccgatttgctttagctgcagagagcaaggatcccgcaaaagttccttggcctagtaacccgctttcactttcaaaattcgtcgggg

SEQ ID NO: 12185 - DNA, 292 bp, Zea mays
  Clone ID: cC-zmpo148024b01d1
acgcgccgacgaattctgagagtggaaggcggtcactaggccgaggaactttagcggctatccttgctctctgcagctaatgcaaatcggcaaatagatgatggatggacggttacaaggctgccatgaaaatgcaccctttacccaaaccccatcgtatagtataatcgctctccccaaactccaagagggaagacaactccaaagtacaatgcaaccttgattctgtccatctggcactagctttaaggtgttattgcagaatccctccatttgaccatatatataaaaa

SEQ ID NO: 12186 - DNA, 195 bp, Zea mays
  Clone ID: cC-zmpo148024b02a1
gcgcataacagaatatcagtccactaggcagcaggcctgtcaaagtcaaatacaccgtaggtcattctaacaacgctgcacccacaagggcaggcaggtcttcttcctggtggccggctcggagcacgaaaaccagcatccggccaccatttatcgacatagaaaccgaaacaaagcatgcggtatagaactagt

SEQ ID NO: 12187 - DNA, 199 bp, Zea mays
  Clone ID: cC-zmpo148024b02d1
tcgactagttctataccgcatgctttgtttcggtttctatgtcgataaatggtggtcggatgctggttttcgtgctccgagccggccaccaggaagaagacctgcctgcccttgtgggtgcagcgtcgttagaatgacctacggtgtatttgactctgacaggcctgctgtctagtggactgatattctgttatgcgct

SEQ ID NO: 12188 - DNA, 422 bp, Zea mays
  Clone ID: cC-zmpo148024b03a1
cccttttcccctctcatttcctccacttcctacctcctctttctctccgggtactcgctcatcattctatcctccccccccccctctaccataccacccaccacaatccacatactcacacttttctcggccaaaaagagaaacaaaaaatttttttagggcccccaaaccccattcacaaaaaaaggaaaaaaccccccccttaaaaaaaaaaaaaaaaaaaaaaacccaaaagcccccccgaaaaaaaaagggggccaaccccaaaccggggataaaaaaatagaaccggaaaaaaacccccccccggggggagcctttgggacagaaaattggaaaacccctaaaaaaaaaaaggccccaaaacccggaccccattttggaaaaacacagaaaacccggaaaaaaaagggtctttttcc

SEQ ID NO: 12189 - DNA, 419 bp, Zea mays
  Clone ID: cC-zmpo148024b03d1
gttcgacgacggggccgaggacaagtccaagctgcctagcaacgtccagtatgcatgtgcgagcggcgactgcacggcactcggctatggctgctcctgcaatgggctggacgagaagagcaacatctcctacgcgttcaacatgtacttccagatgcaggaccaggatgtgcgcgcctgcgacttcgaagggcttgccaagatcacagacaagaacgcctccacgcgcggctgcctgttcccggtccagataatcagtgccagtggtcgggtggcgccagctctattgctggcggcgctattggcattgcttgtgattgtgttcgtgtagagtggggatttcgtcacttcgcgtagaactgcgttcgcgtgaccaaaaaaataatatgaattccttgctggcaaaaaaaaaattaata

SEQ ID NO: 12190 - DNA, 231 bp, Zea mays
  Clone ID: cC-zmpo148024b04a1
cttatatataatgtggaatacaaatataataacaagcatcgatcgatctctcgatcgagtggacacgattacaaatccatcgagatcggtgtgttgtcgaactttgtgggcaggcacgcacagtgtgcatacgcaatgcaatgcatgcatggataggcagatgatataggagcattaactagttcatgggatgtcaagtttgttatccttgtaagggtccctaggcccctg

SEQ ID NO: 12191 - DNA, 231 bp, Zea mays
  Clone ID: cC-zmpo148024b04d1
caggggcctagggacccttacaaggataacaaacttgacatcccatgaactagttaatgctcctatatcatctgcctatccatgcatgcattgcattgcgtatgcacactgtgcgtgcctgcccacaaagttcgacaacacaccgatctcgatggatttgtaatcgtgtccactcgatcgagagatcgatcgatgcttgttattatatttgtattccacattatatataag

SEQ ID NO: 12192 - DNA, 404 bp, Zea mays
  Clone ID: cC-zmpo148024b05a1
aacttgaattgtttgtactaactgggtaccaaacccaacacagtttaccctgtcatgcaaaattaggatgaccaccaagtactacttagtcttgaagagcgaactatatgtaaaaacttatgacaaccaccaccagaaatacctaactacttggcccaaaaggagcttaacaggggattttaaagttaggataaccaccataaacaggtaactggtccggcaaacggaaatgggacagttgcttccgttgctttgaccttccaagccacacttttacttttgggtgcaactagtttgtacaccataacccattaacttaggtcaaacggagcgccttgatttgaaagaacaatttgcaataaaagtccccgtttacttattattattaggcaggcccaggttat

SEQ ID NO: 12193 - DNA, 545 bp, Zea mays
  Clone ID: cC-zmpo148024b05d1
tggacgcgtgggattctgaggctaccaacgaccttcatgttggcaagggcgtacctggtgctgattaccacaagactgaggtgcccgagagtagcagcaacatgagtcaagacctgcagaacgaggagtccgcaacaacttctgatgtgaaatctgtgctgccaaagttctcacagatcaatttgcttcacaatgacctgggcctgcctgatgatgataagtcagcggggacttctattgcaaattgatctttcatatcaaggcgctccgtttgacctgagttagtgggttatggtgtacatactagttgcacccagaagtagaagtgtggcttggaaggtcaaagcagcggaagcaactgtcccatttccgtttgccggaccagttacctgtttctggtggttatcctgactttgaaatcccctgttcagctccttttgggccgagtagttaggtattactggtggtggttggcatgagcttttacatttagttcggtcttcaagactgagtagtacttggtgggtaatcctgatttttgcatg

SEQ ID NO: 12194 - DNA, 437 bp, Zea mays
  Clone ID: cC-zmpo148024b06d1
cccacgcgtccgaaaaaaaaaataaataaaaaaaaaaaaataaaaatttaaaaaaaaaaaaaaaaaaaaatagggtggtggttttggtggatccctgttttctttctctttgcttgttacttctttgcgttttttattgcgtctttcttcttctattttattgcccgtccttttatcagtgttcttgactgggaaacccttgtctttgcctatctttttcgccttgttgtacattcccttttcgtctgctgtctttattgcgatctggtccttctcgattgcctttccctccctttgctcagcccgtatggtgtatgggactcgccctgtttctgtgcttttatcttctgtggtcgtggtggttctgcgcaggtttgccccgtttccttgtcatttccttattgtctgtatctttcgttttgttcccttcctttttc

SEQ ID NO: 12195 - DNA, 416 bp, Zea mays
  Clone ID: cC-zmpo148024b07a1
aaaaccggaccggggggtgttctcttttttttaaataaaaatacggtccccccccccaaagaagggacacacgggcacccccacgggacaaaaacaccaatttttggggggggggggggaacctcttttggagggggtggaggggggggaaaagggccatccccgaatacaaggaccgatttgggtggttgggcgggtccccccaccaccttttttttataaaaagggggggtcgggcgcggggggccccttggtggcgaaaaagttcttgtcgtttgggacccacggggccccgtagggctccctgccgctttttagggtctgggggggggaaaattggctaaaccttttaatctccttttatggggcccctggggaggattttagaaaaatttggtctgggggagggccggaaa

SEQ ID NO: 12196 - DNA, 290 bp, Zea mays
  Clone ID: cC-zmpo148024b07d1
tgcgttgattcctcgggtcgaaccaacgcgcggtgcggggtccttgtcgcggtcatggcgcagctgccgtccgagatccctaccgtggcgccggcgtggccggagtttggtggcgggcaccagtatcattgcactctttccgtgggcacgttcctcgctcgtcgtgcccatgcattcgtcgtgggtggacgagttcctcgacttctccgtcgccaagcgcggtgcgcaccgttgcttctttagcgacttcgtggcctttctcgagcctcttcgaccacaacagctttaac

SEQ ID NO: 12197 - DNA, 552 bp, Zea mays
  Clone ID: cC-zmpo14820004f12d1
ggtcgatcccacgcgtccggcacctccttctcccccgccggccaacaactcagccgccgcatccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagttcaccgtcgtcgaggaggagaagccagcggcagccgccaatgcagaggaaaaggtcgccaccgccgtcgagaccacaacgacggtggaggcgaaaaagaaggacgtccaggaggccaggaatgagaagcaggcgcaacaaatctgaccgactgttcgtgcatgcgcgtgccaactaatattattatcggctgatgatacctgatgatcagcgtgtgatcg

SEQ ID NO: 12198 - DNA, 72 bp, Zea mays
  Clone ID: cC-zmpo14820004g01a1
cattcacagtcactgatcacactggcggatcaataaacgtaatatgaccgattcactatacactgattggca

SEQ ID NO: 12199 - DNA, 457 bp, Zea mays
  Clone ID: cC-zmpo14820004g02a1
gcataggctagttagttagtagccggtggatttgaaccacaactggtaggttttacaaaagtacatatataatcaagttacgccacaaagctttggatgaatttccagattgccctccttccccaactctaagctgtagtatttttttttctctacaacaggagcagtccagagctgatgctccttgcgccatttacaggattagcttatcggatgcggggttagcttacaagaactaaccaggattggaaaataacagcaaatgactgcaaatgtagcatggatggatggatggatgagccatgcgtgtgtgtgcgtgttttttacaagctgaggatcccgtacagcgctgcctggtcatggttgagaggttgcggcagcaggaggcggcgaatgtttgcttctttgtcggctgatcaagttgtgccaagcgcctacgcgtccgcggacgcgtggg

SEQ ID NO: 12200 - DNA, 457 bp, Zea mays
  Clone ID: cC-zmpo14820004g02d1
cccacgcgtccgcggacgcgtgggcgcttggcacaacttgatcatccgacaaagaagcaaacattcgccgcctcctgctgccgcaacctctcaaccatgaccaggcagcgctgtacgggatcctcagcttgtaaaaaacacgcacacacacgcatggctcatccatccatccatccatgctacatttgcagtcatttgctgttattttccaatcctggttagttcttgtaagctaaccccgcatccgataagctaatcctgtaaatggcgcaaggagcatcagctctggactgctcctgttgtagagaaaaaaaaatactacagcttagagttggggaaggagggcaatctggaaattcatccaaagctttgtggcgtaacttgattatatatgtacttttgtaaaacctaccagttgtggttcaaatccaccggctactaactaactagcctatgc

SEQ ID NO: 12201 - DNA, 465 bp, Zea mays
  unsure at all n locations
  Clone ID: cC-zmpo14820004g03a1
aatcttaaaacacttgttacgaataacctttgggtttagagtttagggcagggacagaagaaaacatgtcgccagacaattttatgaagttcgcgtcataagggacctcctgtccagattcgtctagataaagaagtagcaaataaactactcggcagcagcaacctcctgcatagcctcatcaccctcgacaggcctctcaagcttcacaccaacgtcctctttgtagtcgccatgaacctccatcaacttcccgagatcaaacttgggggccttgagtatcttcaccttgcggatgaagacgttttgaagtgggaagatgctggaggtagacttctcaatctctttgccaataacttccggaatgaacttagaaacaagttctttaaggtcacatgtagaagcctgngntgatcataatctcaaccatcttgcggcgaatctgccgaatctgggatgcctgag

SEQ ID NO: 12202 - DNA, 271 bp, Zea mays
  Clone ID: cC-zmpo14820004g03d1
cttagggcaggcgctcgaaaatagctggctgaaggcagagatggtcacttgggtgttaccaccatagtaatctttagaagcactgtgagcagtggtaacccaactctgctgtgttgatggttccaagaggcgcccaaccagagaaacctgttgctagctcaattcgagattcccgagaggtggatatacaaccggctttctggacctagaactgttagtattcgagtattgcaaagaattgaaagttacctcgatttcattaaaacgttta

SEQ ID NO: 12203 - DNA, 506 bp, Zea mays
  Clone ID: cC-zmpo14820004g04a1
accttgttgttgcttaaagaaaatatatttttccgtattacagaaacaaaatgcattcttatacccaacaatataattggcatagccacatagagtatataatatgctccgatccttacagaaagaactgaagaatggtcacaatcaaaatgaacctggaatacatagtaattaggaaaatagaaaggtttcaaattgtaagatcgagagcgtagtccacggatgaatataatctctcgtgcacgatgtggttagcagtgggtgggtctgaaattaataaacgatactataatgatgcatatataatcgacgtgttgcttgatgtgatgatagtaggacgatgacgatcagttggtccggctcttgacgatgtcgaggctcatctcgtggggtcggtggcctggatctcgcactggatgccgtccagctccctcctgaacctgtccttggagctggcgtacagcatcttgctccggtgcgtgcagtatcaggggacaggagaagag

SEQ ID NO: 12204 - DNA, 497 bp, Zea mays
  Clone ID: cC-zmpo14820004g04d1
aagggttgggttgatccacccgttcgcatggtgaactcgtcgtccggcctggcggtgagcgacgagtgctttgtgatgttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaggttcaggagggagctggacggcatccagtgcgagatccaggccaccgaccccagcgagatgagcctcgacatcgtcaagagccggaccaactgatcgtcatcgtcctactatcatcacatcaagcaacacgtcgattatatatg

SEQ ID NO: 12205 - DNA, 555 bp, Zea mays
  Clone ID: cC-zmpo14820004g05a1
gagtatgaacaagaatcaattttgatggaaagttagtcggcggtgagagtgagacattcgagcaccctggccctgtcaggctggcaatttgcccaggtcagctacgttgttagattatagtatacgtgtgcatgcatggccaggtcaggtgccgaggtgttgctgcagcttgctcagatcagacgccgttggatctcgggctggcgccgccgtgttgtgtgtcgacgttgacgtacttgccccagaaccagtggcggctccagacgaggttcatctcctcgatgggcacccccttggtctccggcaggaagagggcgatgaaggtggtcatgatgaacatccacccggcgaagaagtagaagagcccgaacttgagcgagcacagcatgctgaggaaggcctggccgatgatgaaggtgagcagcatgttgacgcacacggcgatgctctgccccgccgaccggaccttcagcgcgaacaccttcgaggggacgagccagcccagcggcccccacgatcaggcgaacccggcgacgtataggcagatgaagagca

SEQ ID NO: 12206 - DNA, 417 bp, Zea mays
  Clone ID: cC-zmpo14820004g05d1
gtccgccgctccaacgcctggctgctggtgctcttcatctgcctctacgtttccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgctcgctcaagttcgggctcttctacttcttcgccgggtggatgttcatcatgaccaccttcatcgccctcttcctgccggagaccaagggggtgcccatcgaggagatgaacctcgtctggagccgccactggttctggggcaagtacgtcaacgtcgacacacaacacggcggcgccagcccgagatccaacggcgtctgatctgagcaagct

SEQ ID NO: 12207 - DNA, 417 bp, Zea mays
  Clone ID: cC-zmpo14820004g06a1
cccaaaataaggaaaaattcggtgactttacgtcaactgcatatatcaggtccaattaaactccttggcaggaaccatcaaggtgggttacattaacaggtacaggtttgcgccaactttctaaacaacccccatttcacatacaagaaaggggccgtctttttaagcacttttttaaaagttccattggcttaagtagtctgcaaatgtcgaaggggaactcaaagtgcaaaagatggaaaatttgggtctgctgttgaccccgatcagaagcaaaaagcatgggaatttcctgcaacggcatccattttcagataaatgggattgggggcactcaggggaagccccctggttagcctgctgcatgaaaagacctcatgatgacctaacaatttggactcggggcaaaaccatttt

SEQ ID NO: 12208 - DNA, 124 bp, Zea mays
  Clone ID: cC-zmpo14820004g06d1
tctctaccaacataacgcgtgaatagaagcgagatggtacgcgcttgggtgcctggctggcggcaccgccacagggggcaaaaaagcggagcggagcgcgggcaaaacaacattgtacctggca

SEQ ID NO: 12209 - DNA, 513 bp, Zea mays
  unsure at all n locations
  Clone ID: cC-zmpo14820004g07a1
ctgtaggaaatcgatatattccccggacaaactccggcgatggccggagcctgaaacgtgacaaaacatctttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttccgtcccgtcccgtcccggccggtcagctccgcagcgcgacggcggcnctcgtgcaccagcgacccggtggcctgcgcgacgccgtgcgcctcccgctccgcggcctcccggcacgacccggcgccgttcatgcggcgcacgaaggcggcgaagcgccgcagttgtccgggtggaagaggtcggggcccatgcgcaggtacgtgaaggccaccatccggtcct

SEQ ID NO: 12210 - DNA, 407 bp, Zea mays
  unsure at all n locations
  Clone ID: cC-zmpo14820004g07d1
aatactattctttcttatattgggatttgttttttcttctttagctatatttttttttttgattgttttttttttttttttttttttttttttttttttttttttttttttttgggaaaaaaaattttttttttgggggggaaaaaaaaatttttttttatagaaaaaaggcccggggggggcccccggaaattttggaccggcccctgggaagaaacaaatttttctttttaggggggcattaaaaaaggggggaaaaaaagggaaaaaatttttccggggaaaaaaaattatncccaaaaaattccacaaaaaaataaagccggaaaaaaaaaaataaaaacccggggggccctatagggggggcccccccaaatatattgggggggggcacatgccccttttta

SEQ ID NO: 12211 - DNA, 372 bp, Zea mays
  Clone ID: cC-zmpo14820004g08a1
attccctggacaaactgtcggtgatggccggagcctgaaacgtgacaaaacatttttgtccttccctgccagaaaggcctaccggcttggtaacaatacaatctcatatacgccggaactgcactgcactgcactgaactgcactgcacgagagactgcttgttggctatcgactgcgctccctggctctccacccaaaggaaaacccaacaagaacccgaggtgcctcccaagtgccaacccctgtatgtacagtcgagtcgaagcttccgatccgtcccgtgccatcccggtctgttagctgcgcaaaacaacggcgggctagtgcaccagcgacccggtggcctgggcgacaccgtgcgcctcccggtt

SEQ ID NO: 12212 - DNA, 362 bp, Zea mays
  Clone ID: cC-zmpo14820004g08d1
gcgacaacaatcagaatcgctttgccaatgtccacaataagttacagctcagatacaatacatagaacgcgcgaatgccgccacacaacgacaatatgtcactccaatatcccatcagctgcccacccgcttggttctcacaggactgactcggttacccccttacaaaaccttcaacaaatttacaggacgggaacagcgcaggtctctggtagccaggttcttacaaggacaatgcaaaaataacacgaggccatctttttggggatgtgagggataaattaaaatgaaaaatggcatgggagtgaatgcctcatgagttaggtttgtacagcgaagttcgcggcgcttggcagtcccac

SEQ ID NO: 12213 - DNA, 407 bp, Zea mays
  Clone ID: cC-zmpo14820004g09a1
gtatgttctcattcttggtattccatatgttttaaagcattggggaattaaatgttcaaccatcacaacaattaaggtagaccagaacaacaaagggctcacaaggagggtaaacaaaaaatgtcatccagtgtatgaaaaaaaatgaacccaacacaacagggcatcatatggacatggagcataacttatccctggggtggctcggtgccataacataaccaaaggaaaaaagtgccttgctgcacacgcggcagatgacctcgtttgaacaataggtcatcttcatacgctgcttagatgctgaacggcgacgtataagaggggccagccctgaaagcggcggggatcagccgctccgcgatggggaaaccaccagacccgacaggtaagcggacgcacagggg

SEQ ID NO: 12214 - DNA, 260 bp, Zea mays
  Clone ID: cC-zmpo14820004g09d1
caaaaaaaaaatagcacacaaacaaaaaaaaaaaacaacattattttactaaaaaaacaacatagaacaaagaaagggggatgctatctacactaataccagttggcctgttaagaagcccagtcaccctacaacttgggaagggaagccaaggctgacctgaagaggctcgctcggaccagagccaacatatgcaacccagagagcaaccaccatggtagctccgacctgtactaggcgctgaaggcggaccattccgt

SEQ ID NO: 12215 - DNA, 374 bp, Zea mays
  Clone ID: cC-zmpo14820004g10a1
gtattccatattttttaaatcattgggaaattacatgttcaaccagctcaataataacgctcgacctgattaacaaatttctccaaaaatcttaaacaaaaaatgtctttaggttatgtaaaaatataaacccaacacaactaggcttcatatggacatgcagtataacttatttcttgggtggctcggtggcataaaatacccaacgaaaaaatttcgtcctgactgcatggtgcgcccacacgagcatgttttgaaacatagttcatatttataaactgattagatgctgagtgtcgacttataagaggtgccaaacctgaaatcggcggggatgacgttttccgcgattcggttgccaccacacttgacag

SEQ ID NO: 12216 - DNA, 63 bp, Zea mays
  Clone ID: cC-zmpo14820004g10d1
gttatacacaattgcactctttcgtccttctagacgacgttttttttctgcaaaaactacctc

SEQ ID NO: 12217 - DNA, 464 bp, Zea mays
  Clone ID: cC-zmpo14820004g11a1
ctctctaatgtagatttaatataacgttataatgagggggtacatgcatttcacacaacatttacaatcatactcaacctgcatatggatgcggaccaacaggctcgatgcatacaatacatacatgtctgccaacgacaaaagcacaaaccacgacacgcgaactagtggcgcggtaattaatcggttgattcgcacacacgcggctgctattctaccagtaataggttgtgcaaaatgcagtcgactttaccggccattacagggcctcgggtgaattgaataggctaattgctgtgctgactggcgacgcatgagcgatccaaccaaccatagcttggagtgccatgcaataagatgatcgatctgcaccacccatcatggttatggatgcgccagcccattctgtggtcctggaatccgtatgccctgccccgcatgatgatctggctgggcaccacccg

SEQ ID NO: 12218 - DNA, 174 bp, Zea mays
  Clone ID: cC-zmpo14820004g11d1
tatttttgggttgatcccatcgcgtccggtaacattgcgtgtgtcatcatccccatatccaccgggatcattttctttttggccttgcggtgtctggcccatgggtgcgtagatctctgcgatctgttcacggcgtccacatcacattacaaagacaatgaagaaggctgcctg

SEQ ID NO: 12219 - DNA, 482 bp, Zea mays
  Clone ID: cC-zmpo14820004g12a1
aagtctcacaaatgtacatttaatacaacgtgataatgaggcggtacagccatttcacacaacatttacaaacataatcaacatgcataaagatgcggaccaccaggaccgaggcatacaatacatacatgtctgccagcgccaaacgcacaaaccacgacacgcaaactagtggcgcgggaattaatcagttgattagcacacacgcgcttactatgctacgccgactaggtgtagcaaaacgcagtcgacgttaccggccattacagggcctcgggtgaaatgaatggactaattgctgtgcagactgacgactgcatgagcgaaccaaccaaccagaggttgcattgccatgcaataagatgatcgatgtgcaccacccagcatggtgatggatgcgccagcccaaactgttgtcctggaagccgtatgccctgccccgcatgatgatctggctgcgcacgacgcggtaggcctacatg

SEQ ID NO: 12220 - DNA, 444 bp, Zea mays
  Clone ID: cC-zmpo14820004g12d1
tgggttgacccatcgcgtccggtggcgggaggggcgccgtcggtgccggcgggtccgctggacatcgctctgctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggctacctgctcggcaccggcgacctcagcgcgtaccaaaggaactggatcgagatcgagaacgtcgagaacctgtccatcaacggtcacggcaccatcgacgggcagggagccctggtgtggagcaagaaccagtgccagcattcttacatttgcaagatcctcccgatagctggttgctggattttgtgacgaacg

SEQ ID NO: 12221 - DNA, 578 bp, Zea mays
  Clone ID: cC-zmpo14820004h01a1
cacaataagggattcaattttttaattcgaatgcaaacatgttacacttagatttggggcttgtttgagatcttgctggagacgaaaaaatcactacgcgggacaatctttgcacattgcagggatttgttttatacgacgtacagatatgggagaagttagttttgagtacaacatgaatttactttaccttgccttgcagggattaatcctagatcaaactcatcttctggtacagaggatacaaacaaggaactgctttgctagcttcttccaaacaattctgcatgctatgccaatcgttctgtctctgtctctctctctaataacaatgacaagaatctcaagtagcagttcaatcaatctgtgcatgctatggagtatgaacaagaatcaattttgatggaaagttagtcggcggtgagagtgagacattcgagcaccctggcccctgtcaggctggcaatttgcccaggtcagctacgttgttagattatagtatacgtgtgcatgcatggccaggtcaagttgccaggtgttgctgcagcttgctcagatcagacgccgtggatctcggc

SEQ ID NO: 12222 - DNA, 514 bp, Zea mays
  Clone ID: cC-zmpo14820004h01d1
ctgggcgcgctggtgctccccgacacgcccaactcccttatcgtccgcgggttcaacgacgacgccaaggcggtgctggtgaagatccgcggcacggacgacgtgcaggacgagtacgacgacatggtggcggcgagcgaggaggcgaacgccatcgagcacccgtggcgcaacatcccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcgaggtgttcgcgctgga

SEQ ID NO: 12223 - DNA, 414 bp, Zea mays
  Clone ID: cC-zmpo14820004h02a1
aaccgagaaaacccttgggaaaaaaatggggagattttttaaaagcaaagcccccaagggtcccccccaaaaaaaatagggggccaaaaaaaaaaacaagggaccccccaaggtaaaaacaaaagcgttaagctaaaaccccccttggggggcaaaaaaaaaaaaaaggggcctcccaaggggaataacccaactgggggaaaaaaaaagaatcccggaaggggacccaaggggggggggcgggtcccaaagggacccccccccgggaaatgggggggcgccgccgccgggggagggattttttggagacccccccaacaaaggggggggaaaaggcgcccaccaggaaaaaaggggttgggggcccaaaagtttgcagggggcctcaaaatgggggggacctttgggcccccc

SEQ ID NO: 12224 - DNA, 599 bp, Zea mays
  Clone ID: cC-zmpo14820004h02d1
gtgatagtaacgatgagctggcagataagtctgagctctggcgtcctttaaattgtttagtagaagctgccaacaggacaaaatcctttaggtcaagttcacagagtccagttgttaagggagagcaacccaatggctctacgagtagtacatttgctagcaaagcaaaggcaagggagaatctggagaagtccaaaattcaggatgacaaaaaagatgttcccatgccaccagtgctgccaaaaagaagagctcaaggtactgcgcggaagaagagagatcgtcttcaagctccaactgatgtgaagcctgatgctgcagttgcacagaatgcaaagaagttcagctccatatggttttcattgattgcctcatttgaccagcaaggagatccacctttaccacagatcccttcccactatttgcgaataaaagacggaaatatccctgcttcatctatcctaaaatacctcatgcaaaagctcagtctttcaagtgagtctgaggtggaaataaagtgttgcgagcagccagtgaacccctcacaacctctgcgcaattattagagctgtggctgaagggagagcaacacagacaac

SEQ ID NO: 12225 - DNA, 488 bp, Zea mays
  Clone ID: cC-zmpo14820004h03a1
caggcgatagttcaatttttgacattgtggagatcatagaacccagatgtctctgttacaaaatatattatatacacatcccgttagtcccgggacgacatgcaaaatgcactagccaactcgcacgaacacgcaagtacattaatgacaggaaacttgggcagaaattatctgcttctgcactagacagccataaatccttgggtaacccatggaaataatcgatcggcggcggccacagccactcctagatagatgtaattatggttggtggtggttcatgctgtggtgtggccggggagtccggtgcgatggtgaaatgcactccccttccttggcctgactgcaggatgaatgccacctccgctgcagctagagcagctgcctcctgtctctgtctgcggcgcttgcagatactgattgcccaagccatgatgtagaacggaagcaggaaaccagcagcacgcaacagaaaaagtgaaaacatc

SEQ ID NO: 12226 - DNA, 594 bp, Zea mays
  Clone ID: cC-zmpo14820004h03d1
gcatccaccagaaacgtggagctcagagcattggtgcctcttttttctttcaccaaggattccggtgccttgtttcacaagacaaaaaaagtctcaagggtcttgattcttgtatgaactcaagatttatggtggatcttggagctgtgggatgctaagcctggtctagctactagattatgaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatctggggaaaccattgcacatccaccctccatggctcatgccattttagcagtgggagaaagcatggtttctgaagcggaacctcttctgcaagtggtggagtgtcgcatttgtcaggaggaagatagtatcaaaaatctagagagtccatgtgcttgcactggcagtctaaagtatgctcataggacttgtgtacaacgatggtgcaatgagataggagatgtaacatgtgaaatatgtcatgagccttatgaaca

SEQ ID NO: 12227 - DNA, 496 bp, Zea mays
  unsure at all n locations
  Clone ID: cC-zmpo14820004h04a1
caaaataatgcagattactgttgtcgagtatagtctgactgaccaacaacaacgacaacaacaacaaagccttgtagcatataaaaatgagcaataatagtcacaaactaaaaattaaaacatgttcgagctgtcccatttacaatacctaatttcaaaaatcaaactaaaaatgcaaccagcatttgcctggttggaatgttcaaaaaaatctcgatggtgatatttttgtttaacctttttatcagaatttctttgacaccattataagcagctagaagtgttcttgagtatttcctgatttcatatgaaatagatgtgatggaaaccatatngtctgttcaaagttgaaccccctggtgatttttttgacgcactctgaaagcctgttataagtcattaagctaactgagtcatagctgcttttagaattgccatcccagacaaaggttagtcangaagttatgacttccgtgtgcatgagctctagagcaat

SEQ ID NO: 12228 - DNA, 517 bp, Zea mays
  unsure at all n locations
  Clone ID: cC-zmpo14820004h04d1
gggtttgacccatcgcgtccggntcttgatnaatctattttgataatgggctctgatagtattcttnctggccatctgtttcataggtatgtatctctgacaatagtatacttcagaagcggtattattcatgtgtgaattgcgaacaacatttactggatatgattggtaccccattccacatccatatttgcatagggtgctatcgtggatgttcacatgcattcccttggttcaatcttatatgctgaactgcggagattggtcatgcttgatatgatacttggaaccgcttgcagtcatgctattcgaattcctacttgttaggcttgcccaaacttttacaactaccaagctgcagcacctttttcttctaaataattatgacatggccatctctgtcctgaaggaaactggcgatgaagccaaaaaactgcaaaaatattttgaagagaagttagaaagtaacatgatggcctttgtggatgatttgctgatgaacatttaagtgacttac

SEQ ID NO: 12229 - DNA, 418 bp, Zea mays
  Clone ID: cC-zmpo14820004h05a1
aataatgtaatttgaataacttatatataatgtggaatacaaatataataacaagcatcgatcgatctttcgatcgagtggacacgattacggatccatcgagatcggtgagatgacgaactatgaggtcaggcacgcacagtgtgcatacgcaatgcaatgcatgcatggatcggcatatgatctaggaccattaactagttcatgggatgctaagcctcgcgatccttgtaagggtcactaggcccctgctgagaagatatctacttgcacctcttcatgcaatcctgcatgctcatgtgaactgggcccgggacctcctgacacccgggcttgcagtccatggcggtcgccggacgagcatcctgcaggacgagcgtgatgagacgcatcaccggaactatgaggactgcattat

SEQ ID NO: 12230 - DNA, 454 bp, Zea mays
  Clone ID: cC-zmpo14820004h05d1
tgacccacgcgttcgcataccaaaccgacgatggcgtacaataagacaggcctcatcgtttcggctatgcttctcatcacgctcgtgctggaggctggcccttcggcggccgccatggactgcaaggccgggtgtgacgaggtcacgggcccactccacatgagcatggaggactgcatgaagaggtgcacggagatagctgctgagcaggggcctagggacccttacaaggataacaaacttgacatcccatgaactagttagatgctcctatatcatctgcctatccatgcatgcattgcattgcgtatgcacactgtgcgtgcctgcccacaaagttcgacaacacaccgacctggatggatttgcaatcgtgtacactcgatcgagagatcgaccgatgcttgatattatatttgtattccacattatatatgagaaatacatattaaat

SEQ ID NO: 12231 - DNA, 450 bp, Zea mays
  Clone ID: cC-zmpo14820004h06a1
aaccaccatcacaaatatatataattttttttgtacaatcaagataaatcgttggcctttcgaccacgcaacgcgaatacatgcctggctacgttaagtacagcgcgcgttgcgcaaataccaatacactagagaattaataacgtacgacccagactaaaacgcacctgactaacagagtctatttattataacaaagaagaaataaataaagccgagaagccggaacatgaccgcgtgcccaaacggtgtgcaaccggatcaaccagccgtacggctggggcttgctgccggtcatgccctagcagaccttgttgcagtagcacttgcgcatgacgccgtccatcttgcactcgacgactgtgaacttctccgtcttgcatacgatgtcgcagttggtgttgctgaggcacacgcctttgaaagcatggctctgcgacaagcacagcg

SEQ ID NO: 12232 - DNA, 400 bp, Zea mays
  Clone ID: cC-zmpo14820004h06d1
ctggtggttatggcagtcggcaactttgtccacactatggagactctggtactgaaactgaggtttaaagcaaagatgaagaatgcgaatagcagtctggatcgcccgcatcaaaattgacaggcatcatcgtccttggaaaacaaggatgctgacaccggctcttttgtaaatcctttgacccacattaacattttttgcctgcttgtcattctctctctctttttttttggtaattggccctgtaacattgaagttgatattccacacaacacggtggatgaaaccatatttgttcgctcttggatgagaactgagtttggcatgtactatatatgcttctgtatgaaacctctgggttctgaaataagatgatgtgtatctgaagctgcgaatcgac

SEQ ID NO: 12233 - DNA, 538 bp, Zea mays
  unsure at all n locations
  Clone ID: cC-zmpo14820004h07a1
actcgcaccccgctgccgggctcggcgggcacgacgccggcgggccgcgctgccacgcggtagagatcgacgccaagatcctggggctggaggccatgatccgcgtgcagtgccacaagcgcaaccacccgtccggcgcggctgatgacggcgctccgcgagctcgacctggacgtgtaccacgccagcgtctgcgtcgtcaaggacctcatgatccagcaggtcgccgtcaagatggccagccgcatgtactcgcaggaccagctcagcgccgcgctctacagccgccttgcggagcccgggtctgtcatgggcaggtaatcaggcaggagagctcatcagctcgcctgtgcctgccggatagggacgataccgatacactgctacccaccacggcgactgtcatcgcggtcaccatggttacaaaacacacacacgcacgataggccttagagattangaggtggaggacggcggcgacgatgatgatctggcgttgttgaaaactctagaaggatggatggatgatgacacctag

SEQ ID NO: 12234 - DNA, 514 bp, Zea mays
  Clone ID: cC-zmpo14820004h07d1
ctgacgcgtgggcggacgcgtgggtacgaacgtcgtacgagatctctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggtctcgcactccacgtgaggctccgcgcccagcgtctatacctgggcgatcgcgacatcggcgaggtgtttgtgcccatcgacgaccttctggccggcgccgacaagggtggcgatccgaggcccgtgagctaccatgtgcgcaagccgcactctggccgggcccacggcggcctctacttct

SEQ ID NO: 12235 - DNA, 429 bp, Zea mays
  Clone ID: cC-zmpo14820004h08a1
gatggttaaatcgaattgttgaactggtccacacaaatggcaagcaatggtacaggtgtcgatccctcactcgagggaaagaacaaataacagggcaccaaattaaactggtgcatcagcgataccaattcgttaaatgaaaatcaagtagaaagaggaaggaaaaaaaacaaacaaaaggaagacgaaggtgtgccactgccaccgccgtgcccaatcagagcacgcccacgcatcgggaatgcgcgggagcagcagagcagcgcagcgcagccaagtctcttcccccaccttggtctcttccctccggctccggctcctcgtccggcggctcagtgaatgtagtacgcgaagaaggaggccacggcggccccgacgatgtcgggtgcgaccgcggaggagccgctggtgggagacggagccggcgcc

SEQ ID NO: 12236 - DNA, 521 bp, Zea mays
  Clone ID: cC-zmpo14820004h08d1
accacccgcgcgtaaggagccggcgccgcgtgtccgatatattctacgtcgtcctcgccgcagctgcagctgcaggcgcggcgcaggcatacaataacgtcacctccgacgaggagtactgggcggagcgcgccgaggtggctcggtcgcgcaacctcaccgtctacgtgagcgaccccgtggccgccacgaaccgcttcaacgcggacgtgctgagggccaccacccggcgggcgctggcgaggtacgatggcccgtgcatggcgaccaaccccatcgaccggtgctggcgctgccgcgccgactgggcgacagaccggaagcggctggcgcagtgcgcgcgcgggttcggccacaggaccgtcggcggcgcggccggcaagctgtacgtggtgagggacccgagcgacgacgagatgatcatcccgcggaagggcacgctgcggcacgccgtgatccatgaccggccgctgtggatcgtgttcgcgcgcgacatggtgatcgagctgcggcaggagctg

SEQ ID NO: 12237 - DNA, 432 bp, Zea mays
  Clone ID: cC-zmpo14820004h09a1
gttgaaatctaatagtggaatggattcaaacacatggggagcgatgatacacgtgtttatccctctctctgggggaagaacatcaatggcatgcatccattttttacttttaggtgaaagaggccacatcgtaaaataggactcaaggtgtgtcaggtcagaaacatgcccacccataggaatgcgcgcgggcgtgtctctctctgtcccgcttagtctgttcatccgcctccatgcgacctgccccggcccgctcactgaatgtagcaggcgaagaaggatgccaccgccttcctctggtccgtgccggtctggggtctcgaccggggaggaaccgcttgtggggcccgaagccggaggctacggggcgagcgccactgtgggctgctacgcggcaacaacgactgctcagacaactttctttatcttcat

SEQ ID NO: 12238 - DNA, 322 bp, Zea mays
  Clone ID: cC-zmpo14820004h09d1
cacagacataggtacgcggccacccagagagactcttgctcgcttttcccatccttcttcctcggcttcgtcggggggcgatccgtccccccctccagcgatggcgaattcaaggatggacatgaccaagatcgcctgcgcctcactcaccgtcgccctggcgggcacggcggcgcttgccgcggaagcctgcggttccggcgccaacataagcacctccgtctttgcacccggggactgcaccctccggtgctacatagactgatccttctgacgatgcttcatatcctgagccaccctaccacggtcggccgtaagacgt

SEQ ID NO: 12239 - DNA, 285 bp, Zea mays
  Clone ID: cC-zmpo14820004h10a1
gaccaaaaaaatttatattatgcattgataagacatcaataaccaatgacaatcccaacacagcatggtgttgttcgctaggagccacatcaggcgtctcattagaattgaatggaccttaacatattgcgtccaaaaaatcacaggtgagaagcatccggagcgacagatattgccgtcttgatgaataggggaggaaagcggacgccgatagaccggcacaaaactttgttcgggctaatgaacaaactgtaaccaaaacagaggcaggagaggctggcggcg

SEQ ID NO: 12240 - DNA, 376 bp, Zea mays
  Clone ID: cC-zmpo14820004h10d1
ggtcgaccccccgtccgctcaaacagcctttcctgcccacgttttttttgccgatttttcttttccgcgaacaaagctcctgagcccgagtgtgggccgccggtttcctcccctattcatgaagactgcaagaactgcctctacctatacttctaacctgtgattcaccggacacaatatgtgaagggccattcaattcttatgagacgcctgatgaggctcctaccaaacaacaccatgctgtgttcggatagacatcagttagtggcgtcttatgcatgaataatataaatcatgttgctcataacaaacaacccttatataatataccatgggccgcctatttagaggatcccatcatacatcctcgtgcttg

SEQ ID NO: 12241 - DNA, 209 bp, Zea mays
  Clone ID: cC-zmpo14820004h11a1
gtggccataaaaacactttttatggatggagaacagatatattacccaagacaaacccaaaaaagcaaggggtttaaagatggggtccacatcgagcgaggcataaaaaacaaacgggccttaaaacgttgcgtccaaaaaatcccatgtgggaactatcgggagggacagaatctgtcgactgggacacacgcggaggaaattctacc

SEQ ID NO: 12242 - DNA, 224 bp, Zea mays
  Clone ID: cC-zmpo14820004h11d1
ccacgcgtccgcggacgccttggcgccaccagcacctaatccaaaacggacgaccttacttagatggaggcagtgaccccggacaggaaggcgcgcacacgatcgaaccactggctggaggagtacggaggagcactccgaccttctccgggacacgctgaacaacctgaaggcgaaaatgtacggcaaggccatggagcaattgaccgccgcagggggcgccc

SEQ ID NO: 12243 - DNA, 402 bp, Zea mays
  Clone ID: cC-zmpo14820004h12a1
cacgaatgtacatataataccacgtgataatgaggcagcacagccatttcacactacatttacacacataatcaacaggcataaagatgcggaccaccccgaccgaggcatacaatacatacatgtctaccaacgccgtaagcacaaactacgacacgcaaactatagcgccagaattaatcagtcgactagcacacacgcgcatactattctaccagtaatagggcgagcaaaacgcagacgacgctaccgggcattacagggcctcggttgaaatgaatagactacttgctgtgcagagtgacgatgcatcagcgaaccaaccatccatagcttgcagtgccacgcaatgagatgagcgatcggcaccacccagcatggttatggatgcgccaacccaaa

SEQ ID NO: 12244 - DNA, 439 bp, Zea mays
  Clone ID: cC-zmpo14820004h12d1
gtaagagtctaagggcatctatgccaaagcgtacgggactgactggtccttcatcattaccaagttgggcgcctgcggcgctggcatgacagacagcacgaaggctgagcaggaggcatgggcatcgacttgcggcggcacctccttcacccaggtggccgctagcctgctctgcactgccaaggtgccatgcaccggcgtgaccatggatgacgtacacgtcgagtatagcggcaccaacaacaagaccatgggtttatgcaccaacgccaaaggcagcaccaagggtggcctcaaggagcttgcatgcttttaagaccctccatcgactgacccatctctctaggtataatagtttatctcgtccttgcattgcccattagatgctatccatttggtaacgcacaacagttaaacgacagacatccgacagcttttt

SEQ ID NO: 12245 - DNA, 480 bp, Zea mays
  Clone ID: cC-zmpo14820005a01a1
tttacccatcgcgtccggaagaaacatgagctcacaaaaaatacctctctagctcgccaccttcttcgtggctgcaggttctccatcatgctggccacgacgacactggctacatttttcgtgattgggtcgtgcaccaccccgctcaccttcgaggtcggcaaaagctccaagcctgtccacctggtcctcaccctcaacattgccaccatctccgaagtggagatcaaggagcacggtggcgatgacttctcctttgagctcaaggagggcccggccggtacctgtacgcttgacaccaaggccccgctcaagtaccccctttgcatccgctttgccgacaagtctggcggctaccgcatcgtcgatgacgtcatccctgaaaattttaaggccggcaccacctacaagaccaccctcagcatttgaacagcctcttatgaagaaatatatttcgaaagagctcatccgatccatgtt

SEQ ID NO: 12246 - DNA, 655 bp, Zea mays
  Clone ID: cC-zmpo14820005a01d1
accgggagcatcggtagccgcgcgggcgaggggcgaccggcgcctgcacgcgtacatctccgcccagctcccgtcggccagcccatgctcctacgattaccggtacaaggaaggatcggctggggcgctcggcgtcgtgggcaccgactcggcgaccatcgcgctgcccggcggcaaggtggcgcagctgcaagacgtggtcctgggttgctcctccacgcatgatggccagagcttcaagtcagtagacggcgtgctgagcctgggcaacgccaagatctcgttcgcgtcccgcgccgccgcgcgcttcggtggtagcttctcctactgcctcgtcgaccacctcgccccgcgcaacgccaccgggtaccttgccttcggcccagggcaggtgccccggaccccggcgacgcagacgaagctgttcctggaccccgcgatgcccttctacggcgtgaaagtcgacgccgtccacgtggccggccaggccctcgacatccccgccgaggtgtgggaccccaaagcggcggcgtgatcctcgacttcggcacgacccttacggtcctcgtcaccccggcgtacaaggccctggtcgccgtgctgaccaagctcctggcccgggtccccaaagtggactttcccccgttcgagcact

SEQ ID NO: 12247 - DNA, 483 bp, Zea mays
  Clone ID: cC-zmpo14820005a02a1
gggcaaaaaaaatagcgctggctgaattacagattagtggggtgggtataagccatcctgtacgttctcaaggggattcgactccgattcattgccacgccaagggagggggtgctccaggcacaacatcaatcaatctgcctcgggcgtgcagctgccatcaacaactaacattttaagaatgcaaatacaacttactatgcttgtgagaacgcggtttactcctcgaagccatccatcatggggcggtggcctccttccgaagaagtgttcttcgaggactgttttcgggctgtggcccgcctgctcttggctttctttgccttcatcctccggttcttctcggtggcatcgacccaggtgtagaacgacggtatgtggaacggatcaacctcgtctttccagttccggccattaccactgtcaccggactgtgtacctcggccaccctttacccatgaataccatgagcctgatccttct

SEQ ID NO: 12248 - DNA, 561 bp, Zea mays
  Clone ID: cC-zmpo14820005a02d1
ctcccaccgctcgtccgcccctcgcccgcaccaccggcgccggcaccggcgccggagcgcgacccggaggagcgtccgcacccgcgccgcgccagatctggccccgcccgcagctcccatgcccctcccttcccagacccgcctgacctagccacgaccggccggccggacccgccccaccccccgccatggatgacgtgtccaagtatgcgcacagcccggcgcacctcgccgtcctgcggcgcgaccacgcggtgctgcgtcgactggtggcggccctcccgcgcctgccgcgcgccggggaggtggccaccgaggaggagtccgtcgcggtggatgccgtggcggacgcggtcttggccgtcattgaccgccgcgacgtgccgcggagggagaccccgctccaccttgccgagcgccttcgggaccccgtcgccgtcgacatgctcatgtcggccggcgccgactggtcgcttgagaacgccgacggctggtccgcgctccaggaggccgtctgcacgcgcgaggaggccattgtcaccatcatcgcgcgccactacc

SEQ ID NO: 12249 - DNA, 560 bp, Zea mays
  Clone ID: cC-zmpo14820005a03a1
attagaacatgttgtttcatcagaagaactccgtggaggaaaataatgggagacatcgaaggttagtttgttacatggtgtggccggtcgagagtgtctctcccgacctatgccaaactgtagagaattcaagtgtcgtctccttgcttgatcacagtatcacacactgaacatcaggcatcatcagccaattatattaattggcacgcatgcacggacagtcgatcagctttgctgcgccagcttctccttcccggcctcctcggcgttcttcttcgcctccaccgtcgtcgtggtctcggcggcggtggcgaccttttcctctgcatgggctgctgccgctggcttctcctcctcgacgacggtcttctccacggcttcctcctcattgtggtcgggctcggcgacggccgcctctggagcgagcacctcattagccttctgatgctcaacgtcggccgccgcagccggctcctccaccaccaccttctcagctacctgttcatcagccgcaacctcaacggagattggagtggcctcgggcgcaaccttgggtgtgg

SEQ ID NO: 12250 - DNA, 607 bp, Zea mays
  Clone ID: cC-zmpo14820005a03d1
cacctcctcttcccccgccgggcaacaactcagccgccgcaaccgtcacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcaatgtgtgatactgtgatcaagcatggagacgacacttgaattctctacagtttggcataagtcgggagagacactctcgaacgccacaccatgt

SEQ ID NO: 12251 - DNA, 499 bp, Zea mays
  Clone ID: cC-zmpo14820005a04a1
ggactaaatatctttaaaactcctactgttagcagattgaaacagtacagaccagatcacaacagattgaaacgttggccacatggctctttggagaaggaaatggacgcgaacagaaaaccaagacgacgagcactgggcatcaatttctgaacgctttacaacagagtcagtcagcactccaaggacaagaaacttcttgaggcatctcgatgttcttcagatcatgtcgctctcgctcatggcttgggcactcatactctgaagaagcggtggtccaagaactcttggaaggacagacgcttcactggattagtgcatagtagcctggtgcatatatcgacacaatcggggcctaaggtagacgccagtggttccgagaacgggagagacgtgcttctgttgatgcactggagcagctgcacgttgcttctgccatggaatggcgggtagccattcaagagctcaaataggatcgcgccgatgctccacatgtcta

SEQ ID NO: 12252 - DNA, 516 bp, Zea mays
  Clone ID: cC-zmpo14820005a05a1
gattgatgaatggctatatatatagtaataaagaagcacaaattagcatgttatagaatcatatatataggctgccctacacgcgtgcctctcaacgagccgtttcatcccacggtctcaagacatgtgccacgccgcaagaggcaacaccgaaaagaaggacacgcgctaggtccgcatgaagtcggcatgcgtccagtctatcgactgacagacacacgcgaccagcatcaaattacatatgttttaggccggacgacgacgacgacgacgacgacgacgttaccgaacgtagtagggggtcgggaaaaagaaacaaacaaatcaatggacatgttcgtaagggatcatgttggaaagcgtgcggcagatctcggacatctcgatgagcgacctgttgtggtcctcctggggttcttggagacggccttcctgaactcctcgtcgcagtgctgcgtgtcctgcgccaccatgctcatcgtggcgcggatggtgacggcgttcgcgaagccgatg

SEQ ID NO: 12253 - DNA, 631 bp, Zea mays
  Clone ID: cC-zmpo14820005a05d1
ccagcagctagctagcgatggctggagcctgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctcaacatgatcccttacgaacatgtccattgatttgcttgcttcttttttccaccccctactacggtcggtaacgtcgtcgtcgtcgtcgtcgtcgtc

SEQ ID NO: 12254 - DNA, 547 bp, Zea mays
  Clone ID: cC-zmpo14820005a06a1
ccactgaagcaacagataaattaaaagacaatttgtcgcaaagacaacaacctgtcagcactgcatcacgctgcgcgctcaattgtggcgcggcgcggcgccgcgtgggcccaaattaaaagaaaccaatgagcccgcaccgggctttcaccttcacactcgattatgcatgcatgaaacacaaacacagggagacagacactagctggctactgctctttgcacgtcgcgaactcgcgatgctttcaacttgtctttctattacttttcagcaccatttagcgctaggatctccgagatgaccgtagctttatcggcttcgaacttcttgtcgtctttctcgacggtggtgaagtctttcaagaacctcaggagcttgcttctgttggcgagcagtatgccggtgatctcaggtgcctgctccttgttagcgacgaacagcttgaagacatggaaagcctctacttgaatggctatgctttcatcccttagaaggttcatttgaatcatgagatgctctttcgaactaacatagcgcaccatcact

SEQ ID NO: 12255 - DNA, 609 bp, Zea mays
  Clone ID: cC-zmpo14820005a06d1
cggacgcgtgggtggacgacgcacctgcgtcgccgacggcggcggtatcatcggtgagcggacgcgcggccggccaggcgagcgtgatcctcgatccaagaggtcggtagggatcgagatgaccgggtgcctgtggccgtgcgtgggagcggcggtggctgggcatggggccggccatcggaaggcggggctgttccgctccaagcccaggacccccgcggaggtggtgcagcacgccagggacctagtcacctacatcctcgacaacaaggacggctgcggcgccggcaagcgcgacgccaagcatgagcacaggatggtagaactaagctaagaagtcaaggagatgaaaggcattctgtatggtaatggcgaagaagatccttgtgaagaagcatgcaagcaattgactaaggagttcttcaagaaggacactgacaccttacgtcaactaattgtttgccttcaatatgtggacctggaaacgcaaaaggatattacacaagtgatagcaaatttgcaaaggcaaaaggttgattcaagattggttgcctctgattacttagaaaccaacttggatcttttggatattttgatgtctgggtatgg

SEQ ID NO: 12256 - DNA, 183 bp, Zea mays
  Clone ID: cC-zmpo14820005a07a1
cttaaataaataatttatttagtttatgtaataatatcaacccaacacaacaaggcatcagaagggacatgtagcatcacatatttcttgggtggtttggtgccacaaaataaccatagaaaaaatattgtcttgctaacatgagcaccaggtgagctcttttgaaatataattcatcatcag

SEQ ID NO: 12257 - DNA, 446 bp, Zea mays
  Clone ID: cC-zmpo14820005a08a1
agagaaattaagctgaactaaatgtagccagtacatgtaaccattcatagcatatattcgttcgacaacattcttgcatgctccatgcatatctggtcggtctcgtaattggtatttaatttagttcatgctgccttctggagtggggtcaatgggtaggccgtcttcgctaccagatggaggtgcgcttttaaagaaggggttcttgatgaccatcttgacgaactcaggcccgccatccggccatgtcatgggcgctcccgcagcaggcccctcggtggctgcagcagctggtgccttggcaggcgcatccgtctcttctttggctgcttcgtgtttccttgtggtcgttgtgctcgccggagatttgaccgcacagacggtcggtgccgccgtcgcggcgacataggccgtcagaatgaacaatgtgacagacaggttgcgcg

SEQ ID NO: 12258 - DNA, 507 bp, Zea mays
  Clone ID: cC-zmpo14820005a09a1
gccatacagtttttttgctgtatctcatatctttctgaagtaattctgatgtagcacattgatgcatgagaaacgtctctatacaacatttaaaacgttaatgttccttcctttcccttctgcctcctcgctctagaaaagaaattggcgcctaaattgcccagattacatgccgccggactgccgactataccccttctcagtgtgcaaccaagggcacacttctcaggcacaggcagatacaaactttttggcaggcttcatgccgccggcggtgttcctcttttcctgaccacacagaaaaaacactgtctactgcactctaaacttgcagcatccagccaaaggtttgattggccgcttcaagttgtcggtgtttagccacctgaaggcagcatagacccatcaaccgcacagaggattcaccatgattcggccatgatccagtcactaatacatgtttgacatgccaaacggaacaacgccgacctttctgtgagtagttgc

SEQ ID NO: 12259 - DNA, 370 bp, Zea mays
  Clone ID: cC-zmpo14820005a10a1
aataccgagatctatagttacaaatcgggagtagtagctttatatgctactatcgatatacaaaccgagagcacagtacatatggtcacactactacaggtgcacgcatgtattgccgcttataaatgtgggaaaaaaaagataacccgtttctctagcaatggaaagaagaaatgacaaaaacacggcacacacacagagaaggatggttttttttcactgatggtcgtctgatggaaacacttgttccgtagtgtatacgtgtggacgtgtggttaatttcatgcaggagctctcccttaaaccttaatcacttgagcagcagcagcagtcgtcgagaaggtctttttcatgactttgagcttctcgg

SEQ ID NO: 12260 - DNA, 423 bp, Zea mays
  Clone ID: cC-zmpo14820005a11a1
cacaacaagtttccatggttaagtttcgcctccggctcggatagaaacaaacatactactagttcacaaatcgcccacaaacgacaaagccagaactgataacgacaacttttacagccatacgggctggcccttattgacggggacaactgatctgatctcatttaggcagacccattcgcaggcccaggcccggaatgcttttcaatcagggccaggagctcgtccttcctggcacccacgatggtcgcaaccgttttgccgtttttgaccaaagggaaggtcggcattgccttaacctcgtaggccggggggacttccttaacttggtccacgtccaccttcaggaagacgacctgagggaactttttggcgtgttcgacaaacaagggggcaaaggcccggcatggaccgcaccaggcg

SEQ ID NO: 12261 - DNA, 403 bp, Zea mays
  Clone ID: cC-zmpo14820005a12a1
ggaacccggcccacccaaaaaccaggtaacggaaaaagaaaaaaaccgggcccccactggggcaaaacccccaaacaatgaaggggaacaaaaagcccatttaaatgaaaaccggccccccccccggggggcccaaaaacaaattgggaaaacgggccggggatcggaaaacccgaaaacccccaaggtaaaaaccggggttttgcccggggccttgccaaaagccggggcccaagggaaaaggaagctccccgggggcgggtccaacaattggggggggagggttgggagccctctttggggaaaaccggacgggggaaaaggcaaacccgggggggggaaaaaaaccctttgaccgggacggaaaatactgagtatcccccaaagggggccaacaatgggg

SEQ ID NO: 12262 - DNA, 418 bp, Zea mays
  Clone ID: cC-zmpo14820005b01a1
cccacgcgtccgtccacgcgttcgcccacgcgtgcggagcgacgtccccgacggctctgtgttaaagacgatccgcccggagaagggcagctgcctcgccaccgagagccacatcacgtggaaggacggcaaggtctcccaggacatggtgctcaagctcagggacaccgagaccggtgagctcgtcctgcacctcacctgggtcaacatcccaggcgtcgcgatgtgaatcccctgctgcatgaggcggcgacgcctgcccagctggttttactacactaaatatatacgattatacgatatgaagtcttgcaatgtggctccgtacgtttaccaggtattgggcaacaaggagacccttgcatgcgtgtcttgctagtttgcagttagcttatctcacgctactgggactgggagc

SEQ ID NO: 12263 - DNA, 387 bp, Zea mays
  Clone ID: cC-zmpo14820005b01d1
attgtcagatataagaaatcattatgcatacatcaaaatgaatacatttgttcaaaaaaaaaaaaaaataaaaaaaaggaaaaaagtcaaaaaaaaaaaagaaatcaacgaatataaagaaaagaaaatagaaactaagagaaggcaaccaacctagatgtatgcccttcttaggttcgtgacgttactaggggggtctcgtttttgggggcccgatttctctcccgcggacctcccgcgctgtactttctctttggggccgccatagtccatctcatgggcccggtttttccgcccttctgaccggggaaaccctcgggttcccccctgttggttggctgggagcatgttccccgtttagcccctgggctactcatccagggggcc

SEQ ID NO: 12264 - DNA, 288 bp, Zea mays
  Clone ID: cC-zmpo14820005b02a1
acgcgatggttaaattgaattgttgaactggtccagacaaatggcaagcaatggtacaggtgtcgatccctctctcgagggaaagaacaaataacggggcaccaaattaaactggtacatcagcgataccaattagttaaatgaaaattagaaagaggaaaggaaaaaaacaaacaaaaggaagacgaaggtgtgccactgtcgtgcccaatcagagcacacccacccacgcatcgggaatgcgcgggagcagcagagcaactcatcgcaaccaagtctcttcccccc

SEQ ID NO: 12265 - DNA, 315 bp, Zea mays
  Clone ID: cC-zmpo14820005b02d1
gtgggggagagacttggctgcgctgcgctgctctgctgctcccgcgcattcccgatgcgtgggtgggtgtgctctgattgggcacggcagtggcacaccttcgtcttccttttgtttgtttttttcctttcctctttctgattttcatttaactaattggtatcgctgatgtaccagtttaatttggtgccccgttatttgttctttccctcgagagagggatcgacacctgtaccattgcttgccatttgtctggaccagttcaacaattcaatttaaccatcgcgtataaaaaacgtcatcaactgtaacaaa

SEQ ID NO: 12266 - DNA, 526 bp, Zea mays
  unsure at all n locations
  Clone ID: cC-zmpo14820005b03a1
tttttttttttttaaaaatattaaatacatattgtatttcaatttatataaccgtattaacccaacacaacaaggtgcacgaagggacatgtaacataacttatttcttgggtggtgtggtgccataaaataaccatagaacaaaaattaaatattagctcgctggcacatggatcagatgagctctttcaaaatattattcctcataagaggatgatcagatgctgagggtggtcttgtaggtggtgtcggccttaaaattttcagggatgacatcatcggcgatgcggtagccgccagacttgatggcaaagcggatgcagagggggtacttgagtggggcctttgtgtcaagcgtccaggtgccggccgggccctccttgagctcaaaggagaagtcatcgccaccgtgctccttgatctccacttcggagatggtggcaatgttgngggtgaagaccacgtggccaggcttggagcctttgccgacctttgaagtgagcggtgtggtgcacgaaccaatcac

SEQ ID NO: 12267 - DNA, 615 bp, Zea mays
  Clone ID: cC-zmpo14820005b03d1
aaagaaacaagagcacacaaacaatacctctctagctcgccaccaacaatggcctctaggttctccatcatgctcgccacaacggcactggctacgttttttgtgattggttcgtgcaccaccccgctcaccttcaaggtcggcaaaggctccaagcctggccacctggtcctcacccccaacattgccaccatctccgaagtggagatcaaggagcacggtggcgatgacttctcctttgagctcaaggagggcccggccggcacctggacgcttgacacaaaggccccactcaagtaccccctctgcatccgctttgccatcaagtctggcggctaccgcatcgccgatgatgtcatccctgaaaattttaaggccgacaccacctacaagaccaccctcagcatctgatcatcctcttatgaggaataatattttgaaagagctcatctgatccatgtgccagcgagctaatatttaatttttgttctatggttattttatggcaccacaccacccaagacataagttatgttacatgtcccttcgtgcaccttgttgtgttgggttaatacggttatataaattgaaatacaatatgtatttaatattttt

SEQ ID NO: 12268 - DNA, 178 bp, Zea mays
  Clone ID: cC-zmpo14820005b04a1
gataaaaagtatttttataaaagtctaaatgtattaagagttcatttggattttaacaaaaaacattggtcaaagttatattttggagaccgtgtcgttgtcctaaacgacaacttataggaaaccggagggagtccgtacgtacgtatgtactacaggggtacctagggctcgtttg

SEQ ID NO: 12269 - DNA, 178 bp, Zea mays
  Clone ID: cC-zmpo14820005b04d1
caaacgagccctacgtactactgtagtacatacgtacgtacgtactccctccggtttcctattagttgtcgtttaggacaacgacacggtctccaaaatataactttgaccaatgttttttgttaaaatacaaatgaactcttaatacatttatacttttataaaaatactttttatc

SEQ ID NO: 12270 - DNA, 224 bp, Zea mays
  Clone ID: cC-zmpo14820005b05a1
gggggggaaaccagggtttttttggacaaatgggttacctttcatttgggcataccaaacccttacgaacagcggtcacacttttccattaaattaaaggggtggaattttttttaggaaatcgaccaaacaatttggccggatcgagtcggataatatatattcggggggatgcaatagcatgcctttgggtaggcttggccacacttttccccacacgttcc

SEQ ID NO: 12271 - DNA, 224 bp, Zea mays
  Clone ID: cC-zmpo14820005b05d1
cggacgcgtggggcaaagtgtggccaagcctacccacatgcatgctattgcatgcctccgaatatatattatccgactcgatcctgccaaattgtttcgtcgacttcattatatatattccatccctttaatttaatggagaagtgtgactgctgttcgtgatggttttgtatgcgcaaatgtaatgtaatccatttgtccaacataatccttgtttcccacac

SEQ ID NO: 12272 - DNA, 339 bp, Zea mays
  Clone ID: cC-zmpo14820005b06a1
ggggaaactttggtgaaatgaccatgaaaaaaaagcccaggacctgcctttcatggattttccccggggaataaaaagcggtggaaacccctgggacttaaaagtacgggccagggataaaataccaacgggccacccgggcatggggctacccggcctgtaaactttggagctttagccagggaaagtggattgaacgattccctttttcattgcccgggcaatgccctggggggcaccgatacccgatcccagggggcccggggcccgagggcaaagggtcccaactcgccacttaggggccgaaaccggggccgggcttggagcaagggacttggg

SEQ ID NO: 12273 - DNA, 603 bp, Zea mays
  Clone ID: cC-zmpo14820005b06d1
gtcctggaccatccctgcaaattaccgcgatggctaccaaggtcctagtcatccttgtgttcctcgccgtggcctcaccggctgctctggccgccttcgatgtgatagagatgctggccgacaagcccacgtactccacgtacctgaagctcctgcaggacaccaaggtcgcggccgaggcgaatcatctccggtcggcgacgctactggtcggccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggagccccctgcgtggccaagctcgtcaaggtcgtcgcagcgcggccgtactctgtgtccatcatggagatcagcgagcccattttgccggccgcgttgccctcccccgtcgcggcgcccggtcgtcgcggcaagggtggtaagcgcaagatcaagccatcagcggcaa

SEQ ID NO: 12274 - DNA, 436 bp, Zea mays
  Clone ID: cC-zmpo14820005b07a1
ccactcccaaagaatgaatttaactgaacaaaagaatctgaagctttaattcgggtgccgctttggcccccgttccgtttaaagtctaggcttcggccctgagctttgctcccaagactagactcagcaaaagaagctactgtccttttacggcatttggggccgtctgtatgaggggatgaaactatttagggtgcaatttaagccaaatacactggccggctctcagcttgtgtataaaaaagaggcagcaactttttcccaggaaaatccaaaaactggaagccggagccgagcttggtcaagcggcaccttgaatttcttaaccaaaaattgggagccattagtaggtggacactgcaaatctaaattcatggatcatatgattcttgcatcatcaaaaggtccaattgccaaagaaatgccctttcctttg

SEQ ID NO: 12275 - DNA, 458 bp, Zea mays
  Clone ID: cC-zmpo14820005b08a1
gagagctcaacatttgatattattcattgagaacaccacatgtatttttgcaagtagcctcatcaggcatctcattaaaattgaataggtcgaacatgtgtccaaaatgacaagtgagaagcattaggtagcaacaatagacattacagtcttgatgaataggagaaagcggctgccgacagaccggcagaaaactttgttcatgctaatgaagaaacagcaacaaaaggagaaagaaacggggcgggaggctggcgataatggctcctctcggctttgcatctcttgggcccaaagaattagaagcatttcctgtgcacgatggacgggccagactcgtcgtactcagccttggcaatccacatctgctggaaggtgctgaacgatgccaggatggatcctccaatccagacactgtacttcctttctggaggagcaaccaccttgatcttcatgct

SEQ ID NO: 12276 - DNA, 108 bp, Zea mays
  Clone ID: cC-zmpo14820005b09a1
catgattgtgaggcgtcggtctaatagtaattacatcggttggttttgtgatgatccaaagaagaaagaaaattcaaaccagcggattatatattcgggggagacttg

SEQ ID NO: 12277 - DNA, 472 bp, Zea mays
  Clone ID: cC-zmpo14820005b10a1
atctcgatacatgaattatatatgtgatgaataaacagttttatgtcataaacgacgtacaatgacaattcaaaacaaattaaaatgcgattaacgatgaagtagcgaatgaaaatcattcttgaagatgagtccacatcttgtgcttggcttagctatgagctctaacatactccgacgagtcagccatgctggtccacacatcattgagttcctggccactcctttctaatctcaaagtagtaactcatctccaggaagcacttgccatcatcatcaacaaactttagtttggcagaataagaacctctcgcaaaaatgccagcaggggtggtctcttcttcgccctcgtagacatagggctctagctgggggctgaacgtccccagcatcatcttctgggtctccactttgactccagttttccagacagtgttggtgtacttgaggcctgacacgatgttgttggaga

SEQ ID NO: 12278 - DNA, 485 bp, Zea mays
  Clone ID: cC-zmpo14820005b11a1
cgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcggagacgggggcggggcttggagcaggtgactcggacacggtatccttggccaccttacccttacccaccaccactgcttcgacgggcttgcgcgggatcatgttggaatcctcatgggttgccgctgatggcttgatcttgcgcttaccacccttgccgcggcggccgggcgccgcgacgggggagggcaacgcggccggcaaaatgggctcgctgatctccatgatggacacagagtacggccgcgctgcgacgaccttcacgagcttggccacgcagggggcgccgggagcgccgaagtacatctgcccgtcgtc

SEQ ID NO: 12279 - DNA, 374 bp, Zea mays
  Clone ID: cC-zmpo14820005b12a1
aaatgcgaataaaagttgtattgattcgattgttgattacaaatcggccgtatacctctctatttatagaggaggggggctggaccctttacaaactaatttccgagcttatctcctgattttagctaacaaccgtagcacaaaactcggaaccctaatctgttctgcgcacgcgcggaccgttcggcccacaggcgcgggctgtccggaccgcggaccgtccggcctcagggccggaccgtccgcgcgctcaatttggtgctcaacaaaaagtaataattgttggggcaggcaggagatcggctaccattcatgtccccgccggccgtcgttcctcctccccggcgtggcgacgaccccgcggcctcggcctg

SEQ ID NO: 12280 - DNA, 444 bp, Zea mays
  Clone ID: cC-zmpo14820005c01a1
aaaccaaggatcaatgtgagaaatctatatatgccccatacaaactacggtgatggccgatgcctgcaacgtgacataccatctgaagaactcgcatgcatgattatcccacgggactgaacaccatgcactctcatatacgccgggactgcactgggctgaactgaactgcactgcacgaaagactgatgcttgacttacaactgctgtccatgggtctacagccaaaggaaaacgcaccacgatcctgagctacctcacaagctccaacccctgactgaccattggatcggatgctcacgctgcgtgctgtacagttccggccggacagctcctcagggcgacagaggactgactgaccagcgacccgtagggctgcacgatgccgtgcaggtctcgattggcggtctaccaggacgacacggaggctttcatgcggatcac

SEQ ID NO: 12281 - DNA, 410 bp, Zea mays
  Clone ID: cC-zmpo14820005c01d1
aaatcatgctatagaaacacactgtacccaataatcgcgagacccacataaactttggtgtcgggccgatcgagcgatcgctgccgcgtcggatgacagacaccatcagtacccagaaccatgggctgcaacctggctcaatgcgccaacgtctgcgggtggaccgatgtgcccggaaatcctagacctgctgcgtacgcgtacgtatgcttctccgggaggaagccggcggtcggcagcctgcgtgtgcaacggcaggcgagctgctagccgtaactggggccgacgcggactgtgtacgtctgacgggcctgagcgccagcgagcacggcctaactgtgctccggagacatgaagtcgcccggcgtgcctgagaccgttatgacgccgctggacaccgagcatgagtg

SEQ ID NO: 12282 - DNA, 477 bp, Zea mays
  Clone ID: cC-zmpo14820005c02a1
cataaatactatagttttgttaataaaaaccaaaattgagtagtaagacgatgattagcacccagttcacgcaagagcgcggcaagttcatacatttgcccatttctgttcttttttacagccatgatacatatcagagaccattaacatgagccaaactgaaaaaaggctccagatttttacatggcaccaacccggcatgctcctgctccttcctatgtacattgggaccaaccaacgggccaagctttcaagcggtagcaaccatggcaatattgcttagttctcccaatgatgcgaactgctgccgccgctaccggaggactgcgccgacggcgagaacaggctgttgagccactgcaaggatggcggcaaccgcctgccactctcttcagcttcagctagctcggcgttgcccggagagcttgccctaccatcaccctcgccgttgtcactgccttcacgatccgcattgac

SEQ ID NO: 12283 - DNA, 488 bp, Zea mays
  Clone ID: cC-zmpo14820005c02d1
gtcgatgcggatcgtgaaggcagtgacaacggcgggggtgatggtagggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacataggaaggagcaggagcatgccgggttggtgccatgtaaaaatctggagccttttttcagtttggctcatgttaatggtctctgatatgtatcatggctgtaaaaaagaacagaaatgggcacatgtatgaacttgccgcgctcttgcgtgaactgcgtgctaatcatcgtctttactactcaattttggttcttattaacaaaactatagtatctctgaaaaatacca

SEQ ID NO: 12284 - DNA, 193 bp, Zea mays
  Clone ID: cC-zmpo14820005c03a1
ggcgtcggacgcgggagccggggcgggggcctcggcggctgcggcggacgccacgagcgcggcggccatggcggcgacggcgacgaacttcatcctgaggccggccatctgcgagtctgtagtaagccgggtgtttattgggccgcgccggatctctcttcgagctagttctagatcgcgatctagaactagt

SEQ ID NO: 12285 - DNA, 365 bp, Zea mays
  Clone ID: cC-zmpo14820005c04a1
atgaaataatgtcaaatttagatactttattacattaacgattcatcaccacattctcacgtagttttgcacgcagacaattattaagcaaaagcgatatactaaacttgagcatgcctcgacaggacttctcctgaccgaccggggacaccaagaaggtacctgtggtcatctttagtaaactcgacacgacaattgcgtaattatacaatttagtaatccgctgcggtaggtactttgctcgtcccttcttgcacaaacgaaagagacagtgaggaaaaaaaatgacttgggtgacctggcacagtggcagtggcagcccgaaggcccgaacacctactccgacgatgatccggacgcgtggg

SEQ ID NO: 12286 - DNA, 384 bp, Zea mays
  Clone ID: cC-zmpo14820005c04d1
cccacgcgtccggatcatcgtcggagtaggtgttcgggccttcgggctgccactgccactgtgccaggtcacccaagtcattttttttcctcactgtctctttcgtttgtgcaagaagggacgagcaaagtacctaccgcagcggattactaaattgtataattacgcaattgtcgtgtcgagtttactaaagatgaccacaggtaccttcttggtgtccccggtcggtcaggagaagtcctgtcgaggcatgctcaagtttagtatatcgcttttgcttaataattgtctgcgtgcaaaactacgtgagaatgtggcgatgaatcgttaatgtaataaagtatctaaatttgacattatttcataaaaaaaaaaaaaaaataa

SEQ ID NO: 12287 - DNA, 461 bp, Zea mays
  Clone ID: cC-zmpo14820005c05a1
aagccgtaaaataaatgtcatgtctatcatgagaataagcctcagctattctggtttacatggcaatgttaagtaagcaaaaatgaaatacataagggtatctttgtattggccagtcaaggggaatcaatgtatattgcctccacactattgactggtgcgtggtaataaaacaacacgcgataacaaaaagggccggaataaattccttgggacggatcatatcgatcttacggtggtgagtggtcatcatcctctataactccttgctcgctgaaccatatccaaaatctgagccaccccccgatgatttactccctccagaagcacctgcagcagcactgccacttccttctacactttcttcggcgccggcaccaaatttgacgccttcgaagacaccagcacctatgttagcttcaataccaccgttggcgccaccggatccttcaccagaaacg

SEQ ID NO: 12288 - DNA, 503 bp, Zea mays
  Clone ID: cC-zmpo14820005c05d1
gtggcaacgtctatactggaaccggtgccgatgcaggcgtttctggtggaggatccggtggcgccgacggtggtattggagctaacataggtgctggtgtcttcggaggcgtcaaatttggtggcggcgccggaggaagtgtaggaggaagtggcagtgctgctgcaggtgcttctggagggagtaaatcatcggggggtggctcagattttggatatggttcagcgagcaaggagttatagaggatgatgaccactcaccaccgtaagatcgatatgatccgtcccaaggaatttattcctgccctttttgttatcgcgtgttgttttattaccacgcaccagtcaatagtgtggaggcaatatacattgattccccttgactggacaatacaaagataaccttatgtatttcatttttgcttacttaacattgccatgtaaaccagaatagctgaggcttattctcatgataaacatgacatttattttacggcttaaaaa

SEQ ID NO: 12289 - DNA, 518 bp, Zea mays
  Clone ID: cC-zmpo14820005c06a1
cagtacaaacaacccagtcaatataacaatatgttaatcatggaataaacaaggtagtacacagtacaacagtccaatataatccgcttcatgcatatatatacatataaagaagggcgcggctcagctccccgatccgaccctagaagttcttggtggcctggtacgttttgccgaactgccagtcgcggggcgtgacgtgccaggaggtagccttgcggtggtcggcggtcatgacgcggaacgtcagcgactcgccggtgaggtcgacctccgtggtccagagctggccccagctgcgcttcatcggcgtccacttgacgcgcttgttgcccttcacccacagcgccaccacgtccccggcgccgtccacgttggtcaccttcacctcgctgtagtgctggttccccgtgatcgtgtaccggatgccgcctttcctctcgcacgccaccttgcggtaggtgatgggcacgatgccggccttctccttggcgatcttgaggaaacgccgtatggtg

SEQ ID NO: 12290 - DNA, 611 bp, Zea mays
  Clone ID: cC-zmpo14820005c06d1
agcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgttcctcaagatcgccgaggagaaggccggcatcgtgcccatcacctaccgcaaggtggcgtgcgagaggaaaggcggcatccggtacacgatcacggtgaaccagcactacagcgaggtgaaggtgaccaacgtgggcggcgccggtgacgttgtggcgctgtgggtgaaaggcacaagcgcgt

SEQ ID NO: 12291 - DNA, 580 bp, Zea mays
  Clone ID: cC-zmpo14820005c07a1
ggacggcggcggcgccggggaggacgacgacgagcaggagatgcgggaggcgttcagggtcttcgatgtcgacggcgacggcttcatctctgccgccgagctgcaggaggtgctcaagaagctcggcctccccgaggccagcagcatggccaacgtccgggagatgatctgcaatgtcgaccgcgacagcgacggccgcgtcgacttcgccgagttcaagtgcatgatgcaggggatcaccgtctggggcgcttgatcgatctcatcgtcgtcggagcggacgagtgtgtgtgtccaggagcgggggcgaggcaaattgaacccacaaagctccgcaggacccgtatttccttcctcgagacagcgatgcgactgcgaccttcattcttgtcttgtcttgtggtggcaccggtgtgtctctacttgtgtgtgctcttcttttaaattcattaattaatcttgtcgtctttcgctggtcaagcagaggcgatgagaatggttcatgcatgcccggtgcatgttggtgtaggcactggatttgcaattttgcattaacccgatcacgcctgatctgcttgct

SEQ ID NO: 12292 - DNA, 458 bp, Zea mays
  Clone ID: cC-zmpo14820005c08a1
gctgcgaaaacaaggggcatcttattatacaataagattttcaacacacgcgtcaatcctgggaaacaacatgatgaaaaacagtccacatatatgagactgtaatactagtgtgcacttcagactgcttaagattaacaatcagaagatacgatgcatccaggaacttcagaacgcctctgatatatgaagaaaaaatgcagtgccccacaccagaacaccacatagaatgtatgtttgatcaatctgagaacctttccgacaaagctttttgccgttgagttagactggttcattctatggtccatggcaacagcatcgcaagaaaagctaatgctatccctgcaaattccacccaagttccttgcattgctgttcatccggctgcagtgtgtttggtattgcaccgaacacacaacgcacagcttcaaacccagagattgtattatggaaaaatg

SEQ ID NO: 12293 - DNA, 516 bp, Zea mays
  Clone ID: cC-zmpo14820005c10a1
gaatcaagcactctgttacatttttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtagccgagcgggttggcggggcgcaggctgtcggagatgccgacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggtcgcgtcggtgaccccgtcgatggcgcgctcgagcttgccggtgccgaagtgcctgcactccagccttaccttggcgcccgcgatgtactcggtgacgttggtcacgaacccggcg

SEQ ID NO: 12294 - DNA, 369 bp, Zea mays
  Clone ID: cC-zmpo14820005c11a1
cgccccggggcccggaaacggggacctatttccgggggggaaccccccggtgccctcagttgggggcccaaacccccccgggtggggcaacatacccgggggggaccccgcctaccgttacgggggggtgctaactgggcttttccaactccggccgggtccttaccaccttcgccgaggggatcctggtcccgggccccggaatcctccccaagttctccccggccatggcccgccgaaccatttcctccctttgccgaatcctgggccaagtaaccgggccggccccaaaaagcgtcaagggcctggcttccaaaaccccaccggggccgacacccaccgtccacgcccaccacctggcccttacgg

SEQ ID NO: 12295 - DNA, 421 bp, Zea mays
  Clone ID: cC-zmpo14820005c12a1
acctaaaaaacagggtccttttacttggctttaaatatgaggggtggccccccaaaattttcaaagccctccgggatttttccccctacgaacgaattgaagccacctggactccccgggccccggggttaaaaaaggtcctgttcccgcccacaggggggaatgggccccgggacaggggtttccatcgatcattagggcacccgggtgttgcaccagcaggggccggacccgggggggagttccccccctggggctggagctggacccccccggttttgacgttcctgaacccggggataattgcctgggcgaaattgtcggtcctccagcaaacgggggtttttttggggagggaattcctggggcttggccctttgggcccgaaaaagggccccgtcctaaaaattttctcccgggg

SEQ ID NO: 12296 - DNA, 534 bp, Zea mays
  Clone ID: cC-zmpo14820005d01a1
aaatcaaaaaggtcattgctcactttatcttttattattctttttttactattttctcaagatgttaacatcctctccaataaaaatacttcacgagcttgtcctgacaagttctaactaattccgtcaggaaggtcgatttgaagcataccaaatgtgaggtaaaaaatcgaatcacacgtacgcagacgtaaaccgaaaacgaaaacgtgtgagaacatctcgcatcacgaatgttattgcgttattcctccgcagagcgcccatcagctagcacaccatgctgctcttcttcttgctattggcgaccagcctccgccagaaggtggtgacctccttctcgatgtcgtgcaccgacttcttgggctgctccggcgcctgcttcctgccggcgtgcgcgtccatgtcggccatggtcttgcccaggtccgcgatgaggcgctcggcgagcccgcggctgaagtcctcgcggatgaccacgcgcatgacggccacgtgctcggcgtcggcgggcatggtatatgccggcacgat

SEQ ID NO: 12297 - DNA, 604 bp, Zea mays
  Clone ID: cC-zmpo14820005d01d1
tcggcgcagtattaccagctcatccgcctcggattcgagggctacaaggacgtgatgcagaactgccgcgacaacgcggcggtactacgcgagggcatcaacaagatgggctacttcgacgtggtgtccaaggactcgggcgtgccgctggtcgccttctccctcaaggactcctccaagtacacggtgttcgaggtggccgagagcctgcgccggttcggctggatcgtgccggcctataccatgcccgccgacgccgagcacgtggccgtcatgcgcgtggtcatccgcgaggacttcagccgcgggctcgccgagcgcctcatcgcggacctgggcaagaccatggccgacatggacgcgcacgccggcaggaagcaggcgccggagcagcccaagaagtcggtgcacgacatcgagaaggaggtcaccaccttctggcggaagctggtcgccaatagcaagaagaagagcagcatggtgtgctagctgatgggcgctctgcggaggaataacgcaataacattcgtgatgccagatgttctcacacgttttcgttttcggtttacgtctgcgtacgtgtgattcgaatttttaccttaca

SEQ ID NO: 12298 - DNA, 458 bp, Zea mays
  Clone ID: cC-zmpo14820005d02a1
aaattatattcacaaagaactgtgaccacattgtaaagatattacgataaactgatgaagagcagcaaaaccaatgctagttgttcaaagatagatcacgacgagaatagcctgcgaggacgaaagcgtcatcgtcttctcacatcgtagcggcgcctgtcgtgagcacgagctcgagcgcactactatgggcatggctgcttggttgagcaaatgattccccctcactgctgcgagttgcgcacctccaacgcgcactgcgactggaataagggcacaagggacgccggctccgccacgggcgtcgacatcgctgggtgccgccaccccatgccgagcgcgggcgccgacggcctcggtgtcacgtcgtgcacctggtgctccccactgctgccatgccgagcggcggcgccgcgctgctgctgctcggcaccgctcctgccctcggcctggtcccc

SEQ ID NO: 12299 - DNA, 452 bp, Zea mays
  Clone ID: cC-zmpo14820005d02d1
gctagctcggcagacgagagagcgagtcaccgcgagaaggggatcgcggaaagtgagagcagaatcaacaatccacctgctcatcgagtcgatggagatgaaggttgctgcctcacggccaggatgcaagaaacgccccccgagccgtctccagaagcatgcgccagcgtcgctgcaactggagcaggctgtcgccagtgcggggacgggagcaccgcccgcggcgtggggtgacgggagggcgccgatcccgctcctgtcgacgctcgtcgtgactcccatggtgccggtctgaaaagcgtgcccgacgggggtccccaggaacgagggaggaggggaccaggccgagggcaggagcggtgccgagcagcaccagcgcggagccgccgctcggaatggcatctctggggagcaccaagtgcacgacgtgacaccgaggccgtccgcgcccg

SEQ ID NO: 12300 - DNA, 585 bp, Zea mays
  Clone ID: cC-zmpo14820005d03a1
ggtcctaaatcttgtggtgattattgtttgtgggtagtgttacaagaatttgggcaaccccagtcagtagctttctgcatttgtcatcatagagatttgactattaaattgaacagctgttctggtgcagagaagaaggggctgtgatctgtatctatgaccaaaacctcactgggtggccactttttgatcatggagtcttgctgttgaggatccagcatgtggtcgcgctccatctttatgaaagttcgtttgattcggttcaatctctcatcatctccttcgaagcttgctgtactgatagctgttgcaggccacggacgcatcagcattgaagcaagtactgattcctcttcagggctttgttgtgatagtcgatcacgctggaattctggcctcaaggcaatggttgttggaggatcatctgctcctgcaccaagtgtcaactcaatctcgttctcgggcaaagtcggtaacccatcgttcttatcttcatcggcttgaaatccaaacggcagcattgtggcggccacgaaaaatgcttgaccgatcctgtcaacaattcatgcattgcatggatcacac

SEQ ID NO: 12301 - DNA, 625 bp, Zea mays
  Clone ID: cC-zmpo14820005d03d1
gcggaaggagcagcacttcgtgcttgttcatggcgaagggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaatttgttgacaggatcggtcaagcatttttcgtggccgccacaatgctgccgtttggatttcaagccgatgaagataagaacgatgggttaccgactttgcccgagaacgagattgagttgacacttggtgcaggagcagatgatcctccaacaaccattgccttgaggccagaattccagcgtgatcgactatcacaacaaagccctgaagaggaatcagtacttgcttcaatgctgatgcgtccgtggcctgcaacagctatcattacagcaggcttccaaggagatgatgagagcatgaaccgaatcaaacgaactttcataaagatggagcgcgaccacatgctg

SEQ ID NO: 12302 - DNA, 519 bp, Zea mays
  Clone ID: cC-zmpo14820005d04a1
aaataaaaggtatcttattatatatgatgcagtgctgcttacaagaagcagatggtacattactacatttcaaatttcattgcaaagtagaatatatatggacataagatcacattcacatggatgttgctccacactttttagcacacacagatatacaacgcaaatacacattgattgccttctctggaggcaattcaccacacgtgcgttcctttagttacccccaggaggatggcaacggcagcaacaacggcagcaattgtgcaagcaacgtatcctggtttctctcgttggtcatgtacccgcacacatataagaacgaaagctccaatgaaccatggaatggcagccaagaaaaacccggttatgaacagacaccagcctaagccgaggccacaacatgggagacgcctcattctcacaggtctttcttcagcaacaggaccatagcctggtacggcctggtacccctgggcgtagtacgtcttcgcaggcgcgtacggctgctgctggttg

SEQ ID NO: 12303 - DNA, 643 bp, Zea mays
  Clone ID: cC-zmpo14820005d04d1
accggaggcggacggcggaaaggccgggggcctcccgccgtcggagccgccgcacctgcagggccagccgccgcaggagtacgggtacggcacgttccagggccctcgacatcctcccgtcgggttcccgcagcctgccccgcctcccgggctcggcggcggcggctatcacaaccagcagcagccgtacgcgcctgcggagacgtactacgcccaggggtaccaggccgtaccaggctatggtcctgttgctgaaggaagacctgtgagaatgaggcgtctcccatgttgtggcctcggcttaggctggtgtctgttcataaccgggtttttcttggctgccattccatggttcattggagctttcgttcttatatgtgtgcgggtacatgaccaacgagagaaaccaggatacgttgcttgcacaattgctgccgttgttgctgccgttgccatcctcctgggggtaactaaaggaacgcacgtgtggtgaattgcctccagagaaggcaatcaatgtgtatttgcgttgtatatctgtgtgcgctaaaaagtgtggagcaacatccatgtgaatgtgaacttatgtccatatatattctactttgcaatggaattttgaaatgtagtaatgtacccatct

SEQ ID NO: 12304 - DNA, 299 bp, Zea mays
  Clone ID: cC-zmpo14820005d05a1
gaaaaaaggctccagatttttacatggcaccaacccggcatgctcctgctccttcctatgtacattgggaccaaccaacgggccaagctttcaagcggcagcaaccatggcaatattgcttagttctcccaatgatgcgaactgctgccgccgttaccggaggactgcgccgacggcgagaacaggctgttgagccactgcaaggatggcggcaaccgcctgccactctttttaagttcaactagctcggcgtttcccggaaagcttggcctaccattacccccggcgttgtcactggc

SEQ ID NO: 12305 - DNA, 607 bp, Zea mays
  Clone ID: cC-zmpo14820005d05d1
ggcggagcaggcgggcgtcggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagccggcggcgagcatggcgtggcgctgggcgactactttctcggccccagcctcgacgccttggtacagcagctcgccgagaacgatgcggcgcggcacggaacgccgtcggccagaaggaggccgtggaggcaatgccta

SEQ ID NO: 12306 - DNA, 368 bp, Zea mays
  Clone ID: cC-zmpo14820005d06a1
gggcaaaaaaaatagcgctggctgaattacagattagtggggtgggtattagccatcctgtacgttctcaaggggattcgactccgattcattgccaccccaagggagggggtgctccaggcacaacatcaatcaatctgcctcgggcgtgcagctgccattaacaactaacattttaagaatgcaaatacaacttactatgcttgtgagaacccggtttactcctcgaagccatccatcatggggcggtggcctcctttcgaagaagtgttctttgaggactgtttttgggctgtggtccctctgtttttggatttctttgcctttatcctcggtttttttttggctgcatctacccatgtgtaaaa

SEQ ID NO: 12307 - DNA, 544 bp, Zea mays
  Clone ID: cC-zmpo14820005d07a1
agaatcagcatgtactatcatatatttcaattagtcataaaaaatatgtattctattaaaatgtagccatgcatgataaagttaggattacgtaggagatacatggacaacacaacattcatggatccttttataaaaaatgaaggcctatcaaatatttcattaggcacttattatataacttgtcaatccatttcttaactcttctcttttaaacaacagcgaagtctcactctagctatatatggagatgaagaagatggagaaggaggatgacaccatcattgttggcgccagcatcactgtcgtaatagggtagtggtagcaaatagatatcacggtccaatgcatgcatgtgtaatgcattgcttgggatccaacccaatctagtatagctagcataggtcggcttaaagtattgtcagcactaaagttaattatttggcggtgtaagcggtgttggccttccagttggcagggatgacatcgtcgtaaacggacttggtgcctccctcggtagtgaagccgaccgtgaggggtccct

SEQ ID NO: 12308 - DNA, 476 bp, Zea mays
  Clone ID: cC-zmpo14820005d08a1
caataagccccaggatgttgtattatcagaaccccatggagggaaaacgggagacatcaaaggtttgttttgtttacaaggtgaccgagtctctctcccgacttaaacatgtatgccaattagtggtcgatctctttcttgcacattgatcatcaggcatcagccaattgacatgcagtcaattagcttagcgatggcttctccttctccatctatatctcctcctgggggtctttcttcaattctgtcgtgggctcggctgccaccttgttggtggcaatattttcctctgcatggactgctgatggcttctccttctcgatgacggtcttctccacaacttcctcctcctttttgttctcaggctcgacaacgacgaccgccacttccgaagtggtcacctcactagcaatctgctgaggctcaatggtggctgctggctcttgtttcgccgccactgttagtgcctcctcctt

SEQ ID NO: 12309 - DNA, 412 bp, Zea mays
  Clone ID: cC-zmpo14820005d10a1
aacccaaaatgcacgaggttccgttacttctcaaagcagctgtaggagcctgtagcttctttcatggttttaaaagcattacataagcagcaaaaccagaaataatcctctagtaggtgaataagcagacacaatacgaccccgcacacgtaccacttattaggacagtgacagtacagtacaaatgataagcaaggggcagatcaagaatcacaagtaggagccataaaaaagcatgatagagcgcaggcacaccagaccagaccagaccagaccaaaagcttcttccaaaacagaggaggcgcctcatgcagaagacggcttctccgccttgaggggcttcaccacctcccaggtgaagtcggggtcgtcccttccaaagtgcccgcccacgcgtccgcccacgcgttcg

SEQ ID NO: 12310 - DNA, 506 bp, Zea mays
  Clone ID: cC-zmpo14820005d11a1
gatggttaaatcgaattgttgaactggtccagacaaatggcaagcaatggtacaggtgtcgatccctcactcgagggaaagaacaaataacagggcaccaaattaaactggtgcatcagcgataccaattcgttaaatgaaaatcaagtagaaagaggaaggaaaaaaaacaaacaaaaggaagacgaaggtgtgccactgccaccgccgtgcccaatcagagcacgcccacgcatcgggaatgcgcgggagcagcagagcagcgcagcgcagccaagtctctccccccaccttggtctcttccctccggctccggctcctcgtccggcggctcagtgaatgtagtacgcgaagaaggaggccacggcggccccgacgatggcgggtgcgaccgcggaggagccgctggtgggagacggagccggcgcctccgcggccagcgccacggtggccgaggcggcgacgaggacggcgcatgcgatcttcttcatctccatccctggatg

SEQ ID NO: 12311 - DNA, 590 bp, Zea mays
  Clone ID: cC-zmpo14820005d12a1
atagaagacaacccattggacagtaatcgtgaatcagaatccagtaatacaattaggggagtttgtccagcaagatctatgcctcaggttgttgctataagcaccaccagatttcatcgtagcgatagggttgcagagaagcatatatatacattttgaacaaatgaataccatagaactgatttcaatttggttacagaaagcacatacgttagcaatcgtgaatgattggctttacagaaagatcgcacaagtttgaatgacaactaacactgaagatggtttgttcatggattgaaacgtgatggctgaaagaacaaatcatccggggccagctataggcaaacatcaagatactgcagagagaacccttgcaattgtatgacttgctgccaccgctcaactgcagcagccaccagcctgtgaggacgagccagcaccacctccagatgagttgggaacagcatagccaactttgatcccgttggactcatttgatacatcaaatatgccatcttggattttcttgtatattgtaccagcggtcttaatgaatgcctcctcgacgttttgtgcagttttagcagatg

SEQ ID NO: 12312 - DNA, 492 bp, Zea mays
  Clone ID: cC-zmpo14820005e01a1
caaacaaatggaaaaccaaatcatatatttcatcgcatgattacagaacgacttgacacaaatagataaattaaatcacgtctatgtaattaacacaacccgtcaccatgcatatatattcatatcagatcacatcaataataatatatggaaacagcggtgcaggtgacgtcttccaagtcgaccaccgcagcaacagtcaccaagaacgagcgaggcaactgcaatggcaacggtggacggatccatcgtcgtccatgcgcgcgtacgtaagcacgcacacgcttagtggaggtagtaggcgaggagggagaagaggagcgcggcgggcgcggcggcgagggcgggcgcgccgctgctggcggagggccccgcggcggcggcgccagcggcagcgccagcgccagcgccagcgggagccttggcggacgactcggaggcagttggggcgcccgcggcggcggcctcggtggaggccagcactgcggtggc

SEQ ID NO: 12313 - DNA, 566 bp, Zea mays
  Clone ID: cC-zmpo14820005e01d1
gagaatcctgcagtcctccaataagagccagccagagaaactaataaatctctcaccgccgccatccgagagaacaagccaaccgaccccgttcccaaggcaatccgtcgtcgacgtaccaccgtcaccgcatgagcgagatggagatgaagaggatcctcttcgccgtcctcgtcgtcatcgtcgtctcggccaccgcagtgctggcctccaccgaggccgccgtcgcgggcgccccaactgcctccgagtcgtccgccgaggctcccgttggcgctggcgctggcgctgccgctggcgccgtcggcgcggtgcccttcgccagcagcggcgcgcccgccctcgccgtcgtgcccgccgcgctcctcttctccctcctcgcctactacctccactaagcgtgtgcgtgcttacgtacgcgcgcatggacgacgatggatccgttcaccgttgccattgcagttgcctcgctcgttcttggtgactgatgctgcggtggtcgacttggaagaacgtacctgcaccgctgatttcatatatcattattgattgtgatctgatatgaa

SEQ ID NO: 12314 - DNA, 423 bp, Zea mays
  Clone ID: cC-zmpo14820005e02a1
cttatatataatgtggaatacaaatataataacaagcatcgatcgatctctcgatcgagtggacacgattacaaatccatcgagatcggtgtgttgtcgaactttgtgggcaggcacgcacagtgtgcatacgcaatgcaatgcatgcatggataggcagatgatataggagcattaactagttcatgggatgtcaagtttgttatccttgtaagggtccctaggcccctgcttagcagcgatctccttgcacctcttcatgcagtcctccatgctcatgtggagtgggcccgtgacctcgtcacacccggccttgcagtccatggcggtcgtcggaggggcgggctccagcacgagcgtgatgagaagcatcgtcgctacgatgaggaccgttttattcgacgccatcgtcggtttggcttg

SEQ ID NO: 12315 - DNA, 460 bp, Zea mays
  Clone ID: cC-zmpo14820005e02d1
caaaccaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactagttaatgctcctatatcatgtgcctatccatgcatgcattgcattgcgtatgcacactgtgcgtgcctgcccacaaagttcgacaacacaccgatctcgatggatttgtaatcgtgtccactcgatcgagagatcgatcgatgcttgctattatatttgtattccacattatatataagaaatacaaattaaaattaaacttaagggactacacat

SEQ ID NO: 12316 - DNA, 516 bp, Zea mays
  Clone ID: cC-zmpo14820005e03a1
gtcaggttggtggcggtcactgcagcaatctgagaattcgctgtgacctggttaggtttggtcagagccgaaacaaatccaccctcgcccaaaagttacagcaaaatgcagcaggaggattaacgctgaggaagggttacacaccgtagagaagaggcgagaaaagaaaaattacaagcagacatcaacctgaactgacggtatgcacaggcggctaagaacgctatacactgtcatttgcaacggcggctatacactgtcactggcaagtatccggagagttcactcgcggccggtctgccagcgacagagcttcacagaaccgcagctatgcaatggaccatttctctgtcgttagcttcctcaagattgtgtggtgctgggcgagacacagcagaaccatttcttcgacgcgttggtcctggcgttgtaggaagtcatcttctcggccctggagtccttgctgtcagccgacaccgacctgttgctcctgatgtggccttgggtcgggggagc

SEQ ID NO: 12317 - DNA, 535 bp, Zea mays
  Clone ID: cC-zmpo14820005e03d1
gtggccaatccttctcctatctcgtcccggagtcccgggggaaattttgccccagaaacactagcgcgtcggatcacaagcaagggcgaaaattttctgtggctccggcggctgaaggacgctgcggcacccatgtcggacgacactggtggccgcgctctacccaagttcggcgagtgggacgtgaacaacccggcgtccgcggacgggttcacggtcatcttcagcaaggccagggacgagaagaaagctcccccgacccaaggccacatcaggaacaacaggtcggtgtcggctgacagcaaggactccagggccgagaagatgacctcctacaacgccaggaccaacgcgtcgaagaaatggttctgctgtgtctcgcccagccccacacaatctcgaggaagctaacgacagagaaatggtccattgcatagctgcggttctgtgaagctctgtcgctggcagaccggccgcgagtgaacttttcggatacttgccagtgacagtgtatacccgccgtgcaaatgacagt

SEQ ID NO: 12318 - DNA, 538 bp, Zea mays
  Clone ID: cC-zmpo14820005e04a1
aggcagcaggcagcagcactgcaagacgcgttagtatttctcatagacagaactgtacatacaccaagatttttggattttttaactcccccgtatcaaaaaaaaaagctcgctctctaactgactcatccgggccaccggccacaccgatcaccggaccgcccgctagctgtccgccgtttcccatgaaccacccaccgttgtcgagtccccgctgatctgggcaccactctctccacttccaccgttggccctggcggcgctcatgcgtgcctcgtacgcgtggccgaggttccttaaccggttgagctccggcagtatgactgtggcgaggtccggccggtcccttcgccgcatctccgtgcacttgagcgcgagcttggcgtagccgagcgccttctcgacgggccagtccttgacggtgatgtcgagcatctgctcaaaggtgcccgcgtcgatggccttctcgacgtgatgcgtgagccccatgggtggccgcgcggtgaccacctgcagcaggagcacgccgagggagtag

SEQ ID NO: 12319 - DNA, 582 bp, Zea mays
  Clone ID: cC-zmpo14820005e04d1
gcgcggagccgctggtgcaccgggacctgaagccggccaacatcctgctggaccgcaactacgtgagcaagatcagcgacgtcgggctggcacgcctggtgccgtcgtcggtggcggacaacgtgacgcagtaccggctgacggcgacggcgggcaccttctgctacatcgacccggagtaccagcagacgggcaagctgggcgtcaagtcggacatctactccctcggcgtgctcctgctgcaggtggtcaccgcgcggccacccatggggctcacgcatcacgtcgagaaggccatcgacgcgggcacctttgagcagatgctcgacatcaccgtcaaggactggcccgtcgaggaggcgctcggctacgccaagctcgcgctcaagtgcacggagatgcggcggaaggaccggccggacctcgccacagtcatactgccggagctcaaccggttaaggaacctcggtcacgcgtacgaggcacgcatgagcgccgtcagggccaacggtggaagtggagagagtggtgcccacatcagcggggactcgcaacggtggttggttcatgggaaaccgctga

SEQ ID NO: 12320 - DNA, 502 bp, Zea mays
  Clone ID: cC-zmpo14820005e05a1
gttggtactaatgttatatttcaagatttggatattgcaaaagaaagacaatatacaacacctccacttagcgaaggaacaagtgctgtacaggtttgctgctctaccaattgaatgatcagactcagaagtagcaaccagttcagagaaaaactgagttgctctgttttgcaggagcacccattggggcaaggtcactgaaaggatcaccaaatgggttcgaagctccagatgtaggcacagagtactgatactggtggtgatacatgtttggcattggcattgccaacgtctgttgatgctgctgaaaatactgctgctgctgtggctggaaatacagctgcgcctggtaatactgctgcgcctggtaatactgctgttggttctgagccatcagtgccaactgcacattagccggtggtgcaaatctgctagacatggtgaacggatcgctggcattggtgcaaaagggttggctgctcctaggctaccggtgtaggtc

SEQ ID NO: 12321 - DNA, 560 bp, Zea mays
  Clone ID: cC-zmpo14820005e05d1
ggcgcatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataggcttctgagggagggcgatcccatgttcaaggaagagttcctggcctactcatccagagggaacatcttgcacatagccaatttcaaggacgactcgagccagtcagcttgggattgctccgcatggattcgcgcctatggatgcttcctggaggaacggctcgagtgcctcagggttctcagatacgacatcgaaaccgagcgtcttgtcagatatccccagacttccagcaaggtacatagtaaaa

SEQ ID NO: 12322 - DNA, 406 bp, Zea mays
  Clone ID: cC-zmpo14820005e06a1
acgaaaacgatccgaaaaaaccggtagtcagaacgggacggtacaggatgggatttttcggtaccgttttcatccctagctcgagccaaggagtccggcggaaggccgccggtgtgcgaaacagcgtcagcgtcgagaggagaaaaagtcaccgcgagtccaggatccatgctgaggcacttggtccggacgggccagctcgccgacgcgaggagcctattcgacgcgatgccgcgccgcgacgaggtcgcctacgcgactcttctctcgggctatgccgcggcagctgactttccgggcgctatggcgctcttctcccgcttccgcgccttctccttccagccacacgacgccgcggatccgttcatcctcagccccgtcctaaggcgtgcgctttcgctgccgc

SEQ ID NO: 12323 - DNA, 407 bp, Zea mays
  Clone ID: cC-zmpo14820005e06d1
gcggcagcggaagcgcacgccttgaggacggggctgaggatgaacggatccgcggcgtcgtgtggctgggaggaggaggcgcggaagcgggagaagagcgccatagcgcccgggaagtcagctgccgcggcatagcccgagagaagagtcgcgtaggcgacctcgtcgcggcgcggcatcgcgtcgaataggctcctcgcgtcggcgagctggcccgtccggaccaagtgcctcagcatggatcctggactcgcggtgactttttctcctctcgacgctgacgctgtttcgcacaccggcggccttccgccggactccttggctcgagctagggatgaaaacggtaccgaaaaatcccatcctgtaccgtcccgttctgactaccggttttttcggatcgttttcgt

SEQ ID NO: 12324 - DNA, 519 bp, Zea mays
  Clone ID: cC-zmpo14820005e07a1
gcttggattaaatttccagtgacagaaacttggattgacgaagtgttcctggttacaaatttgtaaagctggatacgctttcaatgtcattcacatcaacagatcagtagcgcgaggacaagatcattgccttgcccttcaaatttcaccgcctcattccgtcctccatgcctgaaggaagaagcagaagtcagtcccgtcaccctggatggcgttccctccgctgtcctcttggatctccggcggtgcgccgggcttgaagacgaagactgcctgcgtgcccggcccggcgaagagccagtcgtgcacgtcccagatgacctgcaccggctcctcgtcgacgagcagcgtctcattgccccggaacttccactgaaggctcttgacatgcagcagcacggagccgtccaccgtgatccacatcttcgggtccctgctggagcccgcggcggcgagcgcgtactcgatgacgatctcatgctcctttgctcctctggcgttgagccgcgcgcgcgccgc

SEQ ID NO: 12325 - DNA, 398 bp, Zea mays
  unsure at all n locations
  Clone ID: cC-zmpo14820005e08a1
atattactatacggaaaaaaagaggagtacatgcatattatgtattttctgctgggagtaaaaggtgttgtaaaaccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggncgagacgggggcggggcttggagcaggtgactcggacacggtatccttggccaccttacccttacccaccaccactgcttcgacgggcttgcgcgggatcatgttgga

SEQ ID NO: 12326 - DNA, 537 bp, Zea mays
  Clone ID: cC-zmpo14820005e10a1
caaacaaaagaataatttaggctcagcatgatacaacatttcatgactcacataagttttgacaaaataaataattaaaccctcgcctaattcacttacttttaatcaaaaggaaaagatagagagagagacaagaggtaacacctgaatttggtttgcatttaaagaagaaattttataccctaaaattcagggtgttacaccgtcgaacataatatagctgttggatgtttgtcgttttactgttgtgcgttaccaatggatagcaactaatatgcaatgcaaggacgagagaaaaattataactagagagatgggtcagtcgacggagggtctagaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcaggctaatggcctccggggtggaggaggtgccagtgatgttcttgaaagtgacgt

SEQ ID NO: 12327 - DNA, 169 bp, Zea mays
  Clone ID: cC-zmpo14820005e11a1
caaacttggttctgttcattttaaaaatgaaatccgtacgatttccaaattttttttgccattcgaaagcattcgctctgcatgcactccaacccccagaacttttttacagcaaaaggtttcagttcaacggaggatccatccagaatttgggcgttgcagatcgacg

SEQ ID NO: 12328 - DNA, 485 bp, Zea mays
  Clone ID: cC-zmpo14820005e12a1
gagaggaattatataagaaccagttcattacttcattttataggaaaaatacagaaacgggaaaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaagcgtcatcggctcgtcgtagatgccaaccacgagtgcctgccctgtcttcttcacggtgatgcctcctgatcccttcttgccacggatgacggcaccaggc

SEQ ID NO: 12329 - DNA, 517 bp, Zea mays
  Clone ID: cC-zmpo14820005f01a1
ctcattgaaacgtgaccacaaatcaacattaacattatggaatgggattacagatatacactagcataatgaataagttccaagattgtgaggcgtcggtctaataataatacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcagttgagcgtgatggcctccggcgtgttggaagtgccgtggatgttcttgaagacgacgtcgttgacggccaccttggaggcgccggactcgacgcagatgttgttggggcagtac

SEQ ID NO: 12330 - DNA, 646 bp, Zea mays
  Clone ID: cC-zmpo14820005f01d1
cggacgcgtggcggacgcgtgggtgccatcctctccatcacgaagatggcgttcatcagcaatgtcgcagtgaaggcggcgggcgtggccgcgctgcttgtggtcgcagtggtgtcgcctgccgcgcgcgcggcggcggtggcggtggcgggaggggcgccgtcggttccggcgggtccgctggacatcgcgcagctgggcgccaagggcgacggcaagtcggacagcaccccgatgatcctcaaggcgtggaagaacgcgtgcgaggcgacggtggtacagaagatcgtcatcccgccgggcaactacctgacgggcgggctggagctgaagggcccctgcaagtccttcatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcacgaaccagtgccaggattcttacaattgctagatccttccaatagcttggtgctggatttgtgacgaacgtccagatccgcggcatcacgctgctcaacagcaagttcttccacctcaacaatctcgagtgcaagaacgtgctgatcgac

SEQ ID NO: 12331 - DNA, 345 bp, Zea mays
  Clone ID: cC-zmpo14820005f02a1
agagagcattagtatcaattaatcaaatcgtttcagttatataacggttgaccccataaagttacaagagcaaacgaagtgagcaaagcaaagcaacacttgcgttattggtcccttccgaccagacgagcaattaccggacagccaactacgtgcccaccctcgacgacacggtccctggtgaactcagtagaagatcatggtagcgacagcagcggcgacaccagcgatggcagctccgcttccaagggtagcagcaccggaggcattagcagccgccggtccctcagcaggcccatcagcggcaggggacgccaccttggcggtggatgccgacggggaagg

SEQ ID NO: 12332 - DNA, 371 bp, Zea mays
  Clone ID: cC-zmpo14820005f02d1
ccttccccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagggaccgtgtcgtcgagggtgggcacgtagttggctgtgcggtaattgctcgtctggtcgggagggaccaataacgcacgtgctgctttgctttgctcacttcgtctgctcttgtaactttatgggggcaaccgttatataactgaaacgattcgattaattgatactaatgctctctaaaaaaaaaaacattgcgcggacaaa

SEQ ID NO: 12333 - DNA, 538 bp, Zea mays
  Clone ID: cC-zmpo14820005f03a1
agggggggagattttgatggttacatactgcagtgtacaattttcgtccaaatagttcgacagttttacaggcacgcacttactgccaggaaaaaatctctagcatgatttcatgaatcaacagcacgggcagctacatcacagagcttaatggatgaaaggggaaagaagaaagaaaaaaggaccatactgtaacaacaacaccagccccagtcgtcattctacggcagcgttcccgtcgaggcggccagcgaccttggccttgggcacgccggtgagctggccctcggcttcgatcttgcgcacgacgtccatccctttcaccaccttgccgaacaccacgtggcgcccgtccagcttcttgggcaaccggttttcgtctacggtggtgatgaagaactgggagccattggagtcgggcccgtagttagccatggacagcgtaccggctttagcgtgggtgtgcttgaagttctcgtcggagaagatggtgctgccgtagatggacttcgcccccgtgccgttgccgttggtgaag

SEQ ID NO: 12334 - DNA, 584 bp, Zea mays
  Clone ID: cC-zmpo14820005f03d1
cgaagagagagagagagacgcaggaccgccggcgacgatcgaggagggaggaaccagatacccggcggcggcgatcgatggctccgcgcagctcatcggcggcgacgtgcctgtgcctcgctctcgccgcggccacgctggcgctggcccacggggcgcaaggaggaggaccatcggcatcggcggcggacctggacaaggtcacggccgagaccttcttggacatcgagatcgacggcaagcctgcaggccggatcgtgctgggactgtttggggacaccgttcctaaaacagcagagaacttccgagcactttgcacaggggagaaaggaattgccaagtccggcaagcctctgtggtacaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtacgctgttcatggctaactacgggcccgacttcaatggctcccagttcttcatcaccaccgtagacgaaaaccgg

SEQ ID NO: 12335 - DNA, 407 bp, Zea mays
  Clone ID: cC-zmpo14820005f04a1
aatagtaactgccagcatgcctttttattattatccattcaatcgatgaaaaacccacatttgcgtgacattacatttggaggtccatcgacgggatatatttttgaacaaaaacatttagcttaaaaaatgccagattaataggaatacaatatatagttccgtccatatcagatgggtatcgcatgcgtggccagccggtgacgacgtacgtatagactcgctcagggcctgagctgaacgccacgttaccccggggcatgcatacatgcatgcatgcatgcatggttcattcatttcaaggggcttcgcttcaaaaaggaggaggggtgcaagaccttttgcagttttcgctgaggcgcgggttcttttccttggcgcaggtgacccttcaggccttggggacc

SEQ ID NO: 12336 - DNA, 659 bp, Zea mays
  Clone ID: cC-zmpo14820005f04d1
cgacccacgcgtgcgtcaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgcatgtatgcatgcgccggtgtgacgtggcgttcagctcatgcgctgagcgagtctatacgtacgtcgttacccgctggccacgcatgcgataaccaatcgatatggaccgaactatatat

SEQ ID NO: 12337 - DNA, 521 bp, Zea mays
  Clone ID: cC-zmpo14820005f05a1
aaaaataaaaataaaatggctttaataccgagatctatagttacaaatcgggagtagtagctttatatgctactatcgatatacaaaccgagagcacagtacatatggtcacactactacaggtgcacgcatgtattgccgcttataaatgtgggaaaaaaaagataacccgtttctctagcaatggaaagaagaaatgacaaaaacacggcacacacacagagaaggatggttttttttcactgatggtcgtctgatggaaacacttgttccgtagtgtatacgtgtggacgtgtggttaatttcatgcaggagctctcccttaaaccttaatcactgcagcagcagcagcagccgccgagaaggtcttctccatgactttgagcttctcgggaggcggggccgcagcgaccgcgtcggccgcctggccgtatgcagcaaggattttgcgatcttgtccttgtccccctccgcgtaggccttggtgatgttggcgtcggtggcgagcctcagcttgagca

SEQ ID NO: 12338 - DNA, 466 bp, Zea mays
  Clone ID: cC-zmpo14820005f05d1
cgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgccttcggggacacgcccaagaagcagctggggatcacggacgccgtgctcaagctg

SEQ ID NO: 12339 - DNA, 317 bp, Zea mays
  Clone ID: cC-zmpo14820005f06a1
aacacctgaatttggtttgcatttaaagaagaaattttataccctaaaattcagggtgttacaccgtcgaacataatatagctgttggatgtttgtcgttttactgttgtgcgttaccaatggatagcaactaatatgcaatgcaaggacgagagaaaaattataactagagagatgggtcagtcgacggagggtctagaagcatgcaagctccttgaggcaacccttggtgctgcccttggcgttcgtgcatatagccatggtcttgttgttggtgccgctatactcgacgttgacgtcatccatggtgacgccgg

SEQ ID NO: 12340 - DNA, 317 bp, Zea mays
  Clone ID: cC-zmpo14820005f06d1
ccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcatattagttgctatccattggtaacgcacaacagtaaaacgacaaacatccaacagctatattatgttcgacggtgtaacaccctgaattttagggtataaaatttcttctttaaatgcaaaccaaattcaggtgtt

SEQ ID NO: 12341 - DNA, 481 bp, Zea mays
  Clone ID: cC-zmpo14820005f07a1
attgacagcaaataactgaatgtggatcgtagggtcattttttctagcacacattgaacaaaaccctagagtagctcctctatggttctgccttctatacacacatatgtataaatgctgaaaaatgacgtcaggtaccaactgtccgtctatggattgtccctccttggcttgcaaaaactaaagggttgcaacataagggtcctggattatttctctcttggtaactactgaagcatgatgaaaatcactacacatatatgcgtggagatagctaggggacaacagaaggtccatgaatcctcaataccttgtgtacttttaatgccagtctctacaccaccatggctgatggatcacactatcgagtcagcgatggtggactggttctcaggcgcagctgcccctggtcttggcttctgatcctcgccaacgtgcctaggggacgatacggcagacgaggaggacgacgacggcgacg

SEQ ID NO: 12342 - DNA, 590 bp, Zea mays
  Clone ID: cC-zmpo14820005f08a1
ggcggaggccatcggcgggggcggggaccccgaggccgcggcgaggcggcgctgggatctgcccggcaaggtggccgggaacattgcaatggggaaaattgatatgtctactgacgaagaatcagattgtgtagctatatgtccacctaacagaaatgctggtcacgaggaagttgtgagtggcagccatgatgaagattcttcaggaaagcaagagaacccttatgctgtgaactcacatatggacagcaatggccaggaagatgtgtctgtaaacctagacctgctcaagctgattcatcagcaggaatcttctgtcagcaattcaccaacaaagcctgcagtagctagacagcaagggtctggccatactgtccttgagccatgcgctgttgcacctgaaagaagatcatctggagcaaggaatattgctcgaattcctcatcccaccagcagcggggaaaaactttcggataaaagtagctcctcaccaagaagcatggcaaagaagagttcattattcacacccaggaagccttttcaatcttgacacacttctcacaagtcagatgatgactcatattctggca

SEQ ID NO: 12343 - DNA, 522 bp, Zea mays
  Clone ID: cC-zmpo14820005f09a1
gatgagtgacaccgatacattgcggtaagcgcgtactgtactaggttcgatgcaaggatagcaaatcgcgcagaatatcaatatgtatctcgtgcagaaagttgatttatgcagagcatcattttcgttttctatttttttatgttcagaaaaaacatttcccttcgaatgctctgaacaaaaccatcgaggtcagctttacgatcaccgggtgcaggtcgactgcatgaacctgacctccatgttcttgaggtcgaattcccagaggtgctcttgctgcatgatgttgccgatgaccgacacgccgggccactcgccctcctgcaagccgatgcacttcacgcccggtttcacgtcgatcacgtagctcttcgccggtggctccagccgcgcgcacccggtgaactgcaccgtcagctttgggatctccggcgctcccggtcgcggtgccgtccagttgtagcagtgctcgaacggggggaagtccactttggggaccccggccggagcttggtcagcgcg

SEQ ID NO: 12344 - DNA, 229 bp, Zea mays
  Clone ID: cC-zmpo14820005f10a1
atgtaataaaaaaataaaaaaaaaaaaaaaaaaaccatccacaaaaataaaaaacaccggaacaagggaaaaaccaaaaaaaaagaaccaacccaaacccgaccaaaaacaaaaaaaaaccccaaaaaaaaagaaacccaaaaaaaaaaaaacccccccgggcccaaaaaaaagagaaaaaaaaagaaagagggggaagacccactaaaaaaacccggaccccccgaaa

SEQ ID NO: 12345 - DNA, 498 bp, Zea mays
  Clone ID: cC-zmpo14820005f12a1
gtaaaaaccagcattaccagtgtacgactgtacaacgctcatttacaaggacaattacagttcacaatttatacacacacatcatacaaaatcgctatcatacacaggcgttgaggtgtacacgcgcaacgctcccgtgccaacagccaggctcacgcgaaaaaaagcccttccacgatgaccgaaaaacaaagcacatccaaatccatccccaaaaagggcaaccgcgacatgcgaaacctctcaaaaacgaccatccggacgttggacgcaggacacctctcttcttttcatcgccgtcttcttcacgagaagccgatagtcttaccgagcagccacaggaacagagtccactcgagcataaatatcgtgtgcaggtacgaacggtccagcgtgaaaccgaacacggtgatcccagctctgttgttttccaagtatgtcactagtgcctgtctcttctggaaggagatgacatgcgcgtgcggcatatgaatcttg

SEQ ID NO: 12346 - DNA, 162 bp, Zea mays
  Clone ID: cC-zmpo14820005g01a1
aagcaaatcaacaggaaaaaatgtttcacagtgctgatcattgtgcttctattggtgaaaggaacaggagttccatgcccaacaatttctgctacaagaagaaaactggcaaaagatgatcacaaagagccctacagcctgatgctcagtcgagcaaggtcc

SEQ ID NO: 12347 - DNA, 162 bp, Zea mays
  Clone ID: cC-zmpo14820005g01d1
ggaccttgctcgactgagcatcaggctgtagggctctttgtgatcatcttttgccagttttcttcttgtagcagaaattgttgggcatggaactcctgttcctttcaccaatagaagcacaatgatcagcactgtgaaacattttttcctgttgatttgctt

SEQ ID NO: 12348 - DNA, 294 bp, Zea mays
  Clone ID: cC-zmpo14820005g02a1
aggacaaccaatttgtcgtgaatttgagctaaaaaatgtaatttacatttgatctctctctctgctctaccgctacagcagcaggcacaagacgcagactgcttaggggtcacaaggcttacagttacatccccacgaacaaataggaagcggtctgtgcccggtacgcctgacaaataagtgttacacccttgtccaactacaggcttgttcggttagctctcaatccatgtgaattgaatgagattggatgtgtttgaatcgcaaacaagttaaacttcttcttaatttttt

SEQ ID NO: 12349 - DNA, 307 bp, Zea mays
  Clone ID: cC-zmpo14820005g02d1
aaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgacccctaagcagtctgcgtcttgtgcctgctgctgtagcggtagagcagagagagagatcaaatgtaaattacattttttagctcaaattcacgacaaattggttgtcctaaaaaaaaaaata

SEQ ID NO: 12350 - DNA, 460 bp, Zea mays
  Clone ID: cC-zmpo14820005g03a1
ggcagaaacaattccttctccatttgcatgtttctcttctcggtcatcatgttacatgtgcacacactcgttacattacctatgctgttatacccttacgcacaaacgtacatgcgcttatctgatagcattcaattcaggtcgctagagcattgcatggtgcgatcgacttgtcactgcttctcctggcctccctcatcgcgattactctcatcgtcagtagagcgcgctgtgatcaccgcttagtatccttggaactgaggcggcggtggcgacgcatactgctgcgccatgattggtggcaagatgaactcctcaggtgccggcggtggaggtgatgatggtgcgggcggaggtggtgatgagatgggttgcgtcagagtggccagctcactggagcatggggtggtggggatttgaccggtggtggtggacagtttatttggcgcccgttgatgat

SEQ ID NO: 12351 - DNA, 547 bp, Zea mays
  Clone ID: cC-zmpo14820005g03d1
ccggttttgctgggctcgacccacgtcgtccggaagctccccgccaccagccgattacgttcaccatccgccaccaatgaaagtctccacgccccactcagctacctattacgctcgcgcttccccacctaccaaatgtccctcctccaccggtttcggttagctcaccaccactagtaaaatcacctccatctccagcatatgtgagtgaaccgccttcaacggtgaaatctccttcaccaccatcacctccaccgatgattaaatcaccgccaccaccggtgccggtgaggccacctccatcgacagcgaaatcaccgccttcttcaccactgttaagttcgccgacggcaccagcgcccgtgaggtcaccttcaccgctaacgaaatgatcagcttctccaccaccgataaggtcgccacccccaccacaagcaaactcacctgcttcatcagctccaataagctcacctccttctgcgatgcaatcccctacaccgactgctccagtcagctgaccaccaccacctatgaaatgaccaccacc

SEQ ID NO: 12352 - DNA, 553 bp, Zea mays
  unsure at all n locations
  Clone ID: cC-zmpo14820005g04a1
gaataagttccaagattgtgaggcgtcggtctaataataattacatcggttggttttgtgatgatccaaagaagaaagaaaatacaaaccagcggattatatattcggtggagacttgagagtacgtgagaaagagagaggttacgaagagtgattatatatataatatatgcatgttagtcaattggttcagatgcaggcgagctcctttgccaagccgatggacttgccgatggcgttcttgcagacggccatggtcttgttgccggatccattgtacttgatgtcgacgttgacgagctgcacgccctggcatggcaggttgttggcgcagttgagcgtgatggcctccggcgtgttggaggtgccgtggatgttcttgaagacgacgtcgttgacggccaccttggaggcgccggacttgacgcagatgttgttggggcagtacttctggtcgatgatgatggngtaggagacattgtccatggtgatgccctcgtacaggaacttgctggccttgagcgacgacttggagtcctcgtacgacttgatg

SEQ ID NO: 12353 - DNA, 638 bp, Zea mays
  Clone ID: cC-zmpo14820005g04d1
cgaatctgccatcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatgcgtctcgacggcaacctgctcggcaccggcgacctcagcgcgtaccaaaggaactggatcgagatcgagaacgttgagaacctgtccatcaacggccacggcaccatcgacggtcagggagccctgctgtggagcatgaaccagtgccagcattcttacaattgccagatcctcccgaatagctaggtgctggattttgtgacaaacgttcagatccgcggtatcacgctgctcaacagcaagttcttccaccttaacatcttcgagtgccagaccgtgctgatcgacaaagtga

SEQ ID NO: 12354 - DNA, 351 bp, Zea mays
  Clone ID: cC-zmpo14820005g05a1
gaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcaagcgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgc

SEQ ID NO: 12355 - DNA, 370 bp, Zea mays
  Clone ID: cC-zmpo14820005g05d1
gcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgcttgccatgcatcgacaacctattcttaataacgttcattatctcgttcttatttatgacgaatgtcatgtatgttctggcgactgtcatgtatattctgatgactgtcatgtatcttgctcatgtatgctcaaggttcattatcttgctcatgtattaagtatgttatgaataactcaatatttattattttgttcaaaaaaaaaaaaaaatgac

SEQ ID NO: 12356 - DNA, 372 bp, Zea mays
  Clone ID: cC-zmpo14820005g06a1
ggggaggcaaaacccctggaaaacgggttaaaatccccaaaaaacaacgggccaaaccccaaaaatttgggattttgaaccttccggccaaaaaaaaaaccttccccaaaaaaaggccggttttaaaccggcccagggcccccccgaaccacccgttaactttccgccggtttccaaaaacccccccccggcgggaaacccccggtgacccgggaattactttggccacttccacggggggccccaacggggccaaagcgggccctgaacccggggcccagggtccttaaccgggtgagccccggcaataccacgggtgcaagggccggccgggcccttcggcgaatttccgggcccttgagcccgagcttt

SEQ ID NO: 12357 - DNA, 533 bp, Zea mays
  Clone ID: cC-zmpo14820005g07a1
gccacgtaaattttatatatcatggtgatgtttgtcgttcagtatctatgtttcattcaaattttttatccccgtcgcaacatatagagacataactagtgatcacaataatattggtccgacgtatattatatgtgccggaaggcctctatatataggagtccaactctatttagcaggaagatcagacaagagatgtcccgctaaacaacttggctgaaacacaatcgaatttggaaaagcgaatgaagcggaaattaaaaagaactagtgagctagatcatcatcaaggatgagataccatgcatgcatgcaaaaggaaggtcatcatcagaccaggcaagccagtgcctcgatgcttcccttggcggtgcccttggcgttgctgcagacggccatggttttgttgttcttgccggcgtactccacgttgacatcgatgagggagacgccgctgcatggctgcgtctccgagcagagcaggctgatggcctcgggcgtggacgacgtgccggtgatgttgcggaacgtga

SEQ ID NO: 12358 - DNA, 544 bp, Zea mays
  Clone ID: cC-zmpo14820005g08a1
ggagaaacgtaaacaactaaacatgtaagtaaatcagagttgcatacattttttcggtcctcgtaccacgatcatacacaagcacatgcatacacacacgtatacatacgatagattacgtagccacgcttattcgtgcatcacacgagcgcatacatacgtacgcgcgcacaacacggcgggcgctcgatatcactctcacacacgcacgcgtagcacacggggagggacgacgatacgggagggatcaatcagccgaagaagtggtgcttcttctcgccgccggcctcctcggcgtccttgtggtccttcttcttctcgtggtgctcgtggaaggcgaagccgccggagccgacggccgccgtcgacgcgacctcctcctcgatcttgtggcggtgcgcgtgctccgggtccttctttgcctcgtgcttctcgtagagtgcgaaggcgccggcggcgatggcgccggcctcgccgaggtgctgcttgtgcttatgctgcttctcctgcttgtactcgtcgtactcggtctcgcccgtggaca

SEQ ID NO: 12359 - DNA, 378 bp, Zea mays
  Clone ID: cC-zmpo14820005g09a1
atgggtcctgtgtttttcttggttccttcccggtttgctcctgctccttcctttggtcattgggtccgtccgacgggccccggctgcggggcgggtgccccgctggggggggcccccggggagacgcaaggggggggcccctggacggcgttcttcggccgcccgagaccacacgcgcgggccccccgggggccggggggagccggccccgggggggcccccgggggcggcggggggggggcgcaccccgggggggggcgccgggcaggggcccgcgctcttggggggcccccaggggcgcttcgcaggggcgcggcggggaccccaaggggggcttggacctgtcggggggcttggccccccccggcgcgggggccc

SEQ ID NO: 12360 - DNA, 168 bp, Zea mays
  Clone ID: cC-zmpo14820005g10a1
gggagtcgccttggccgggctctcctcggtttccggttcgctgctgaccgcggccgacccgtcgggcgagagtactacgacctcctcttctaacacgccgtagtcctcggagagcggggcggcggctgtttcggaggatgggctctcggcctcggcctcggcctcggc

SEQ ID NO: 12361 - DNA, 524 bp, Zea mays
  Clone ID: cC-zmpo14820005g11a1
gtccttctaatttctttcgaatttaacttggatcgaacacacctgtatcctgtcgttctaccctgtatgttgtaacacacggctcgtaggacgtacgttttgatcagctgcacatacatatacacattataatcacacacatgcacacacaccgggtctaggcataacgattactcttcctcgccagacaagcccaagctcaccggcgtgccagtctccggtatccagtccgcgccgtgcaagaagtgccccaccgtgaactgcagcgccctgtccttgcccatcacgtggaacccctgcatctccttccgcccggtgacgttggcgccgtcgccgccgttcctgaactctccgaagaaggccgtgcccaggttgtccttgccctcccagggcatgtacccctggcggtgcacgaatccgtcaatgacggactccatcaccaccgtcctcgcgaactccttccacggccggcccaagtacgtattgaccggcgcggacccggacttgttgctgttgctgctgct

SEQ ID NO: 12362 - DNA, 587 bp, Zea mays
  Clone ID: cC-zmpo14820005g12a1
gaggccgaaccagcaacgcttaaaaggatggtttaaggacgtgctaccaggttccaagtctacttcctctcaggaaggcaccaagtgctgcaacaagctagccaaaatggttgcagcgtgccacccagcacaactgcaacgatgcttaaaaatcctacaaagttcttcctgaggctggaaccaagtgacgcaacaagttcatgggttcataacccccgaccatacacccaaaacggtaaaaaccaagggacacattccctgctgctcagcagaagaacatggagctcctcactttctcatgcagacggggcagctcctggacagggacgctgcccgccgaggtatgccccccatggctagatgaagtctccgacatctcgtcgaactttatgaactgcccaacctgggcggctgcaaggtgggcgtagcagatgggagcaacaactgatatggctgttgtgctcctttggtacacgtaagagagcgagtgcaccagctcctgcaggtcatcaggattgaagcctatctcgtcatgcaggatgtgatagtgagttggcctggtagtcccaatcattccagcatgtgaa

SEQ ID NO: 12363 - DNA, 529 bp, Zea mays
  Clone ID: cC-zmpo14820005h01a1
agtagtaactgccagcatgcctttttattattacccattcaatcgatgaaaaacacacatttgcgtgacattacatttggagttccatcgacggtatatttggaaaaaaacaattagcttagaaaatgccagattaataggaatacaatatataggtccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaggaggaggggtgcaggacctcttgcagttctcgctgaggcgcgggttcttctccttggcgcaggtgacgctgcaagccttggtgacctcggccgccttcaccacgtacgccttgtcgcacttctcctggcagaccttcatggccggcgccgtgatgccctattgctcggtgcacttgcccttgcactggatactgccgtacagcaccaggttggact

SEQ ID NO: 12364 - DNA, 640 bp, Zea mays
  Clone ID: cC-zmpo14820005h01d1
accaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgccttagcgagaactgcaagaggtcctgcacccctccttcttcttgaagcgaagccccttgaaatgaatgaaccatgcatgcatgcatgtatgcatgcgccggggtgacgtggcgttcagctcaggcgctgagcgagtctatacgtacgtcgtcaccggctgggcacgcatgcgataaccatctgatatggacggaactatata

SEQ ID NO: 12365 - DNA, 404 bp, Zea mays
  Clone ID: cC-zmpo14820005h03a1
cctgtatgtttaccatttttaaataaaaaaagtcatataaaaaaagatttaaaaatggggatacctggttttggttcgaacccaaaaaaaaattacgggggggaagccatgctacttggggggggggtgaaaccacgtgttgccgaggacctagggggggcccacaaaagggttggcccgggccccggggagggccaaaggccaccccaacctttttttttttttggggaaaaccccgggggcaaaacactttaaccccccccaaaaaaacccgcttttttccgggttggaaaacttccagccgtcccaacccaaggggaccaactttttcccaaatttggggatccaattgaccaccccgggggagtccccccaagggcgggccaaaaaaatttggcccccct

SEQ ID NO: 12366 - DNA, 381 bp, Zea mays
  Clone ID: cC-zmpo14820005h04a1
aaaattgtatcagtgcactttcatgtttgaacaggcaatacacggtgaataaattaccatcatatgctcatttaatcactctggcctcaatttaacaagagaaattcggacgcaaatgtgaccgccatcgtgtcgtccagtagatcggctgagacgaggacgaccaaccaaccaaccatttacactcatcagtggccatggccgaggatcatgaggtggggttggaactgcggcagctcgtcctcgtcaccgtcgccgtcgaggtcgatgccgccgccccgcagcaccaccctcacgccctcgggctcgcacgacttgtccgtggccgggttgcacccgtaggtggagccgcctggagtcggggacgccttggcagcagcg

SEQ ID NO: 12367 - DNA, 559 bp, Zea mays
  Clone ID: cC-zmpo14820005h04d1
gccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccaaccccacctcatgatcctcggccatggccactgatgagtgtaaatggttggttggttggtcgtcctcgtctcagccgatctactggacgacacgatggcggtcacatttgcgtccgaatttctcttgttaaattgaggccagagtgattaaatgagcatatgatggtaatttattcaccgtgtattgcctgttcaaacatgaaagtgcactgatacaatttt

SEQ ID NO: 12368 - DNA, 422 bp, Zea mays
  Clone ID: cC-zmpo14820005h05a1
agacatgaaacaaatgatgcgacagtttcatcatgaagatttgcaggttcagttacccgatggaactagtgttcctcggtagagatgagcaaaaggttaaagcaaggcgaaacaccatggctgaaataattaatgccttccatcgtgtctcggcgctcccatcatcctggatcacttgagctgctgcacgatccgttctcctttcgagtcagcacagcagcacagcgagcttcgattcagcagccacagaaggcccactttttccgtttgggcggcgtgtactggttgccgtcgccgaagtcgggcctgtacccgccgtcgccgccgccgttcctgaaggccggcggaatgcctgcgcgcgcgttcccagccccagggccggtggtggtcttcttgtcgtcgcgggccttctggaatatgac

SEQ ID NO: 12369 - DNA, 611 bp, Zea mays
  Clone ID: cC-zmpo14820005h05d1
gcttctcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgacatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgtccaaacggaagaagtgggccttctgtggctgctgaatcgaagctcgctgcgctgctgcgctgactcgaaaggagaacggatcgtgcagcagctcaagtgatccaggatgatgggagcgccgagacacgatggaaggcattaattatttcagccatggcgtttcgccttgctttaaccttttgctcatctctaccgaggaacactagctgcatcgggtaactgaacctgcaaatcttcatgatgaaactgtcgcatcatttggttcatgtct

SEQ ID NO: 12370 - DNA, 107 bp, Zea mays
  Clone ID: cC-zmpo14820005h06a1
aaaaaaggccgaaaccgtgaggctggattaacaagagaaacggtaatggtacagtaattcatgaagtgaaggattttacatcaccaccagctggtgctgaaccttcc

SEQ ID NO: 12371 - DNA, 522 bp, Zea mays
  Clone ID: cC-zmpo14820005h07a1
gtcggatgtctgtcgttttactgttgtgcgttaccaatggatagcatgtaatgggcaatgcaaggacgagagaaaaattataactagagagatgggtcagtcgacggagggtctagaagcatgcaagctccttgaggcaacccttggtgctgcccttggcgttcgtgcatatagccatggtcttgttgttggtgccgctatactcgacgttgacgtcatccatggtgacgccggtgcatgggaccttggcagtgcagagcaggctaacggcctccggggtggaggaggtgccggtgatgttcttgaaggtgacgtccttgacggtgaccttggaggcgccgttggcagtacacaacttgttggggcagtacttcatgtcgatgaagatggggttggctgagtcctccatcttgatattctcgtaatggatcttggagacggtgaacacggaggcggcgtcctcgtacgccttgatgcggacgccgaacatcgtcttcttaagagtgcaatccttgacgttga

SEQ ID NO: 12372 - DNA, 372 bp, Zea mays
  Clone ID: cC-zmpo14820005h08a1
aaaataaaattgggatcataataatattagcatcgagatacgatgacaggacaaacccttcgacaattcacacgaccacgaaacgaacgaacaaacaaacaattaaccaatttgacaccacgttactgaccaaaacaattaattaatcggatgaaccaaacacgatgcatcccaacgttgccgacccgcgcgtcgtcgctcagtggaggcagtaggcgaggaaggaggctacgagcgccccggcggcgggcacggcggcagcggtggcgccgattgcgctagggccagccgcaccaccggtcgcgccggcgggcgccttggagggcgccttggatgcgaacgatgtcagcacggcggtggcctaagcggcag

SEQ ID NO: 12373 - DNA, 315 bp, Zea mays
  Clone ID: cC-zmpo14820005h09a1
gtacaacaaccgttgagggacccggcttgaaaatcaggctgaccccacattggaccttaaaaggggaacacatgaacccccctggctggccctgaccccattaaagggggggaaaaaggggtccaaaccgacattcccaaaaggggggaaaaagccaatggttcggtaccctaacccgggggggtgcacaaggggggatcctaacccctggaaatggaactaaaactcccgggtttccaaggttcagaaccggaagaacaaggccggggcaaacttgggggttcctcaaaaaaaaggggtttttgggggaaagga

SEQ ID NO: 12374 - DNA, 452 bp, Zea mays
  Clone ID: cC-zmpo14820005h10a1
aggtaaaatttgcaaaattggcttcgaaaaggccccggccacccggggggaccgggacccccgacttaccgggccgctggtcccaccgggccctggttaaaggggtttcccgggggtaagaaaaccctgggcccgggggggcaaaaaacggggcccgggtacctgccaaggccccccggcgatgcaagacaaacaggttttggcgttccgggggatgcctggggaacgccccagggggtgcccgttttcccttttaaaaagctcgcgccctgacaaaggccaaggccaattccctgggggccggggcccggaagtcccggtggatgccccccaaattccttttgaaccgggccctggggctcgggtaccggattttggccctgacccctcaggggtcccgggaccccgagaataaccaaaatttggcctcttgggaatttccggcggggggg

SEQ ID NO: 12375 - DNA, 488 bp, Zea mays
  Clone ID: cC-zmpo14820005h11a1
cgcaaaagaattgcatgtcccaaaaaggggtgtccaaagggaaccaatggggttactcgacaagtccagttttaaaaggaccctagggcctttattaattcccatcccttttttttggggggggaggttttcacccctggcaacaaattgggcatggaaaggacctggaccaatgtttgccttggggggggccccaaaatttaaaccccaaaatttaaattcaacaccattgcctgttaaaaggcttgcaatcccaaacataggagcttatttgaaaaaccctcagggaataaataaaagggacccgaagggggccccaaagcttaaaagcccttccgaggaacaatcccagggcctgacttggaaaactcagcctttgagacccacatttgtgggaaggggctcaggggggcaaggatggatccccctatccaaaccctggatttcctctaagggggggccaccaccttgattttaaagccgtttgg

SEQ ID NO: 12376 - DNA, 379 bp, Zea mays
  Clone ID: cC-zmpo14820005h12a1
aaataaatataaagggttgtttgacaactttattttctcaagggaaaccttttttttcaagagaaaatgaattaaattcccttgaaaaaataaaaccctttaaaaaaaataagggggggaaactagccctattaaaaaatttatgccaaatgcaacatcgggttccaccattttcctttttacaaaaaactactggtccgggttttcggggaaactccctttcacggggttgtaaaaaaaccggggttaattagcccccggtgcatgcatgcctacggggttgggctggcccacatgatcataacaattaattaattaattaaggggaaaaccccaaacggggaggatccatgcgtcccccccgccccaatatgtttta

SEQ ID NO: 12377 - DNA, 291 bp, Zea mays
  Clone ID: cC-zmpo14820006a04a1
ggggggaaaataatggggaacacccaagggtagtttgttacatgggggggcccgcccaaaatgtttttccccccctatgccaaactgggaaaaattcaaaggtcccctcctttgttgttcccagtttcccccccttgacattaggccttatcagccaatttttttaattggcccccctccccggccagggcatcaactttgttgggccagttttttctttccggccccctgggggtttttttttccccccaccccctgtggggtctcgggggggggggcgaccttttcctt

SEQ ID NO: 12378 - DNA, 331 bp, Zea mays
  Clone ID: cC-zmpo14820006a05a1
ggcggcattgcgggtgaaaaactgcatttcaggcaaaaaaaccccttgaatgggggtggtacctcccgcctacgggggggcccctttccaaaaagaagatttaagagagcagaccgaccgctttggaggggtcctccctttcccgggggtagcttccccctacgggcataatttatgcttcgtttcggcgcctgccctgatcatttcggccttatgaggaccgctatccttggctggaggatcccccttggggttactctctcgacccgggggtggggccttttggtcgggtcccgggccttggggaggggtgtattgcggatcggggagg

SEQ ID NO: 12379 - DNA, 540 bp, Zea mays
  Clone ID: cC-zmpo14820006a06a1
agcactgcaagacgcgttagtatttctcatagacagaactgtacatacaccaagatttttggattttttaactcccccgtatcaaaaaaaaaagctcgctctctaactgactcatccgggccaccggccacaccgatcaccggaccgcccgctagctgtccgccgtttcccatgaaccacccaccgttgtcgagtccccgctgatctgggcaccactctctccacttccaccgttggccctggcggtgatgtcgagcatctgctcaaaggtgcccgcgtcgatggccttctcgacgtgatgcgtgagccccatgggtggccgcgcggtgaccacctgcagcaggagcacgccgagggagtagatgtccgacttgacgcccagcttgcccgtctgctggtactccgggtcgatgtagcagaaggtgcccgccgtcgccgtcagccggtactgcgtcacgttgtccgccaccgacggcggcaccaggcgtgccagcccgacgtcgctgatcttgctcacgtagttgcggtccagcaggatgt

SEQ ID NO: 12380 - DNA, 498 bp, Zea mays
  Clone ID: cC-zmpo14820006a07a1
aatgtagatcttcccagctccactgaatatattagcgaccgagcaatcagtacatacagacgaataataagcatacatatgtccctggcctggactgatcaactccgacccaattgtgaatcaaaactctacgttggcctggtaggttgcggactttatgttgggtttcttcttgggcgagatgctatcgaggacgagcgcgcagtgcacgttgactttaatctggcggaggtcgacggagccgagctgcagctccacggggacgctgacgaagatgtcgagcgggatgtccccggccttctcgctctcctctagcgcctgctggagccccgacccgaagccgtggcggccctccatggagatgtccatgacggtgacgttcttgtagccctggaagaaggccgggagcttcccggagcacagcggcgtgccgcggtaggagaccacggtgtgggagccctcgccgtacctgatggtgatcatctcgttggggttctc

SEQ ID NO: 12381 - DNA, 477 bp, Zea mays
  unsure at all n locations
  Clone ID: cC-zmpo14820006a08a1
atataagaaccagttcattacttcattttataggaaaattacagaaacgggaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaggcgtcatcggctcgtcgtagatgccaaccacgagtgcctgccctgtctttttcacggtgatgcctnctgatcccttcttgccacggatgacggcaccaggcttcg

SEQ ID NO: 12382 - DNA, 496 bp, Zea mays
  Clone ID: cC-zmpo14820006a09a1
acattagcctcgcgaaaataaggccttcactatcttaatcttttataatgtcaccttgtacatagtgctctcggaagaagaaaaggtgttgctaagataacaaagaattgctgcaatttctctctatttcattttactgcaccatgcctcccccctctaaaaagaatatttcgaaaacccacacagagcatgaagaatgacgaagttgcaaagcccttccaactaaaatacggacacagaccagcaactgacaagtgaatcaacagaccaggcaaaatcgcggagtcctttcagacgtataccccaaaccaaaggggtaactggaaagccaggactcttccaacagaaggagattgtcattggtatgacaagttcacatgtattttcctgggaccacgctgcttgcagcaggaaccatgatgggatgaatggcctggaacggctgcacaagtggtgcagggcttggtaccaccaatggcaggttcccagttgccat

SEQ ID NO: 12383 - DNA, 401 bp, Zea mays
  unsure at all n locations
  Clone ID: cC-zmpo14820006a09d1
ctaaagcggacgcccctaggttcattgtatttactcttgtctcctgcaaactatgccatttcacctcaatatgttcagtcaatcgtggggcataatacatccagactagacccagctagaggaggcacaccataccatcccatgcaggagggggcaacctacactacccctagtcctcagcctgcaaagacagggaagnncagtcctgttgnttatgtgcacccagttcctctggagccattgcatggaacaccctcagaggttcaaggatggcctcgccctgagcttttgaatccacatcaagctagcatgcagaagttccaaggcatcaccccggtgtatttggcccctccaatcataggaactgagaccctgccattggaggcaccaagccctgcacc

SEQ ID NO: 12384 - DNA, 458 bp, Zea mays
  Clone ID: cC-zmpo14820006a10a1
gaacaaaaaaaatttgactttcatatttttaaaatgtgataccgggccgagaaatggttcccctagctgaccaggaacgagaaattggccgaggaaccagacttttcggtcggtaattcgaagcatgcatgcatagcataggagtgaccaagatgcgtgtgtgccgccacgatatcatcactcatgcagtcgaagcagtgctctgccccgaggtcggcgctggcgctggtacgctggcgccataagctggggcatcaggagacggggcgccgtaggcgggggcgccagccgacgagccgtaccctccggacggcgccgacgcatccgacggcggcagtgcgacctcggccgacatggagccggaagcctcggtgatgaggtccagcgtgacgcgcagcagcttctcaaactcgaagctcttggttatgcagacgttcttgatgtcgctgacgggggcg

SEQ ID NO: 12385 - DNA, 517 bp, Zea mays
  unsure at all n locations
  Clone ID: cC-zmpo14820006a10d1
ggacccacgcgtccggaaccatcatgaccacaaaggaggggacacacacacacacacaccgtctccgcccgcccgccgagacgcgccataggctatggctcgctccgtcgcgcacctcttctttcccatcctccttatctccaccgcgcccgccgagcgggccatcaccgacgccgccggcggccccggatacctccaggaggcgtgcaacaagacgctgttccccaaggagagcatgcacgcgctcaaggacaacccagagtgccaggcggagacagaggtcacgccgcgccggctggccgagctgctcgagtacgtgtcggccgaggagggcatgacctgggccgcgttcgcgcaccacgagctcaacgccatcaaagacgacgacgncctgtacaagagcatcgacacctgctccgaggacatcgaggaagccgaggagcacctnagagccctctgccgcgacttctccgacgccaggttcctcgagggcaagtcctggctcacctccacgctc

SEQ ID NO: 12386 - DNA, 452 bp, Zea mays
  Clone ID: cC-zmpo14820006a11a1
gaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctagcgggttggcggggcgcaggctgtcggagatgccaacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggtcgcgtcggtgaccccgtcgatggcgcgctcgagcttgccggtgccgaagtgcttgcac

SEQ ID NO: 12387 - DNA, 399 bp, Zea mays
  Clone ID: cC-zmpo14820006a11d1
gattagccaccctagtatcaccctccctccctcacacaaataatttggttaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgagccgaggctgacgacccgaacctccccgactacgtcatccagggccgcgtgtactgcgacacctgccgagccgggttcgagaccaacgtcaccgagtacatcgcgggcgccaaggagaggctggagagcaagcacttaggcaccggcaagctcgagcgcgccatcgacagggtcaccgacgcgaccggcacctacacgatcgagct

SEQ ID NO: 12388 - DNA, 501 bp, Zea mays
  Clone ID: cC-zmpo14820006a12a1
agagataaaagtcacaatataatcagagtacttattacatagcgaaagtcttacaaaataaaagataaatataaaacaaactaaggatcatccttggcgcaagtcaactgggagacgccacctagatcgaatcgaactcctcgatacgtgactcctctttaaccacctgttcttctccatgaatcgcgctgtgccaatacatgtccatggcagatggcggcccggcaatggtgaagtgttggctgcggaggcgccacccgagcctcggcgaaagattccgagaagtccggcaaggagtcagggcgactacctaacccggcgctgttggtggagttctgttcaaccgtacggtggcttgccagagctctccacggtcatgggagcggcggcttggcagcagcaccgcaccccggcgaggcatccaccgccccccagctgccggtcgagtcggcagcggcgcccaggcgagggagggacgagccggggaggacgacaatgaac

SEQ ID NO: 12389 - DNA, 326 bp, Zea mays
  Clone ID: cC-zmpo14820006a12d1
acgcgtccggaatataggagtcctcccagggtcgtccctccctagccagagctccgctgacgactcgaccgacagctggagggcggcggacagcctcgccggagagcggagctgctgccaagccgccaatcccatgggcgaggagagctctggcaagccaccggacaggagaacagaactcctccaacatgagccagagctaggtatggagtgctgactccttgacggacctatagaaatccttcagcgaagctgagtgaggcgccaccggagccaacacttgaccatcgcagggccgacatctgccatggacacatattggcaca

SEQ ID NO: 12390 - DNA, 282 bp, Zea mays
  Clone ID: cC-zmpo14820006b04a1
gaaaattgaacttatgaaaggaaagaagaaaaaaatacaaagatcgatttaaagcaaaagagttgtatcaatgatgacactagtacaaaggcaagaaaaccgatgaggtctgataaaataaatgtggttgcccgcaaaatccaatttgttccagaattgtggtagcacacttgcatgggtttgtggttaaaaatggaaaagggggggggggggcccaggaagtcgtagatgccagcgtttagggtttccaggcacctagatgagggggctgaacccctttgg

SEQ ID NO: 12391 - DNA, 153 bp, Zea mays
  Clone ID: cC-zmpo14820006b05a1
aatgtctgatatttttggtaaagagaacggaagaaaggaaagaagaaaaaaaaacaaagatggaataaaagcaaaacggttaaatcaatgatgaaatcagaacaaaggccagaaaacccaacagcgcggaaaaaataaacaatattgcccgga

SEQ ID NO: 12392 - DNA, 297 bp, Zea mays
  Clone ID: cC-zmpo14820006b06a1
aatgactgatatttttgtgttaaagaacttaacaaaagaaacgagccaaaggtaccaagagggaataaaagctacaagaaaacatcaatgaggcaatcagaacaaaggccaaaacaccgggaaggtcgtaatatattaacaaaagagccagcggaaacaatttgtggcagcaatgtgcaggctctcacccagcggtctgtgaaaaaaggcaaacaaacaggggctatagacaaaaggcatgtatggatggccgggatgggtaaccaaaacctaaatagatggggtagagcccccttg

SEQ ID NO: 12393 - DNA, 231 bp, Zea mays; identical to SEQ ID NO: 12190
  Clone ID: cC-zmpo14820006b07a1

SEQ ID NO: 12394 - DNA, 220 bp, Zea mays
  Clone ID: cC-zmpo14820006b08a1
cccatgaagtttacgttcagctgcaacagatgatgctctgtacgtaccaaatgaacagtgtcttactgtcttgtacatgcgactcatcactctcctagctagctcactacagcacgtacggaatcaacgctttgatcctcggcgggaagtcctggaacttggaccggtaccacctcctggtggcgcatctccggccggcgaggtaggccgccgttccggt

SEQ ID NO: 12395 - DNA, 328 bp, Zea mays
  Clone ID: cC-zmpo14820006b09a1
ggaagcaaccgctagcaatcaatggccatttcccttatttcatgagcaacaaaataaatgcgggtcagggacaattacacagagtttgctcaacgtaactcgtaatttcaatgaatttttaaatgaaaaccaagggctcataatgtccaagcattccctgtttggggggcgccgccaccttatgctggagtgtaaaaacatgccaaacagtcgtccccggccgcatatgaatcatatcatgtttgcaagcgtcatgcaattgttggccatttggctgagctccttatcgaacttacccatggggttggggacaccggcatgggtgaac

SEQ ID NO: 12396 - DNA, 564 bp, Zea mays
  Clone ID: cC-zmpo14820006b10a1
cacagtgctgatcattgtgcttctattggtgaaaggaacaggagttccatgcccaacaatttctgctacaagaagaaaactggcaaaagatgatcacaaagagccctacagcctgatgctcagtcgagcaaggtcctagctctttgagaaagggaaaaagaaagagaggatggattgtaattgcatctccgaagaggctgcacttaaataacaatcgactaagagggggagaccatatggataaagtgctggagacggtctaagaggatggcttcaattatgatggctgaaccactgaaggagccatgttctcctcagatcggctgctccagcagatgtcgctgagtgaaggtcttaggcccttgctgcagaacatctcatactccagcgtgtcgcctgccgacttcttcacctcgacgacgtgaaaggccggtgtcacctcgaagatctcggcgtcgatcgcgagctgccccttcctcccttgcttggacccctgcagcttcaccagcccgtcctgttttttcaccatgaagcgctctgtctcagcgatctgctccagctttg

SEQ ID NO: 12397 - DNA, 398 bp, Zea mays
  unsure at all n locations
  Clone ID: cC-zmpo14820006b10d1
atgctccttgaaggcgcggagcctgaacgcgttcgtctttttctcccactccagagggttcgacctagtcaagcctgttcgaggtggaccaagagcagaaggccagcaactcgcggttcatgacccagaagccggcgtcggcgatagcgtcaaagctggtgcagatcgctgagacagagcgcttcatggtgaaaaaacaggacgggctggtgttgctgcaggggtcctagcatgggaggaaggggcagctcgcgatcgacgccgagatctttgatgtgacaccggcctttcacgtngncgatgcgtagaagtcggcaggcgacacgctggagtatgagaagttctgctggaagggcctaagaccttcactcagcgacatgtgctggagcagccgatct

SEQ ID NO: 12398 - DNA, 403 bp, Zea mays
  Clone ID: cC-zmpo14820006b11a1
gcacattgatttacattttttaactctggcaccgtatcggagtgcatgagcgaaagaatgaatatgcatgcatgatgcatgttatcatctgcatggctgcttgcgggcatgcaggttgaagaagaggagggaaagtggctacttagaagttcttggacgcctggtacgtgacgccgaacttccagtcagcggggagaacgtgccatgaggtggccttgcggtggtcgctagtcatcacccggaacgtcagcgactcgcaggtgaggtcctcctcggtctgccacacttgcccccagttgcgcttcatctccgtccacttgacgcgcttgctccccttcaccgacaccgccgcgatgtcgccggcgccgcccacgttggtgatcgtcaccatgttgaagtactt

SEQ ID NO: 12399 - DNA, 405 bp, Zea mays
  Clone ID: cC-zmpo14820006b11d1
aagatcttctatcattggagacgatcaccaacgagggcggagccgttttcttcgcggcggtgtcggcgattgggagcttgcgcgtctagaggacggagatgaagcgcaactgggggcatgagaggcagaccgaggaggacctcacctgcgagtcgctgacgttccgggtgatgtctagcgaccaccgcaaggccacctcatggcacgttctccccgctgactggaagttcggagtcacgtacctggcgtccaagaacttctaagtagccactttccctcctcttcttctacctgcatgcccgcatgcagccatgcagatgataacatgcatcatgcatgcatattcattctttcgctcatgcactccgatacggggccagagttaataaatgtaaatcaatgtgc

SEQ ID NO: 12400 - DNA, 384 bp, Zea mays
  Clone ID: cC-zmpo14820006b12a1
gatcaaatgtcacatctttactatataataagagttctatacaaaataaataattacatcaaaaggagacaacggtctagcaacctaaagttgactgggagacgacggcctagacctctcatgaacacatcgcatcatcctccatgagcctcatcctatggtacctgttcttgaccggtaattaagcaatggttagagcaggcctagctgagaagcggacgcactgcagcgacaaacgtggatgaacaagtcttagctctcgcgcggcacccgcgccaagcccgagttgactgaaccaggcacatgcgacggagaggcctcccaagacaccacccctcgtacactgaatagggagacgtcgtggccatatcccatggcggcatt

SEQ ID NO: 12401 - DNA, 404 bp, Zea mays
  unsure at all n locations
  Clone ID: cC-zmpo14820006b12d1
gtggacccacgcgtacgaaagcctccatgggatatggccacgacgtctccctattcagagttcttgagggaggagtcttgggaggcctctccgtcgcatagtgcctggttcagtcaactcgggcttaggcgcgggtgccgcgcgagatctaagacttgttcatccacgttagtcgctgcagtgcgtccgcttctcagctaggcctgctctaaccattgctttattaccggncaagaacaggtaccattagatgtggctcatggaggatgatgcgaagagttcatgtgaggtctaagccgtcgnctcccagncaactttaagttgctagaccgnngnctcctttagaagtaattatttattncgcatagaactcttattatataggaaagatgagacattngatc

SEQ ID NO: 12402 - DNA, 134 bp, Zea mays
  Clone ID: cC-zmpo14820006c04a1
gataagagaatttataaaaggaaggaagaaaaaaaaacaaagatggaattaaagcaaaacagttatatcaatgatgacaacataacaaaggcagaaaaacccttaaggtcggataaaataaaaaatattgcccg

SEQ ID NO: 12403 - DNA, 240 bp, Zea mays
  Clone ID: cC-zmpo14820006c05a1
ctatgactgatattttttggataaggaacttttaaaagaaaagaagaaaaaaatacaaagatggaataaaagcaaaagagatatatcattgatgaaatctaaaaaaaggcaaaaaaacccaagagcgatgaacaaattaacaaaatggcccgcacaaaccaatttgatacagcatattggaatctcccttgcaccgcgttttgggcaaatattaaaaaacgggcggggctgccaaggaaa

SEQ ID NO: 12404 - DNA, 66 bp, Zea mays
  Clone ID: cC-zmpo14820006c06a1
atcttttttttttctaataagaatgtctgggaggggaggacaaagatttttatgccacgatatatg

SEQ ID NO: 12405 - DNA, 240 bp, Zea mays
  Clone ID: cC-zmpo14820006c07a1
cttgtgttagtttttttgattgagggaatttttgggaggaagggagtaaaaaaaacagcgggggatttaaagcatagacattttgtcaatggagctatcgtaacaaatgtaggggcacccctccggtctggagagatttgagaagtggcccggttaatccattttgaatcaccaacatggtggccaccttgcaggacgtcttgataatagatccaaagaagggtgctggtaacagggata

SEQ ID NO: 12406 - DNA, 242 bp, Zea mays
  Clone ID: cC-zmpo14820006c08a1
aaaaactggggttttttgaagatagaacggatgggaggaaacaagcaaaaaatacaaggggggatttaaagcaaaacaggtacatcaatgaagaattcattaaaaaggaaggcacaccaaaaaggtttggtttaatataaattagggcccggttaatcaaatttaaaaagaaatctgtgttctccttacaaaaggtctaggttaaataacataacactggcgccgttgacaaggaaatcaga

SEQ ID NO: 12407 - DNA, 134 bp, Zea mays
  Clone ID: cC-zmpo14820006c09a1
aaagattgagcggaacggaggaaacaagcaaaatatgggcggggggaattgaagaaaaactggtacattatagaggacttcatgcttaaggcaagtgcacccaaaagatgtgaataaatagaaattggggcccg

SEQ ID NO: 12408 - DNA, 336 bp, Zea mays
  Clone ID: cC-zmpo14820006c10a1
gtgacaactcgtaataattgtcatgaccttgaaacaatctcatggtctctgcataattttagcattttgaactgtaattgttacaaaatcactcatttacattaaaatgaaatccgtgcttagtgcttacaactcgttgcgactgagagaaatccatagcacagcaggacgagcttcaccacctcatttctagcgaagttccaaaacagtatagcgagatcaatcatgaaaattcagtcaaggaggcctgggttcgaccaatccttgctaatatcatcaaggtggtcatcgaaatcaacaattttctcccatttctttgttgtaacatgatcagct

SEQ ID NO: 12409 - DNA, 370 bp, Zea mays
  Clone ID: cC-zmpo14820006c10d1
acccacgcgtccgatgctgatcatgttacaacaaagataaagggagaaaatagttgatttcgatgaccaccttgatgatattagcaagagataggtcgaacccaggcctccttgactgaattttcatgattgatctcgctatactgtttaggaacttcgctagaaaagaagaggagaagctcgtcctgctgtgctatggatttctctcagtcgctacgagttgtaagcactaagcacggattgcattttaatgtaaatgagtgattctgtaacaattacagttcagaatgctaaaattatgcagagaccatgagataggttcatggtcatgacaattattacgagttgccacaaaataaataaatacaag

SEQ ID NO: 12410 - DNA, 551 bp, Zea mays
  Clone ID: cC-zmpo14820006c11a1
cgtagcaaaggtcgcgctattttgtggtataatatatttatattgcagtcggtccatccatgattgaccgtatcagggattgacaatttggcagcacatcgacgtggttaaggcacaatttgatgcaacaagggaacaaaaaagaagaatgaaagaacatccttatgtgttacactcagaatcgcagcttgctggcatacgcaagcaccagctcgcttccatcacacgcaaaaccttttttctcgtgggcgtgaacaattcactgctgtttgcttctaccaacgaaagaaacgcttgcttttcttcttcttctcaatgtatgcaacgatctccaactgacgctcaagagtctcctgcaaggtcttctttgtagctgcaagctcctcttccagtgcactaacgcgggagacagcagcctgcagaacctcctccttatcagcaggcattgatgcgggttttgtcaggagtgcaatgaccttctcctcaagctccgagaggcgctttgcagagacggcgtcttcagcttcctccacagcctcttctgatagctt

SEQ ID NO: 12411 - DNA, 379 bp, Zea mays
  Clone ID: cC-zmpo14820006c11d1
atccatgtcaagtgagttagagaagaactttgctgttatgttccctgcttgctcaatcgccgcgaagctccatattgtcctgagcacaactattcttgacgtgcacagagaggggatgttgcatttcaggaaagctgcaagggtgctgattggcatgcttctgaagattgatggtgaccattttcctgagaccctgtgccgcatgtgcatgatcaatgccggccagggattcctgattctatggggcaccgcgaagagctttcttgacccaaagaccaccgcaaagattcatgcggtgggtaacaagcatcagagcaagctcctcgatgtgatcgatgctagtgtgccgccagaaattccaggtggtacctgccgatgt

SEQ ID NO: 12412 - DNA, 302 bp, Zea mays
  unsure at all n locations
  Clone ID: cC-zmpo14820006c12d1
gcgcgacgatgggatccctagttaataacatcatggncgagggcgccgtcctagcagcgctcgtagccggcgggtcgagcgggcccccgatagtgtcacccggccccctcatcaccagcaagtacatcggaaagaggctcaccgttagggcctgctggtgcggccagccctacaatgccggggctactgacaacagcggcgcgtgcggcatcaagaacgtgaacctgccaccctacagaggcatgacggcgggctacaacgagccgatcttctaagacggcaagggctgcggctcatgctac

SEQ ID NO: 12413 - DNA, 158 bp, Zea mays
  Clone ID: cC-zmpo14820006d04a1
attgacagattttttttgcataatgaacttatgaaagaacaggagaaaaaaaaacaaagaatggtttaaagcttaacgattaaaccagtgatgaaatcagaagaaaggcaagaacaccctaaaggtaggaatatataaaataaagtgcccggaaaaac

SEQ ID NO: 12414 - DNA, 243 bp, Zea mays
  Clone ID: cC-zmpo14820006d05a1
gataagtgaacttattaaaggaaagaagaaaaatcaacaatgttggatttaaagcaaaaccattaattcattgatgacatcataacaaaggcaggagaacccaacaggcaggataaaataaaaattatggcccggaaaatccaatttgaacagactattgggttcccacttgcccggggttttggtcaaataaaaaaaacctggcgccgttaaccaggaacatcgatatgccgccgttttggg

SEQ ID NO: 12415 - DNA, 160 bp, Zea mays
  Clone ID: cC-zmpo14820006d06a1
gactgatattttatgcaaaaagaacttataaaagaaaacaagaaaaaaatacaaagatggaattaaagcaaaacgattatatcaatgatgacatcatagcaaaggcaggaaaacccaaaaggcctgataaaataaaaataagggcccggacaaacaattt

SEQ ID NO: 12416 - DNA, 225 bp, Zea mays
  Clone ID: cC-zmpo14820006d07a1
aattgaaaagggaacttttgaaaggaagcgagaaaaatatacacagatggaattaaagcaaaacaggtaaatcaatgatgaaatcaaaacaaaggcaagaaaacccaaaaggtctggttaaataaaaatgagggcccggataaacaaatttgatcgggcatttgggatctcctttgcaaggcgttgtgcccaaatttgataaaactggcgccgttgacaaggaaa

SEQ ID NO: 12417 - DNA, 92 bp, Zea mays
  Clone ID: cC-zmpo14820006d08a1
gactgggatattttgttatttgaaggtattaaaagaaagaaaaaaaaaagacaaagttggatttaaagcataacatttatatcaactatgaa

SEQ ID NO: 12418 - DNA, 332 bp, Zea mays
  Clone ID: cC-zmpo14820006d09a1
gtgattatgtgagtttttttgtataaggaacggtaaagaaaaagcaagaaaaatagacaaagatggatttaaaccaaaactggtatgtcaatgaagaaatcataaaaaaggaaggaacaccaaaaaggtttggataaataaacataatggcccgcttaaacaaatttaaactaaattgtggttgcactcctacaacaggtttaggttaaatatgatacaactggcgccgttgacaaggaaaacttatatggcgctgttgttgggtttccagaaccaacctggagtggctagacccccctgatgaactgaaatgttacgatcgataggtggat

SEQ ID NO: 12419 - DNA, 267 bp, Zea mays
  Clone ID: cC-zmpo14820006d09d1
attctggcattacaggaggatatatgtatatatgaaacaaacttattgcaattaatgatagacaatgcaaccaacgttccacactgctagactggacatctcttgccggccaggtccacgtgtcctgttagatttacatggtcgatacaccaccagcttgcctggaaggaaaggaccatgtaacgaacccacgagcgaatagcagtggcctctgatcgatactaccagacgcaggagtagccataaccatcataataaatactaaaa

SEQ ID NO: 12420 - DNA, 522 bp, Zea mays
  Clone ID: cC-zmpo14820006d10a1
agacaaagaactttttaatataatatacactccaccctgtgcatctctatcgtgaggtgtacacagcctaatatttctgagaaaatataacagattgatgcgagtacatcctaaaattagtgaagggagtttagtttgttgaagaatagaatggtgtcacagagaagtttagagttcagacaaactgtgtttatcgatgcgatcactgatacatttcttcctgatccatattgggtagagtcgtctctgacacgaatgcaatttcggtgtaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccaccctcagcaccctcttcctggtcgctgtccatctggtgcagatcctcagcggacgcgtagcggctggtcatgccccacctcttgatc

SEQ ID NO: 12421 - DNA, 411 bp, Zea mays
  Clone ID: cC-zmpo14820006d10d1
gcgtccggccgaaagcctcgagcctactgttcctccctggcatggaggaagtagctgtttcgcctatgatcgtagccagccggagtgctggacaacaatggcgctgacgcggtctcctgcactggcatccctagcgttacaataagcctagaggagaaagaaaatatcaatggggatgttcccacgatcacctcggccgcatgcaacgaggaggaggcgttagccagagtcggagaatccaccaaggacgagggccatcgcttgacgaaggaaagctccactcccgtctgctgcagcagccgttccactcacaagatacgcggggcgtgcaggctcttcagggcgacgttcctgtccttaggccggagcgacgacagcatgaagaagacagacgacgacacctcgagcccc

SEQ ID NO: 12422 - DNA, 473 bp, Zea mays
  Clone ID: cC-zmpo14820006d11a1
agtaaccgagataacattcattcaataagccccaggatgttgtattatcagaaccccatggagggaaaacgggagacatcaaaggtttgttttgtttacaaggtgaccgagtctctctcccgacttaaacatgtatgccaattagtggtcgatctctttcttgcacattgatcatcaggcatcagccaattgacatgcagtcaattagcttagcgatggcttctccttctccatctatatctcctcctcggtgtctttcttcaattctgtcgtgggctcggctgccaccttgttggtggcaatattttcctctgcatggactgctgatggcttctccttctcgatgacggtcttctccacaacttcctcctcctctttgttctcaggctcgacaacgacgaccgccacttccgaagtggtcacctcactagcaatctgctgaggctcaatggtggctgctggctcttgtttcg

SEQ ID NO: 12423 - DNA, 277 bp, Zea mays
  Clone ID: cC-zmpo14820006d11d1
atatcctgcttgcctcctccatagaccaacaattaagcctccccttccgccacatctattaagagcagccatgggtgcctgtgcaacgatgcctaagacgctggaggggaaagcccctgctgaggccaccatctccacacccaaagttgcacctgagaccactaccatccacattgaggtagcggcaaaacatgctgtagctgagaaggaggaggaggacacggaggtggcactaacagtggcggcgaaacaagtgccaggagccaccattgagcct

SEQ ID NO: 12424 - DNA, 358 bp, Zea mays
  Clone ID: cC-zmpo14820006d12d1
ggtgacgcacgcgtacggagggattcgatgccgttagacgtaggcgagctcattcttcggcgttttcctttctccctctccgtcctatagcgaccgaccaacgcgtagtgcgaagatgtgagaggcagacgcccgtgtactagcacctgacgggcgagaacgaaggccaccacctcacgagggagggcatcgttagccacgacggcgcctcccgagctgagagcagcgcattgcccgagttcatgcccgttgagaaggctggcatcatgtaggatttcgacgagcctgagcacctcaccccgtccggactgacactgggaggctcctagtacatggtcatccaatgcgttcctggagc

SEQ ID NO: 12425 - DNA, 151 bp, Zea mays
  Clone ID: cC-zmpo14820006e03a1
ccgtgcaagactgagattttttgcaaaaagaacttataagagaacagaaggaaaaaagacaatggtggaattaaagcaaaacaagtatatcaatgatgccattataaaaaaggcaggaacaccataaaggcacgagaaaataaaatttttt

SEQ ID NO: 12426 - DNA, 329 bp, Zea mays
  Clone ID: cC-zmpo14820006e04a1
cattgtgttagccattttgatccggagaagagagattatcacaaatgtgatgccaatagtgcagcgttcctatgacagcgacccaagataaggcaggcagccttaatagcaacaacaggctgaacaatatgtttttagtgaaccataacggctgaactcccactgcaaattttttcatgcataggaaatcatggacaatggttttttgcctgcctcaacgccggctgccgcaagggagcaggaggcgagaaactgccctttcatgaccatccaaggtcttcttaggatggcttgacttcctggctgtaaaactttcttaactctggcga

SEQ ID NO: 12427 - DNA, 368 bp, Zea mays
  Clone ID: cC-zmpo14820006e05a1
gatatgcatatttattgggccaaatgaactaaaaagaaatcagaaaaaaaagccaccaaaaatggattgaatctaaaacctttagccagtgatgcaatctttggaaaggcagcaagaacccgaacgaaaggatttcatatactagaatgcccgaagaatcacaattatataaggttagcggtgcatgctgccaacttaattagcttgctgatgaaagaccatagcccgctgacccggatgaatccaacggaatttaaatgctattccaatcgcacgtaggaagtgtagaccgcatcgggtgtccagctctccaggatgacttggttggcgatgaccttgtcgccggactcgctggtgaggcggatgga

SEQ ID NO: 12428 - DNA, 163 bp, Zea mays
  Clone ID: cC-zmpo14820006e06a1
gattgactgaaattttttgaagagggaacgtgtgaaaagaaaggagaaaaaaatacaaagatggaattaaagctaaacgggtatatcaatgaggaaatcataaaaaaggcaggaaaacccaaaaggtaggataaaataaaaatgggggcccggataaagcaat

SEQ ID NO: 12429 - DNA, 166 bp, Zea mays
  Clone ID: cC-zmpo14820006e07a1
ctttctttttttttttttttttcatttttatctatgtctcatatttgaaaatagcacggggttatctaataacgggttttgttaaaattccaattgcaatgcccaaacaatcagctttccccttatccccttcttatattatcctaattaactgaaaagggaaaat

SEQ ID NO: 12430 - DNA, 233 bp, Zea mays
  Clone ID: cC-zmpo14820006e08a1
attgggaaataatgaagattgaatggataaaaagaagcaagtaaaaggaacaaagggggatttaaaacaaaggaggtgtatcaatcaagcaatcataaaaaaggcaagggggccaaatagctttgagcaaataaatataatggcccggctaaaaaaatttgaacagctttttggaaccacacctgcatttagtctaggtaaaaatagataaaacttgcgccgttaacaaggat

SEQ ID NO: 12431 - DNA, 511 bp, Zea mays
  Clone ID: cC-zmpo14820006e09a1
gtagttaagtgacattctgtgatcatgttactcctcttttttttgttttggttttgcataggctagttagttagtagccggtggatttgaaccacaactggtaggttttacaaaagtacatatataatcaagttacgccacaaagctttggatgaatttccagattgccctccttccccaactctaagctgtagtatttttttttctctacaacaggagcagtccaaagctgatgctccttgcgccatttacaggattagcttatcggatgcggggttagcttacaagaactaaccaggattggaaaataacagcaaatgactgcaaatgtaacatggatggatggatggatgagccatgcgtgtgtgtgcgtgttttttacaagctgaggatcccgtacagcgctgcctggtcatggttgaaaggttgcggcaacaggaggcggcgaatgtttgcttttttgtcggctgatcaagttgtgccaagcggtagcgacgagggacaggccact

SEQ ID NO: 12432 - DNA, 292 bp, Zea mays
  Clone ID: cC-zmpo14820006e10a1
ggtaaaagcaattacaggctgcattccacacgtataacgaaagaaaatgttcagtggatacaaaagggtatattctttgcgattaatcttttcgttgccaatacagctgccgccccatactccagggaattacattatcttctaacaaaaaaaagaatggttacatcgaatggctccaatatacagcttctcaccatgctatcagcaaaaccgggcaaacaaaaaatgtatatatataaaaggcatgtttggatgtcggggatttggaactaaatcttaactaatctgttcc

SEQ ID NO: 12433 - DNA, 320 bp, Zea mays
  Clone ID: cC-zmpo14820006e10d1
ggatacagattagtttagatatagttccaaatccccgacatccattcatgccttttatatatatacattttttgtttagcccggttttgctgatagcatggggtgatgctgtatattggagccattcgacgctgccatacttttctttggttgaagatcatgtactcccctgctgtttggggcagctggtgtattggccaccaactgattaagcaggaagagtctacccttcggtctccactgaacattgcgtttggctatacgcgaggattgcagcctgtgatggctgttaccacaattataataaatactaatacgtt

SEQ ID NO: 12434 - DNA, 420 bp, Zea mays
  Clone ID: cC-zmpo14820006e11a1
cttatatataatgtggaatacaaatataataacaagcatcgatcgatctctcgatcgagtggacacgattacaaatccatcgagatcggtgtgttgtcgaactttgtgggcaggcacgcacagtgtgcatacgcaatgcaatgcatgcatggataggcagatgatataggagcattaactagttcatgggatgtcaagtttgttatccttgtaagggtccctaggcccctgcttagcagcgatctccttgcacctcttcatgcagtcctccatgctcatgtggagtgggcccgtgacctcgtcacacccggccttgcagtccatggcggtcgccggaggggcggcctccagcacgagcgtgatgagaagcatcgccgcgacgatgaggaccgtcttattcgacgccatcgtcggtttggt

SEQ ID NO: 12435 - DNA, 283 bp, Zea mays
  Clone ID: cC-zmpo14820006f03a1
ccttgcctgatatttttggcaaaaggaacttataggaggaaagaagaaaaaaagacaaagatggaattaaagcaaaacaattatatcaatgatgacatcagaaaaaaggcaagaaaacccttcaggccggaaaaaataaaaattagtgcacggccaaaccaaatggaatcaacttctggatcctcacttgcacggcgttgaggtaaaataaggaaaaacgggcggggcggccaaggaacaaggccacgccgcctttttgggtttcccagccccaaatggtggg

SEQ ID NO: 12436 - DNA, 149 bp, Zea mays
  Clone ID: cC-zmpo14820006f04a1
cgtgcatgactggtattttttgaaacaggaacttataaaagaacagaaggaaaaaagacaatggtggaattaaagcaaaacaattatatcaatgatgctattataacaaaggcaggaaaaccattaaggcagaataaaacaaaattttt

SEQ ID NO: 12437 - DNA, 245 bp, Zea mays
  Clone ID: cC-zmpo14820006f05a1
aaaaaaaaagaatttttaagaaaaaggaagaaaaaaagacaaagatcgaataaaagcaaaacgaataaatcattgatgacatcaattcaaaggcaggatgcatataatgggagagacaaataaacgtgggtgcccgcacaataaaattcgtaacagcattcgggcactgacttgccccgcggtctggtataatactggaacactggcgccgttgaccggggaatcataaaccgcgcctttttggg

SEQ ID NO: 12438 - DNA, 180 bp, Zea mays
  Clone ID: cC-zmpo14820006f06a1
attgactgatattttttgtataatgaacttttaaaaggaaacaagaaaaaaaaaccaatgtggattcaaagcaaaccagttgattcaagcaggatgtccgaaaaaaggccggaaaacccatcagggctgatcaaataaaaaatagtgcacgcacaaaaccattgggtcacacactgggaa

SEQ ID NO: 12439 - DNA, 151 bp, Zea mays
  Clone ID: cC-zmpo14820006f07a1
ctgaaaagtgaacgtttgaaaggaaacaagaaaaatatacaaagatggaattaaagctaaacggttatatcaatgatgaaataaaaaaaaaggaaggagaaccgaagagcgcggatgaaataaaaatgatggcacggataatccaatttgt

SEQ ID NO: 12440 - DNA, 244 bp, Zea mays
  Clone ID: cC-zmpo14820006f08a1
atacatatatttttttatagactgatattttttgaatcttgaactgataagaagacgcaagaaaaaacgacaacggtggattcaaagcaaaacagttaaatcaatgaggacatcatttaaaaggcaggaaaacccaaaagctctgaataaataaaaaaaagggcccggataaacaaatttaaacaaacaatttggttgcccacttgcatggcgtttaggtaaaatattaaaaaacttgcggcgc

SEQ ID NO: 12441 - DNA, 383 bp, Zea mays
  Clone ID: cC-zmpo14820006f09a1
aaaaaaaaggggttggccaaaactagggaaatgtgggaaaaagaccaggggtttgaattccaccgaaaactcgggattacatacggggggcttatatgatttttttaatggaaaattaggggcccagaaaaaaatttggacaaatgccttgacaggggacacaccattccccaaaattatatacttttcaaaaatcgccggggggagagccaactaaagaggttttctttgggggatgcccccccaagcaggaacagggggggggcactgaaaacgggggggattgcccttgaaaggtgttttttgttggcattgacagaaggggttaagaggggatgcctgcgcttaccttaaaggtgggataaagaatcgggggatggggg

SEQ ID NO: 12442 - DNA, 406 bp, Zea mays
  Clone ID: cC-zmpo14820006f09d1
gatagctgttgctgcttatcttcttcctcttagtcccgcaacatgttctttcccccctcagcattgagattatcaaggctgctggtgagaggactacaggttccctgcagggagaggattttcttctccgctcggatttcctcaatgacccagctgccacatatgccgtggcagacagtattgcaagatgcaccgatgaagctgaggacgcaaagcttaagtctttcatgaatgagcactggagcgaggcaggtttttgagcgggattcgaatctgcactgcagcactttgggaatcccatgaagataatggacaggggtgaatcaccaatccgcttaggggatctcccacttgagctggcgattgccatggcctacctgccgctctataaagaatgcatgaattc

SEQ ID NO: 12443 - DNA, 492 bp, Zea mays
  Clone ID: cC-zmpo14820006f10a1
gacaaccaatttgtcgtgaatttgagctaaaaaatgtaatttacatttgatctctctctctgctctaccgctacagcagcaggcacaagacgcagactgcttaggggtcacaaggcttacagttacatccccacgaacaaataggaagcggtctgtgcccggtacgcctgacaaataagtgttacacccttgtccaactacaggcttgttcggttagctctcaatccatgtgaattgaatgagattggatgtgtttgaatcgcaaacaagttaaacttcttcttaattttttccaatctcatccaatccatatgtattagaaataaccgaacaaggatttgttgtcaccctgtgtgttcttctgctaacccgtttacaacagcgcgacagagacgacgaatttggtcaatatgatgaaagaaaggcgtgtcatttgagcgatggatcaatctcggtgtgagaagggatgcggctcctgcttactccaggacg

SEQ ID NO: 12444 - DNA, 386 bp, Zea mays
  Clone ID: cC-zmpo14820006f10d1
cccatcgcgtgctgcccacgcgtccgcgctcgctccagtacgcccgttttccagctccggagatcccatctcggccacctcctgcggtctccaagctccaagaggccagattccagcacaaatttgaggtcaatgtgcccgctgagctcgaatcaatccgctcggcaacaagagtcctttgttcccccgatccccgggcttcgattcgatcgaatccgacctaattttatagagagagagtgtgtgtctaaccttctctcgctgcacttttcctttctcctgcctgtcgcaaacgcaaagagggttccatcgcgtcacccgcacagctcctctgatcgggcggcgaaagaaatgcgcataaaaggcgagctcttgacgggctctac

SEQ ID NO: 12445 - DNA, 574 bp, Zea mays
  Clone ID: cC-zmpo14820006f11a1
atgaattagactagtcttggtgttgtaggaatacaagtgtacaaattgggaataaaattaagtaaaataacagctggcagctgcagtttttgacattttgaaaatggaactactgtcacacatctaggggctcttctcctaacaagagtgccttgagaattcggtctgtccatccatctaccatcacgaacatgtgtccaccttctgggacttcatgatacttgatccacggaagcttcttggcaatgtacctctgcagctcaacaagcaccaacctatcttcgcgtccttgccagatgtgcacagagccctcattttgaggaaatggattggtgacattcattggatcgaactcccaagttccaaaagcgacaagtaaatcacggtggatcgattcataaatgccttgctgccttgatttgttctcaatggttcttggcattgccatcatcttctgaagaacctccatgtcatgcttgctaaatatttcagggtggtgcatggctgctgcaaaagaagggaaccacctctgggtcatccacaggtaaagcaaggaaggtatgttgtgtgcaat

SEQ ID NO: 12446 - DNA, 431 bp, Zea mays
  Clone ID: cC-zmpo14820006f11d1
gcagcctaagctctgtggatccgcaagaggccctcctctgacatttccctggatcaagctcaaggacggaaggtaccttgcgtacaaagtggatggtgtacagagtgacaaggccaggtacaagatcatcacagtgcacgcatttgatagcaccaaagacttcccctcgcctgtttctaaggagctcgaggaaggactgggaatttacctccttgcttatgacagagctggatatggggaaagagaccccaatcccaaccggcatgtcaagtgcgtggcgctagatatcgaggagcttgccgaccagctgggccttggccacaagttctatgagctatgggcctcaaagggaggatactcggttaggggatgcctccagtatatacctcacaagcttgcaagagctgcgctggttgagccaattatcaact

SEQ ID NO: 12447 - DNA, 255 bp, Zea mays
  Clone ID: cC-zmpo14820006g03a1
caaacatgcctgatattttttagaacaagaattttaaggaaaaaacacggaaaaccaacaatcatcagataaaagttaaacggttctagcatgggtgcccatataaaaagggcaagagcatatttcacgaagcaggacctagaaaatttgtgacggctggtcctataagaccaccaaacttgttcatgactggacggggttttaggtagaaagggggaaaccctccacgatcacccaggaactggtcaacgccgc

SEQ ID NO: 12448 - DNA, 349 bp, Zea mays
  Clone ID: cC-zmpo14820006g04a1
cattaacgtcaaacatgcctggtattttatagaaccagaatattaaggaaaaaacacggaaagacgagcatcttcagttcaaagtaagaccgttctagcatgggtgcccatataccaagggcaagagtatgtttcccgaagccggacctagaattttgtggaccggctgtcccataaggactaaaaagtttgtataagactggacggactttggggtataaaaaggaagggcctccacgaccacccaggaactggtcaactccgccttgatgtgtatcccagcgccccaaagtcggaattacaccgggttctgaaccgacggcttgaccctgttggtgaccttcgtcca

SEQ ID NO: 12449 - DNA, 113 bp, Zea mays
  Clone ID: cC-zmpo14820006g05a1
ctgaagagagaccttataggaaaaatggacaaaaaccggcaaagatcagaaaacagccaaacgatgataacaatgatgcccacagcccaaaggcaaaaaaaaccatgagccag

SEQ ID NO: 12450 - DNA, 216 bp, Zea mays
  Clone ID: cC-zmpo14820006g06a1
gcaaggagcctcatcaggcatttcattaaaattgaataggtcgaacatgtgtccaaaatgacaagtgagaagcattaggtagcaacaatagacattacagtcttgatgaataggagaaagcggctgccgacagaccggcagaaaactttgttcatgctaatgaagaaacagcaacaaaaggagaaagaaacggggcgggaggctggcgataatggc

SEQ ID NO: 12451 - DNA, 505 bp, Zea mays
  unsure at all n locations
  Clone ID: cC-zmpo14820006g07a1
aaacgataattttggagtccttgatatcaagaattgatacaattagaggctaagaacatgataacacatcgaaatcaaacagaaagaaaaagagggagagcaagaacatatcacggatgaccacacattattatggatttttggttttaaacaacattgctctcacttttctttcatatcttgttccaaatgcaatcggaccgacgtgcttggccttagttggtggagtcatcgtcgtcgtcctcattgcccgatagtccctcgacgccctggggaccaggtgcacctgccggtccgctaggtccatcggcaggtgcgtcagcagcgggggcgggggcatcggcggagggggcatcagcggactttgcctcggccatcggtgccacaaccatggcgacgaagaggagagcagcaacgacgaagacgacgctagcgcgagccatgggtatggtgtctttcttgggttggttgctagctgcttgacaagtttgacgcttggtgtctn

SEQ ID NO: 12452 - DNA, 514 bp, Zea mays
  Clone ID: cC-zmpo14820006g08a1
gtaggaaagtaaatgatatgtatatttagtggtccatatatcgaaacatgccctcatgaaaaaaatgcctccaaaaatggcatgtatatttaaccttttgcttgttttccactctttggaattcgatcatgaacccgaacaaaaggattacatatactagaatttggaagtctcagtagtatataaggttagcggtgcatgctgccaacttaattagcttgctgctgaaggtccatagcccgctgtgccggatgaatcgaagggaattcaaagtctagtagaattggacgttggaagtgtagacggcatcgggtctccagttcgccgggatgacgtctttggcgatgaccttcttgccggactcgctggtgaggcggatggagaaggggcccttgagcgccttggcagtgtccatcctccagatggcgccccaagagagcttcatgggcttccactcagccgacaacttgtcctggatttccatcagcacgatgtcgccgtcgtccgccacata

SEQ ID NO: 12453 - DNA, 418 bp, Zea mays
  Clone ID: cC-zmpo14820006g09a1
gaatgaacgatcggagtatgtagtatatataaacgccgtatatatgcttgtgctggcacttacaacagcaagacaatgagcacttatataaacgtgcatgcaataataagaaatcgatgtgctatatgtatatgcttggggatcagcgcgcgcccctgcagcgttctatgggctcgcacccgcgggtgtatttattggcgttggcgacggggcggtacaggtccttgttctttccgtttggctcgtcggcgacaatcgcgtcgtagttcaacgtgcctggcatggcggcagcgtcctgaacgccactgctcaggaggaggagggccaccagcaggacggtcacgttgttgagcttagcttcgcccatgcccggctgcgtttattcttgtgcttcaggtaaacgaatggagaagagatc

SEQ ID NO: 12454 - DNA, 458 bp, Zea mays
  Clone ID: cC-zmpo14820006g09d1
gatctcttctccattcgtttacctgaagcacaagaataaacgcagccgggcatgggcgaagctaagctcaacaacgagaccgtcctgctggaggccctcctcctcctgatcagaggcgttcaagacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacgggagtttatatatactacatactccgatcggtcattcaaaatttaaattataaaatgaccccctgtggttataaaa

SEQ ID NO: 12455 - DNA, 195 bp, Zea mays
  Clone ID: cC-zmpo14820006g10a1
aaaagggggggtgaaaaaggggaaaaagcaaaaagaggaaaaaagggagggcctttttttttaaaaaaataattttattgcggggggaaaaatggaacttttattttttttaaagagaaagtccaccccgtaaaaaaaaaaaaaaaaaaatggggggaaaaaaaaaaaaaaaatatgggggggggggggtaaaaa

SEQ ID NO: 12456 - DNA, 475 bp, Zea mays
  Clone ID: cC-zmpo14820006g10d1
ttttattatatattatataaaaaaaacaaacttaaaaaaaaaaattttattttataagaaaaaagaaaaaataaaaagggggagtaatgataaaagaaacaaataataaaacaaataactctgcctcctatcggacgaactcccacaccatgtacccttccgtgccccccgtaattcatcaaaacagttattttggggggggggccctgggcggggcccccctccgccgccgggcccggggggcgccggccctccccatgctgggtgggcaatggtaggtaggcgatcgtgcggcgcccggcctgacagggccccggccgggagggcggcccgccggccgggttggcccttttggctccggccgggcccaccggccccccccgcaggcgcccgggagggcgcctcggaggcgaccgcggccccctcggggctaccccgggccggccccgcgagggtgggggccccgccccccccg

SEQ ID NO: 12457 - DNA, 452 bp, Zea mays
  Clone ID: cC-zmpo14820006g11a1
aagaacttatctcctttgccttagcattttcgttatgtctctcattacaataaatgaatctacaagcatacctccgccttttaaacaaagggaagcatgaaggatcttcgaaggctaagcggcacgaagctagggcccttaaaaagtactttatgtagggcactgttcatctatttatagaggaaatgaaccgcctttgtacgaatttacaataatgtccatcaaatttttaaataagctatttacaaatgatatgaggacaataaagtattttctccgtcttcggctttgcggatctcagcccattttgttcgggaacctcccctctagctcgtgcctgaagctattgccttctggcgcaatctttgctacttgcgtacatatgaagcatctttgtatactgctttagtcgaaggttagcttcgtctgccagtagaaatattcctgaaata

SEQ ID NO: 12458 - DNA, 340 bp, Zea mays
  Clone ID: cC-zmpo14820006g11d1
cggacgcgtggagcactagagtgcgggaagtccgccatctagtccatgctgatgcaggtggtgggcgcgggcggccacgtggaggcgtcgcggtgcctgtacggagggacccacgcgctgctggcccgattactgccgcgcgcctactgggagcgcgccaccttcgaggtcgccgacaacaagggcgacgggcgcgccaaggaggcccccgacgaaacgcgggtggagtacgcggagtccatgtgcaacccgacgctgggcgtcggcaacatccccatactatcgcgggtggcgctcgaaggcggcaccaagctataggaggacaacaccttcacccccg

SEQ ID NO: 12459 - DNA, 93 bp, Zea mays
  Clone ID: cC-zmpo14820006g12d1
ctggcctgagctgcagaggagagaagcgcatgctccttgtaccgtttccttacaacaggagctcgttcgtgaagctcgatcgagctcccctgg

SEQ ID NO: 12460 - DNA, 362 bp, Zea mays
  unsure at all n locations
  Clone ID: cC-zmpo14820006h03a1
gcactccaacccccagagaacttttttacagcaaaaggtttcagttcaacggagcatccatccagaatttgggcgttgcagatcgacgatatccctgtccattctagcgtgctgaatgctgactgcaactgcaagcagaagaggtcactcgaaggagtccggcgacagcatttgcgccccctcgtcgcccccgccccggcgcgccgacaagggcgacttgaggaagctgggcgtgccgggcctggacaaccccggcgccgccttcttggggttgccaccnccaacggtggcggcggaggcggcggctttgccccctatggacagagactctcggacgttcttgatggcctgggggggggggg

SEQ ID NO: 12461 - DNA, 326 bp, Zea mays
  Clone ID: cC-zmpo14820006h04a1
ctaataggaaatcgatatattccccggacaaactccggcgatggccggagcctgaaacgtgacaaaacatctttgtcctcccctccctgctttccctcccggcttggtcacaatacaatctcatctacgccggagctgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttcggtcccgtcccggcccggccggtcagctccgcagcgcga

SEQ ID NO: 12462 - DNA, 426 bp, Zea mays
  Clone ID: cC-zmpo14820006h05a1
ggggaaaactgatctttttcatttggcgaaaagcaatgttgtttgatggggcacattaaaaacccataccataccatacaaaaaatttgccgagaatcatgggtaagtacatagtcaggactcagggaaagacctaattcctgcacggggacatggccagcgaagttgtttcaccacttattaaaaggcatacagcaatgcccaaatgaaaagcagtaagctcgctgcattctttgagtttggggagcttgaggctccatttgctgaaggggcatttgcagctgtgtcgggtttttcctccgctgccgctgctggttcgtcgggaggcgtcggtgcaagtgccccaaggacccctgtgcactggctgagcgggggggccttgaccttgcaaacgccggggagctccaatgccctggtttggttgat

SEQ ID NO: 12463 - DNA, 319 bp, Zea mays
  Clone ID: cC-zmpo14820006h06a1
gcatcaattcgttaaattaaggagaaagagggaacaaagaaaaagaggacaaaaggtgtgtccaatcaaaaacatgcccacgcatgggaatgcgcgcagccatgtcactctctgtcccgcttcgtctcttcctcggactccgggcgaccggccgaggccggctcactgaatgtagtaggcgatgaaggaggcgacggcggcccccagggcggcgccgacgggggtctctacggcggaagaaccgttggtggggcccggagccagaaccttcggggcgagcgccacggtggccagcgaggcggggacaaggacggctcag

SEQ ID NO: 12464 - DNA, 151 bp, Zea mays; identical to SEQ ID NO: 12425
  Clone ID: cC-zmpo14820006h07a1

SEQ ID NO: 12465 - DNA, 422 bp, Zea mays
  Clone ID: cC-zmpo14820006h08a1
gacaatagcaagaatccagcactcagaatttggtacagccacgcagttacatttttgttttcctttcctttctcagttacatatttgtaatccaggtgaagaggatttgtggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcagatgggcagcggcacgtcctcctcgtggctgtccttgagctcgatcgtgtacgtgccgttcccgtcggtcaccccgtcgatggagcgctcgagcttgccggtgccgaagtgcttgcactccagcctcaccttggcgcccgcgatgtactcggtgacattggtcacgaacccggcgc

SEQ ID NO: 12466 - DNA, 407 bp, Zea mays
  Clone ID: cC-zmpo14820006h09a1
ggggatcatccatgaaccatcggacaccattttttaaaatagaataggatgatgacagggcacacaaaccaggaggggcattgtttacaaaacaatttacaatacacagctgcatgggaaagcttttttttgcgccaaggggttggcagtcacgacacagcaacaccaacgcttcacaagacggtccttttttgtgaacccaaagttgtcgcagcgatgggaaatcacagtccggatcgcttttcttttgcggcaacgtgggaggcccaccaggcaatagggcggttgccaaaccggctgtgcagcaaggggttcaaagccttgacgaccatgctcatgttgggacggaattcaccctcgtattgcacgcaaagggcgggcacagcagccattttgggtacagcctt

SEQ ID NO: 12467 - DNA, 433 bp, Zea mays
  unsure at all n locations
  Clone ID: cC-zmpo14820006h09d1
caacatactgctcttagaccatgaagtagcgaagatcggggacttcgacatctcaaaccaggcccctgacatggctgcgcgcctccactctactcgcgttcttggcacctttggctaccatgcaccagaatatgccatgactggacagcttagcacgaagagagaagtctacagctttggagttgtgctgctggagcttttaaccggtcgcaagccagttgaccacacactgccccgaggccagcagagccttgagacatgggctacaccgaggcttagtgaagacaaggggaggcaatgcgtcgatccaaggctcggagacgaataccctccaaaggctgtagccaataaggctgctgaggccgccctctgcgtgcaatacgaaggagaattccagcccaacatgagcatcgncgncaaagctctgaacccc

SEQ ID NO: 12468 - DNA, 397 bp, Zea mays
  Clone ID: cC-zmpo14820006h10a1
aaccgggggggggaggtaaaaaagggaaataaaccaccggtccgaaacgggaggccacttttccataaaaagagaaataaaaaaagttggcacaaatgggcgaaaaaaatggttccgggggaaaagggttttatggacaacactccaaacaagggagggagcagggaacaaaaattagaccccctggggagccccaggaggccaaaaacacacaattgggggggggaccaaattggaccaatcacagacagaaaaggtgtcccacacccggaaagaaaaaataggccaacccggggggaaaggaagtatgagtatggggcaccggggggatccggcgtaaaaaccctgacaagggcaaaaaaaaggggccctttaccccacgcccaaaaaaaagacc

SEQ ID NO: 12469 - DNA, 104 bp, Zea mays
  Clone ID: cC-zmpo14820006h10d1
ataaaaaaaaaattctataaagcgaacagaataaaaaaaaaaaaattttttttgtattgataaggatgcccaaatattcaaccgtcttatggctggccctaacg

SEQ ID NO: 12470 - DNA, 367 bp, Zea mays
  Clone ID: cC-zmpo14820006h11a1
caggaaccgagctggtgaattaaataaaggaggcaaaccatagtttggaaacttgaggctgctgttacagcaaaaaagaaatcaacacattttacacacatgtccacaccataagtttcctttgtatgctccccttatttacacgctaacaatctcgttgggttcactggaactattttaggccccatcatcaggcgctgcagtccatgaccatttaatttgagtcaggactgaatttgaacaagcatggacagcagtggttttccagacctggaaggcaacctcatgcccgtttatactttatacaattatgagtatgcttgatttgcttgacccggcggaagattccttcccatggcattcaaat

SEQ ID NO: 12471 - DNA, 385 bp, Zea mays
  unsure at all n locations
  Clone ID: cC-zmpo14820006h11d1
acgcacgcgtccgaactgattgccccgggaaagcatcctccgccggatcatgcatattttgctttctcatttttgtatagagcattgacgggcatgtggttagccttccaggtgtggaaaaccactgctgtccatgctcgttcagattgagncctgactccgatgacatggtcatggactgcagcgcctgaagaaggggcctaaaatagctgcagagaacctttcgagattgttagcgagcagatttggggagcttacaacggaaacttatggcagagccatgcgtttaaaaagagcngatttcttttttgctttcacagcagcctcaagtttccaaactatgggtagcctcctttatgtaattctccagctcgggtcctgcctt

SEQ ID NO: 12472 - DNA, 414 bp, Zea mays
  unsure at all n locations
  Clone ID: cC-zmpo14820006h12d1
catgaggtcggcgagagcgggcacaggtagcgttggttgtggcgtcggagttctcggagagtgagcgcatggagcggtcctcccaaagtccccccaggcaagaacatcacggccacctatggcaaggactggctggacgctaaagcgacaaggtatggcatgccgacgggtgccggtcccgacgataacggtggcggctgcgggtacaaggacgtgaacaagccccccttcaatagcatgggcgcatgcggcaacatccccatcttcaagagatggnctgggtagagggtcctgcttcgagatcaagagcgataagcctgtggatagctccggcaagcccgtggaggtgcacatcacgcgacatgaactatgagcctatcgaggcgcaccacttcgatttagcaggcacggcgt

SEQ ID NO: 12473 - DNA, 282 bp, Zea mays
  Clone ID: cC-zmpo14820007a01a1
aaggaacctttataaatcattgccaccgttgttcattacatgcatgtgacaaaaaaaggaactccaaaaaacattcaataatggatttcatcaataaacttatccatctatggaacattttaaaaaaaaatcgaagaaatagctattgtgtagagctgcaaaaaaaagaagccgccgggagttcaagcagcttcttgctcagtagcactatcagcgttcaaatcgactgagagatcaagctcctttccagagatcttgttgtacaaagcgagcacatccttg

SEQ ID NO: 12474 - DNA, 435 bp, Zea mays
  Clone ID: cC-zmpo14820007a01d1
cccacgcgtacgaggagaccttcttcgacatctacgacagatatgaacccgtcaacaacccggaggaggactgctgtttcctcacaaatagctatgactccaccacccattttgagacgacggtcaaggatgtgctcgccttgtacaacaagatcactggaaaggagcttgatctctcagtcgatttgaacgctgctagtgctactgagcaagaagctgcttgaacacccggcggcctcttttttttgcagctctacacaatagctatttcttcgatttttttttaaaatgttccatagatggataagtttattgatgaaatccattattgaatgttttttggagttccattttttgtcacatgcatgtaatgaacaacggtggcaatgatttataaaggttccattaaaaaaaaaaaaaaaaaaagggcggccg

SEQ ID NO: 12475 - DNA, 329 bp, Zea mays
  Clone ID: cC-zmpo14820007a02a1
aaaattaaattgggatcataataatattagcatcgagtcacgattacagaacaaacccttcgacaattcacacgaccacgaaacgaacgaacaaacaaacaattaaccaatcgcaaaccacgtaaataaaaaaaacaattaattaatcggatgaaccaaacacgaagcatcccaacgttgccgccccgcgcgtcgtcgctcagaggaggtagtaggcgaggaaggaggcgacgagcgccccggcggcgggcacagaggcggaggcggagccgcttgcgctagggcctgccgcaccaccggccgcgccggcgggcgcctaggagggcgcc

SEQ ID NO: 12476 - DNA, 578 bp, Zea mays
  Clone ID: cC-zmpo14820007a02d1
gacgtttgatgcgcgcgacccacgcgttgggatctctggacggggcgcgagcagtctcccaattccacccaatatctaataacatctcctcgaacgccaggttccttggaccactatatccaggagcgacgaagtgatccacccgccagccatggagatgaagaaggtcctttgcgccgccctcgtcgccgccgcctcggccaccgccgtgctggcctcggtcgcctccgaggcgccctccgaggcgcccgccggcgcggccggtggtgcggctggccctagcgcaagcggcgccgtcgccgtcgccgtgcccgccgacggggcgctcgacgcctccttgctcgcctactacctccactgagcgacgacgcgcggggcggcaacgttgggatgcatcgtgtttggttcatccgattaattaagttgttttttttatttacgtgagttgcgatcggttaatggcttgtttgttccgttcgattcgtggtcgtgtgaattgtccaacggattgttctgtaatcgtgcctcgatgctaatattattatgatcccaactttatttcaaaaaaaataaaaggg

SEQ ID NO: 12477 - DNA, 335 bp, Zea mays
  unsure at all n locations
  Clone ID: cC-zmpo14820007a03a1
gtagacaaagaactttttaatataatatacactccaccctgagcatctctatcgggagagtagtacacagcctaatatttctgagaaaatataacagattgatgcgagcacatcctaaaattagggaagggagtccagttttgcgaagaatagaaaggagccacagagaagtttagagatcagacaaactgaggtgatcgaagcgatcactgatacatttcttcctgatccatatagggtagaggcgnctctgacacgaatgcaattccggtgtaagatcagaacgattacatacattgccgaagcggatggagcaatggatcactcggaggcac

SEQ ID NO: 12478 - DNA, 364 bp, Zea mays
  Clone ID: cC-zmpo14820007a03d1
gacccgtctggtgctaaccagcgcggggcgctgatcctttatagggcgttgctgtctgacttcgggcggagcgaccatccgccgggcaggtactatgacggacagatcgctctcctggaagggatctatgtaagcggccggagacgatggtgggcgtgccggtgacgagctcctccgggaggcactcggcgtttaccggtatgtgcccatgacacagctgcaaggaccggcttgacggaacacactgccggactgagtcgactcatatggtggtgtacgcatgggactacaattgccctgtcgtcccttttcctgcgattgttcgatttgactgtcagatggctgccgttctgctgataacgcc

SEQ ID NO: 12479 - DNA, 371 bp, Zea mays
  unsure at all n locations
  Clone ID: cC-zmpo14820007a04a1
attagtgatgtaaccggcatcactgattctgccattctctcaggatagaagaacaacatgcaccaaatacagaggtacagaacctgcaggaatctttatctgatttccaatacgtatgttttgcatacactgaaacgcgcacagaggcagatgcagcactaatctagccagtaaaccaagcacgcacacgcacacgcacgcgcacacacacacaccaagagaccataccatcatacaacatgcagtcagggtttttttatcaacaatctggcgccttacactattaacaggcctggagatctacctgaatgcctgagctgacttctgggtccagccttttcttcacagncttgttccccatggacacagac

SEQ ID NO: 12480 - DNA, 498 bp, Zea mays
  Clone ID: cC-zmpo14820007a04d1
cggacgcgtggggacgaataagccaggcaaaggacgcgcgcgcacgaacggctcgctctctctccgacacccagatccctcccgtttcaggaaacgcgaagattccgccgtccaaccccgagccgctccgctccgtcgattcgggcatggcgccgaaggagagccagcagcagcagagtccggccgaggtggcggcgccggccgcgcggagcatcccggacgaggcgcggcggctgctgcacgagctggccgcggcgtgggaggacgtggccgggtgcgggccgcgcgagcccgaggtggtgccgctcaagggcgccatgaccaacgaggtgtaccgggcgcggtgggccaccggcagcggggactcgtcggcgccggggcagagtgacgcgcggacggttctggtgcgggtctacggggagggcgtcgacctgttcttcgacagggaggacgaggtgcgcacgttcgagttcatgtcgcgggatggccacggacccc

SEQ ID NO: 12481 - DNA, 495 bp, Zea mays
  Clone ID: cC-zmpo14820007a05a1
ccccccccccccccccccccccccccccccccccccccccccccccccccccccccccccccccccccccccccccccccccccccctttctccccttttttctttttttctttttttttaaaaccgccacccttttccccccggggggggaccccccccacccccgggggcccccccccccccccccccggccccggaaaaaaaaaaaaacccccccccggggggggggggggggggccccccccccggggggggacccccgggccttttttggggcccggggaaaaaaaaaaaaaaaaaaaaccccccccaaaaaagggaacccccccggaacaggggggaaaaaaaaccaagccccaaaacccccggaaaaaaaggggggcccccccccccggaaccgggggggcccccccacccccccggggggggccccggggttaaaaaacccgcccggggggggccccccggaaatcccgggccgggcccgggggggg

SEQ ID NO: 12482 - DNA, 535 bp, Zea mays
  Clone ID: cC-zmpo14820007a05d1
ttcctggattgacccacgcgttcgatttctgaaaaccttggcacgacactggtttgttttgggtcagccacacgtttcagttgtcgctgtccctactttgttccgggagtattgagagcttgtgttctgttcacgattgattcaggtgttttcctttgttttgcgtgttttttttcttcttctttttatcgctgagccgatatatatgcactggttctcctctgaatatgggtgtccttcaccaggactcaatatgtgtaattcttttctgtttcctggtcatgattgtctgtaaattgtaaacattgggtttgatggatatcgacactggagtgtaaagtgttggcggttaaaaaaaacaaatacattcaaaaatatttatgaaatagagagaaaacataatgtcattgatcttgtcctttcttatataattaaattatatttttatataaattatctagtaaaaaaaaaatgggggggcggtttttaagggtcccaagttttcgcccctgtgttggcgacgtatttttttttt

SEQ ID NO: 12483 - DNA, 269 bp, Zea mays
  Clone ID: cC-zmpo14820007a06a1
aggaacaatatatatcagtttctgcttacacagattacagatttttcacgagaggctaacacaacatccatgccaaaatacgccattgtcatgagacctcactcagacgtaacgaaggcatgtggtacacttacagccagctggacgacaaaccgagttcacggggagatagatgaaaggagggaataacgaagtcgtagagaaaaagaaaagaaaaatggcgaacgcacacttgagtgtgagaatgtgtcagtgcgggtgtgtctgtg

SEQ ID NO: 12484 - DNA, 578 bp, Zea mays
  Clone ID: cC-zmpo14820007a06d1
gtagcttgccagaaaacagtgtacccgctggagaagttaactctggaaggcgagtcctaccacaagagctgcttcaagtgctcgcacgggggctgcatcctcaccacctcctcctacgccgcgctcaacggcgttctgtactgcaagatccacttcgcgcagctgttcatggagaaggggagctacagccacatgatgaagaagagcccgtcccaggatacgctgccggacatggcagccgacgagcaaccgccggaaccggcgccaccgcaagacggggaaggagaggacaactaggaggaagggaccgccaccaatatatatcacacacacacacacacactcacacattctcacactcaagtctgcgtttgccatttttcttttctttttctctacgacttcgttattccctcctttcatctatctctccgtgaactcggtttgtcgtccagctggctgtaagtgtaccagatgccttcgttacgtctgatgaggctcatgacaatggcgattttggcatggagttgtggtagcctcgcggaaaactggtactgtgtaagcagaactgctatata

SEQ ID NO: 12485 - DNA, 275 bp, Zea mays
  Clone ID: cC-zmpo14820007a07a1
ggtggctaaaccagaaacctattggaactaatggggagtattggcgcataatgctacttaaaatttgctgaactttggctcacgctatggatttagactaccacggggccctacatgaataggctcttatcaaaccggccaacctatcgatgaccggtttgtgttgcgtgctatattaccaaagaaatttcctaggcatcgacactgcgaggggcttggcgcttttctcccaaaaacgcctgaatgcatctctagctaaaccaaatataaagccc

SEQ ID NO: 12486 - DNA, 352 bp, Zea mays
  Clone ID: cC-zmpo14820007a07d1
agtggacccacagcgttctgacacataataggtcatagtcaagcccgatggatacgtgttagttttaaagagtgggtctgccttcggagtgtcatgcacatgcgatggctggtacctgatgaacagagggctacccgctctgctctaccttgttccttcaacactacgaattatcgtcctgcttggatcgaggagcttgtagctcaggcaggtttggaacgccaatgtgtatgccgactgctaggtgcagatatatagctgttatcaagaatctgtttgcaagcttcaaatggcctttaattggggttagctcgccatgcttcctgtggtttttgtttaaattgcgccatgc

SEQ ID NO: 12487 - DNA, 182 bp, Zea mays
  Clone ID: cC-zmpo14820007a08a1
gtcctttttttttttttttttataaataaattaggcacggaggataaaacgagaccattcatttctaaactgggagtatttgaaacaacagggaagtatcactctacctatatatggcgcagaacatgagggcaaacgaggacggcaccatccatgttggggccagcatcaatgccgcaaaa

SEQ ID NO: 12488 - DNA, 567 bp, Zea mays
  Clone ID: cC-zmpo14820007a08d1
acggacagattacacagggcggacttgacagatggatactttgtctgtttaatgattggttatgccttcggattgacaggcacatacataggcttgtacctgatgaacacgaggccatgccaagctttgactctatccttgacaccgttcgaacaacattaggagcttactcagtcactgcattggagacgagagagcttcggatgctctgtctacctctggaacgacaatgtgtcttccgactgctaggcacacgtatattgcttatatgatgacccttgatgcacgctaatacatgccttcacttgtgttaatctaaacatgcatactgtggtctggggtggaatatcgccaggcgtcaatatggtccatgctcaggatatgtatctgttgatataggacacaacgcacaccacacattctattgctggctggatatgaactaaccctctcggtgcctttacacggtacatgattaccccctaggtgatgcaaagttaaagctttttatagacagatctgcgtcattttacttaccgtatcaaagcaacgtttatggtgccaaaa

SEQ ID NO: 12489 - DNA, 192 bp, Zea mays
  Clone ID: cC-zmpo14820007a09a1
attggcggctcaaccaaaacctctttgatctaatcgggattagtgacgcattttggtcctttaaatttgctgacctttggctcacgccatggattttgactagcacaggggcccacatgaattggcttttatcaaaccagccaaccttaggatggccggtgtgtgttgcgtcctctagaaacaaagaaattt

SEQ ID NO: 12490 - DNA, 475 bp, Zea mays
  Clone ID: cC-zmpo14820007a09d1
gacagaacacacagcaaggacttgacagatggatacttcctctgcttaatgattggttatgccttcggattgtcatgcacatacgttggcttgtacctgatgaacagcgggcagccagctctgctctaccttgttccttcaacactaggagttatcgtcctgcttggagcgaggagggggtatctcgggcagctctggaacgccaaggtgtatcctgcctggtaggcccgcatatatagctgatatgatgacactggatgcgcgcttaaacaggcctttaatttggtttatctaaacatgcatacggtggtttttggtgaaattgcgccaggcataaatatgatccatgcttaggaaatgtctttgttgttagaggacacaacacacaccacacatactatggctggatggtttgttactaggctgctgctgttctgtacactgtacgtgataacccctagcgtgatgcaaattt

SEQ ID NO: 12491 - DNA, 236 bp, Zea mays
  Clone ID: cC-zmpo14820007a10a1
gttgggtctaccaaaaccactttgacctaatcgggagtagtgaagctaaagggtatttacattttgctgaaattgagcccacgccagggacctctacctccaatgtggcctacagggccaggcttgtaacaaaccagcccgccttcgtatagggggggggtgtagccccccctaatagcaaagaaatggccccccacccactctgcctgagctgggtacaaattgctgaaaaacca

SEQ ID NO: 12492 - DNA, 448 bp, Zea mays
  Clone ID: cC-zmpo14820007a10d1
acccacgcgttcgttgacatgtggtgaggctggctagtccaaaagctcattgttcgccttccagcatatccttaccaaggaagggcccaggtccctgatcaagggtgctggtgctaacattcttcctgccattgctggctctggtgtgccttctggctacgagcagatccatatccttttcttcagaaagaagtacggctccggaggtgcttaaacggagaaaaatgatgacgaacaagagcagttcgttcccggtccattcccactcaggatctggtcaagtatgtgcctttcatatccgagaaattaatcatgtatgtaggggaatctgtccaacattcgattggggcggagacattgatttcaaaacactcgtatctgttctactaggtggtggcatgggtcctcaaaacatgggcatagggtgtggctagtctgcccttcgttg

SEQ ID NO: 12493 - DNA, 248 bp, Zea mays
  Clone ID: cC-zmpo14820007a11a1
gttgggcatgaaatttaaaacatgtatatattttgaatggaattattgatccacactaggagaaagaataagaaagctcgcagattggcaaaggcctcacaaaacactggctacagtgagaaaaaaagaggtgactaatagcgagtgatggatccaagtaggtttagactcaggagagctccttcgccatgccaaaggacttgccgagggcaatcttgcagaccgacatggtcttgttggcagacctg

SEQ ID NO: 12494 - DNA, 364 bp, Zea mays
  Clone ID: cC-zmpo14820007a11d1
cggacgcgtgggcggacgcgtgggcatgaacatcttcgggagcaagaacgtggagatcgacaaggtgacgatcaaggcccccggcaacagccccaacacggacggcatccacatcggcgactcgagcaacgtgaccatgagcgggaccaccatcgccgtcggcgacgactgcgtctacatgggccccgggagcaagaccatccgcgtgaagggcgtcaagtgcggcccgggccacggcatcagcgttggcagcctggggcggtacaaggacgagaaggacgtggaggacgtgaaggtgacggggtgcacgctagtcggaaccaccaacgggctgcgcatcaagtcgtaccaggacttcaagttg

SEQ ID NO: 12495 - DNA, 288 bp, Zea mays
  Clone ID: cC-zmpo14820007a12a1
atattactatagaaaaaaagtcgagtacatgcatattatgtattttctgctgggagtaaaaggtgttgtaaacccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggc

SEQ ID NO: 12496 - DNA, 572 bp, Zea mays
  Clone ID: cC-zmpo14820007a12d1
gtcctcgaccatccctgcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggagccccctgcgtggccaagctcgtcaaggtcgtcgcagcgcggccgtactctgtgtccatcatggagatcagcgagcccattttgccggccgcgttgccctcccccgtcgcggcgcccggccgtcgcggcaagggt

SEQ ID NO: 12497 - DNA, 304 bp, Zea mays
  unsure at all n locations
  Clone ID: cC-zmpo14820007b01a1
aaaaaaaggaaactagaattgagcactgtacattaacacgtcgatcgtatgtctatacacagggtcccagcaaatgagttagcttatacagntatacatatctgaatatctggaattgatctccctccacgtcaaattgaactcttgttccacacacacacaaagcaaaaactatgtaatatttttcttggctaaatcggagggctatggcatactatatcctctacaaagcgtaacttgcgacccacattttaaacatctagaacctggcagctgacaagctcagccagcccaaagttcctag

SEQ ID NO: 12498 - DNA, 359 bp, Zea mays
  Clone ID: cC-zmpo14820007b01d1
gacgtttatgcgcgcgtccgacgcgttggatcgtatctaggggacggctgagcttgttagctgtcatgttttagatgtttaaaatgtgggttcgtatgttacgctttgtagaggatatagtatgccatagaccaacgatttagccaagaaaaatattacatagtttttgctttgtgtgtgtgtggaacaagagttcaatttgacgtggagggagatcaattacagatattcagatatgtataactgtataagctaactcatttgctgggacactgtgtatagacatacgatcgacgtgttaatgtacagtgctcaattctagtttcctttttttgagaaaaatccccctgacccggtat

SEQ ID NO: 12499 - DNA, 318 bp, Zea mays
  unsure at all n locations
  Clone ID: cC-zmpo14820007b02a1
aaaattaaaaaaaaaagcatttttaaagagcagaagtagcagtacatctgcatgcatgcagatttaggcccatcaaaagaagcggatcgaacgtttgcttacgaggccaggcccattatcgctgccctcgaatgcagggcatagacatacacaatacaaaaaacgcggaaggcagctaccatcttcaattcttgggcgagcgggcagggcagcaatggatgcaggcatgcacaggacggaggacgatcatggcgnctcggagagcgccttgagatcgnacttctagaggagggcgccgcactccttgagcgggtcctt

SEQ ID NO: 12500 - DNA, 506 bp, Zea mays
  Clone ID: cC-zmpo14820007b02d1
tctccctctccctctccgtcccccaagcaaagaaaagaagctagctagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgctggcccggagccccgacccggtgtgcgcggagatcgaggagttccgtgaccgcgcccgcgttccgttcacctccacaacgggatcagcagcaggggggtcggtacgcca

SEQ ID NO: 12501 - DNA, 564 bp, Zea mays
  unsure at all n locations
  Clone ID: cC-zmpo14820007b03a1
caagacgtcgcaagcacgcagacagaagccaggatcccccagagcggccagcccccccccccccccccccccccccccccccccccccccccccccccccccccccccccccccccccccccccccccccccccccccccccccccccccccccccccccccggcccggaaccaggcccccccccccaaaaaaaacccccccaccggaaacccccccgggccccaagggggccccccccccaaatcgggggcgggccccccccccccccccccctggaaggaaaggggggggcccccccccttttttcaaaacaaaaccccccccccccccctttaagggaaggcccccaaaaaaccccccccccccccctttaaatggcaagggcccccccagggggccaaaaccccgggcccccccccggggggccccccacccacccggcgggaacggcaattaccccccccccggtgaggaaaagaaccccctttggccccccccgaaattaacccgcccccccaagggggganncctaaaaagaaaaataagacccccccccccccccg

SEQ ID NO: 12502 - DNA, 509 bp, Zea mays
  Clone ID: cC-zmpo14820007b03d1
acggcatgtgcggcaacttcactgtaggcacttgccacactcccaatgcaaagcaaatcgttgagaaggaatgcctgggcaagccatcctgcatgctgccggtggatcacacagtgtacggcgcggacatcaactgccaatcaacgactgccacgctaggggtgcacgtgagatgcggaggcggcaagaagggtgcctgagaacaagacggatgctgctaattgacgtttcagctcgtttgtttgttcgtcccttcggtttggcactgatgcttatgacccattggtctgccattgcaattgaaatgtggctggaacgtgcttgatcgggaactaacatgaaatgagtgaagggtagatgctgatctgaaaaatatgtgtgtacccccctctttccttccatgtcgtgttgttgcaggtaaccgtcacaatatatataggtggcccactttggaatccggcgaatattacgtttgctgtatttttttctgtgaaaatgaactgattcct

SEQ ID NO: 12503 - DNA, 229 bp, Zea mays
  Clone ID: cC-zmpo14820007b04a1
ggagtcggagagcgggggccggggcgggggcctcggcggctgcggcggacgccacgagcgcggcggccatggcggcgacggcgacgaacttcatcctgaggccggccatctgcgagtgagtagagcagctagcgtgtcgggtttttattgggccgaggggatctctctacgagagtatgaagcagtagaagtgtagagagatgcgcgcaggcgacgggctggctcgagc

SEQ ID NO: 12504 - DNA, 251 bp, Zea mays
  Clone ID: cC-zmpo14820007b04d1
ttgtgggttgacccacgcgaccggttcgagccagaccgtcgcctgcgcgcatctctctacacttctactgcttcatactctggtagagagatccccgcggcccaataaaaacccgactggctagctgcactacacactcgcagatggccggcctcaggatgaagttagtcgccgtcgccgccatggccgccgcgctcgtggtgttcgccgtagccgtcgaggcccccgccccggcccccgccttcgacgcc

SEQ ID NO: 12505 - DNA, 299 bp, Zea mays
  unsure at all n locations
  Clone ID: cC-zmpo14820007b05a1
cattcagataattttctcatgttattatcgttacatagtcaagaagaaacatagncaagaagaaacggattgcaagaatgcaatggaaagaagggatccctcttttacaataaaagggatcgtattttgagaggcaccggtaacccaaacccgcgtcatcggtcaggctcaagctgacccatcgncgncggaatcagaatcancgccggacgatggagctggggcgctggaggagccatcagaagatgggnctaggtgcggcggaggactcagacgacgacgatggcggctggtgcgct

SEQ ID NO: 12506 - DNA, 460 bp, Zea mays
  unsure at all n locations
  Clone ID: cC-zmpo14820007b05d1
aggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatcacccngcggaaagcnaaactcatccggtccctgtagcgcaccatctccattcgttggcgtctgagccctacgccgaaccaggcccatttattgatggcacctccagcgccccaacaccatcggtccggtgaccattctgattccgacgacgatggggtagcaagagcct

SEQ ID NO: 12507 - DNA, 388 bp, Zea mays
  Clone ID: cC-zmpo14820007b06a1
gacatgcacctcctcccttaccttggctcgtatcctgtggaccgcccgtcctttttttttttttttttttttttttttttattgtcgaatgcaacggtgattcagaaaaaggaaatccgatttacagtccacctggccaaggaagtcatcatattttttacttaatatcgagatgggcacagcacaccagaatacatgattggggacttctctttgaacgacaattcaatgttcaaaggcccccaccaaggccttcacccgggttttcttctacacgaggagctcgatttgggtttcctgaattacgaaattgccctttggatcaaccttcctgcatacctgagccatttaaggacttcggcactgtcttatccacactccggtcagc

SEQ ID NO: 12508 - DNA, 301 bp, Zea mays
  Clone ID: cC-zmpo14820007b06d1
gctgaccggagtgtggataagacagtgccgaagactgaagtggctcaggtatggaggaaggatgatccaaagggcaatgacgtgattgaggaaaccaaaagcaagctcctgctggagaggaagagccgggtgaaggccttggtgggggcctttgaaactgtattgtcgttcaaggagtagtcctcaatcttgtcttctggtctcttgtgcccatctcaatattgagtaatatatatgatgacttccttggctcgttgtactctatatcgtatttcctttttctgaatcatcgttgcattcg

SEQ ID NO: 12509 - DNA, 417 bp, Zea mays
  Clone ID: cC-zmpo14820007b07a1
gggggggaaaaacgaaatggggaaccgggcccaaaaaaagggaagccaagggcccggggtgcaccccccccccggggggaaaaacaaaaaaccggggcccaaattaaacggggggcccagggaacccaatttgtttaaagaaaaatcagggaaaagggggggggaaaaaaaccaaccaaagggaaacccgggggggcccctggcccccccgggcccaaaaaaagcccccccccccccctggaatgccccggggccaaaaaaaaagccaaggcaaccaaatttttcccccccccctggggttttccctccgggtccgggttcttgtccggggggttaatgaaagtgtttccccaaaaaagggggccccgggggccccaaaatggggggggccaacccgggggaaccccttgggggaaa

SEQ ID NO: 12510 - DNA, 542 bp, Zea mays
  Clone ID: cC-zmpo14820007b07d1
ggcaagcgatcgtcggagcagagagagacttcctcgccttcatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaattttggtgccctgttattttgtcctttccctcgagtgagggatcgacacct

SEQ ID NO: 12511 - DNA, 189 bp, Zea mays
  Clone ID: cC-zmpo14820007b08a1
aaaagaaaattgggatcttcataatgttagcttagagcaaccagtgccggacaaaccctttgacaattcccacttcctggaaacgaacgaacaaactaacaattagccattcgcatgccacgcaaaaaaaaaaaaaatgggtggacgctcacgattttaaaccccccccgttcatggactcctgggtga

SEQ ID NO: 12512 - DNA, 368 bp, Zea mays
  Clone ID: cC-zmpo14820007b08d1
gcgattggctaattggttgtatgttcttccgttccgcggacgaatgaattgcctaagggatcgctctgtaatcgtgactcgacgtctatataatgttgatccaaatcatacttttgataatactgctgttctgaccaaacggctgctcaactcaggaatccctgtcggtgggccgtgttaaagcatccaagctaagtttccgccccttgtaacgaactaaatattatataccgaggcctagtttgaatacactgactgtatctttacaatcgtttaccactggaaaatctcgggtgtaacccagattaagcctctttcacaatgtgccattaattccaccatgccctaggacactatagctccgtacc

SEQ ID NO: 12513 - DNA, 296 bp, Zea mays
  Clone ID: cC-zmpo14820007b09a1
gccaccaaaaggaacaatgtataaaattttgggaagaggctccccgccaaaccaaacaaggaaggggccgacaaggggacccctgcccacacacgaatggtttgtcccaaccggccactgtttatctgggggggggggggcgacctcttggaaaacttggcctgcacggagagcggggcggtggtgccggaacacatgagttcccccccgaaaacctggggggccacgggcagggtgaaaaaccgcttggcgggggacgccttttcaaccacctatttggcccgtgagggtggggc

SEQ ID NO: 12514 - DNA, 535 bp, Zea mays
  Clone ID: cC-zmpo14820007b09d1
ggcgtgaaccacgatgccgacttggcatggaggatggcaatgacggacaggggcgcttacatggagcaccgtctggcctacatggacaggttgcacatcactgacctgaacgcgggcacgctggaccatgcgaatattcggctgggtgccacatccgacggcctgcttttgtggagacagagggcaagatctactacaagagcactgggtctatggcgcacgccgtgcactctgttaacgctcgggccggagaatcgacagtgcacgcatcacactcgctacaacgaggcacgttacacatgctgtcgggagaggacccggacgtgctggaaatgagcacgatggtcatgggcatgatgtcacggcaacgggcagggcattcgccgctactggatattgtacgagcacgccctaggtcggccatcgcaacagctttaccacgtgccccggaccttcctgcggcagaaggacaagatgctggtgctgatctaggaggagtttaggcggtctggcgctatcatgatcctgacggtga

SEQ ID NO: 12515 - DNA, 341 bp, Zea mays
  Clone ID: cC-zmpo14820007b10a1
accatagaagccgcaatagcattaccagagaatcataatgtaagcataggcttctagtcatataatccatagatatgctagcattaatttcctgttagaaaatgcagacattactattaactgcaaagaccgacacaaagatttttaatcgcctccgagttgtttggatcgctgagaacatatgatgcggtctttccagtgctttcacatgtcagatttagttggtttccgagctgtgaagacatacagtagttatttggtgcgttgcaactccactttgaagtaggcacacagctcatataatggcaccaagaacagtgctcactagcattgaacccttg

SEQ ID NO: 12516 - DNA, 376 bp, Zea mays
  Clone ID: cC-zmpo14820007b10d1
caagggttcaatgctagtgagcactgttcttggtgccattatatgagctgtgtgcctacttcaaagtggagttgcaacgcaccaaataactactgtatgtcttcacagctcggaaaccaactaaatctgacatgtgaaagcactggaaagaccgcatcatatgttctcagcgatccaaacaacttggaggcgattaaaaatctttgtgtcggtctttgcagttaatagtaatgtctgcattttctaacaggaaattaatgctagcatatctatggattatatgactagaagcctatgcttacattatgattctctggtaatgctattgcggcttctatggtgaaaagaacactcttacgcttactcgataaatgac

SEQ ID NO: 12517 - DNA, 293 bp, Zea mays
  Clone ID: cC-zmpo14820007b11a1
attgtgtatctatttttgtttgggggggggcgaccgaaccctaaaatagaaaaaggggggccgaaataaatagtgaacacctcaaatattgcaaacaaaaaaaagtagttgccctggataccgttgacgaagcagcaccaagggaaaaggggggggggtaaaaaataaaaaaaacggggaacaaaaactaagggctgtggaccgacacccccctgaaaaatttgaagttggcccccatttcccccaaagaattgaactacccccacaagctgaaaatcatgttcagccctggg

SEQ ID NO: 12518 - DNA, 470 bp, Zea mays
  Clone ID: cC-zmpo14820007b11d1
agacccacccgtatcggctccgatgggatggtgtcattcgacaaactgatcatctgctaaggtactgggcaactgcgataagaacctgggccccgaggcctcccgcccacggaaacccgccaacgactacacccgccggtgcaacccgatcagcggctgggggggatgatcatatctctctggtcgatgtgcgcgcaatgtcaatgacgtacgcgcgtgcatgtaccaggccttaacgtgaggtgccgagtgtgcgtatatattacacacatgcgttatacatcggccgccgatcgatactgaatgcatggcaactgatgtatattgcttcgcatatgatgggcgcctactgagaggatgggctcaacttgtgatgattaatggatgagcttgacacccaatccaccatggccgacgaggcgcttgctgtggatgaggggcccaaggttgacgaaccactcaaaatcaaa

SEQ ID NO: 12519 - DNA, 349 bp, Zea mays
  Clone ID: cC-zmpo14820007b12a1
gaatcaagcactctgttacatttttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtaaccgagcgggttggcggggcgcaggctgtcggagatgccgacgttcctggtgagcaggacgccagcgcggtccctgagcgcctggacctcgtcgcagtccttgcgcgggctggccaccagcaccacct

SEQ ID NO: 12520 - DNA, 486 bp, Zea mays
  Clone ID: cC-zmpo14820007b12d1
gccaccctcgtctcaccctccctccctcacacaaataataaggaatggtcccgcccttttcctacgacatccacaggggggaggggaaaacacgtgcattcacccggcggcaataatggcctaggctccggctccggcgacgacgaccgccgtcgtaatcctatgcctatgcgtcgtcctctcctgtgccgcggctgacgaccccaacctccccgactacgttatccagggccgcgtgtactgcgacacctgccgcgccgggttcgtgaccaacgtcaccgagtacatcgcgggcgccaaggtgaggctggagtgcaggcacttcggcaccgcctagcttgagcgcgccatcgacggggtcaccgacgcgaccggcacctacacgatcgagctcaaggacagccacgaggaggacatctgccatgtggtgctggtggccagcccgcgcaaggactgctacgaggtccatgcgctcagggaccgcgc

SEQ ID NO: 12521 - DNA, 282 bp, Zea mays
  unsure at all n locations
  Clone ID: cC-zmpo14820007c01a1
cacacaatattatccgtatttcaattgaatttgaagagaaaatatgaaaaagaaatttggaacgagcaatgtccatctatatccggttacattcctgagggtgactcattgccgncacctggggttgagattgattgttgagcacatccccattgttttcataccttccgaagcaggattccttctaatcatttacccgtagatggcattcttgcctgaaccaagagatccagcgagcgtcgctggcttcttgttgcctcgggtctcttccttctgcatgcc

SEQ ID NO: 12522 - DNA, 443 bp, Zea mays
  Clone ID: cC-zmpo14820007c01d1
ctacgcgtcgcgtggtccaagccggacaacagtaaaatggcccaatgtaagaccatcgtcgcagcagtcctcgtggttgctctcgtggtttcgacgatcccagccagcgccgatacgaacctggaacctgcaggaggctctacggagggcagtgcccgcacctccggcatgcagaaggaagagacccgaggcaacaagaagccagcgacgctcgctggatctcttggttcaggcaagaatgccatctacgggtaaatgattagaaggaatcctgcttcggaaggtatgaaaacaatggggatgtgctcaacaatcaatctcaaccccaggtgacggcaatgagtcacccacaggaatgtaaccggatatagatggacattgctcgttcccatattcttttcatattttctctgcaattcaattgaatacggatatattgtgtg

SEQ ID NO: 12523 - DNA, 353 bp, Zea mays
  unsure at all n locations
  Clone ID: cC-zmpo14820007c02a1
ggggacaacccattgggggggaattggggccaaaaaagggaatttacattggggccctttttttggtctcccggtccagggggggggccaaaaccccaactggttggggggcaaaagggttaaaattcccccccccaaaaaaaaaaagaaggggggtgggcccgggccccccgaaaaaaaagggggccccccctggccaaccccgggggggggggggggggccccaacccccgggaaatgaaagaaaatggggggggnngaaacccaaacaaanaaaacccccttttaaattttggccaaccccccccccccctttgggttaaaaaaaaccccaccagggtgtgggggccccc

SEQ ID NO: 12524 - DNA, 264 bp, Zea mays
  Clone ID: cC-zmpo14820007c02d1
tattgataccgtggtgttggagtttaatcagtacacgccgggctcaaggtggaggcaagcgttggtgaagcggatggagcatatggaggagggcagcgagggccacgggtactacggaggcataaggaagctccgcggcaaggatgacatctacaagtggaggcagatgtggccaacagacaaaatgaagttagcaggagccgcatcccttcttacaccgagattgagccatcgctcaaacgacactgcctttctttcatcata

SEQ ID NO: 12525 - DNA, 342 bp, Zea mays
  Clone ID: cC-zmpo14820007c03a1
gtgttaataggatcccaactattcaaccatataatgttttgccatagcacataacagtgctggcacatttcttgtaaccaatttttgcacaggtattggacgctgacacagcagctagcacaccacaccatcaacggatgcaacatgaggccgggggatatatttgcgactggcacactgagaggacctgtatggagtaaacattgcaacttctatacccatagtatgaatcttactttgacatgagccatttcaagaaccggactccctcgggtgtctgctggagctgacatggaacgggcagaatgagataccggtggggaatttgacccgcaagttcct

SEQ ID NO: 12526 - DNA, 567 bp, Zea mays
  Clone ID: cC-zmpo14820007c03d1
ggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaaggacgagaaggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacattcacggtacctccaacacgccggaggccatcacgctcaactgcgccaacaacctgccctgccaggcgtgcagctcatcaacgtcgacatcaagtacaacaggtccgacaacaag

SEQ ID NO: 12527 - DNA, 440 bp, Zea mays
  unsure at all n locations
  Clone ID: cC-zmpo14820007c04a1
aaggactgcagaaacgcttttcatagccctgcattttatcaaaagtagttttgtttctcgtagccatgagacccatcaaatcaaattaatgaagcacccatcaacaatttgcaggaccgatgaactagcaaggcttcttgcagaagcacttgcgcgtggccacgacctgcttgcactcgccaccgggaaagctctccttcatgcacacatcggcgcatctgtcgctgttgaagcagaagccctcgaacaggagactcggcgataagcattgactctcttccttctgcgagcttttctcctgcttcttctccgtctcctgctgtttcgctttctccattatcaatgcatgcatgggcatggctactcccattttggcatcgatagatcccacctttggtgcgacgaggagaaactagaattggacagntncctgagacact

SEQ ID NO: 12528 - DNA, 535 bp, Zea mays
  Clone ID: cC-zmpo14820007c04d1
tgaccacgcgtccgtgcggtggcacccacccatcaaggatggggccgccagcaggttcatccgttcctgttcttgctaaaacgagagaaggatggcagtgtctcagggagctgtcctattcttgtttctcctcgtcgcagcagaggtgggaaccatcgatgccaaaatgggagtagccatgcccatgcatgccttgataatggagaaagcgaaacagcaggagacggagaagaaggaggagaaaagcacggagaaggaagagagtcaatgcttatcgccgagtctccagttcgagggcttctgcttcaacagcgacagatgcgccgatgtgtgcatgaaggagagctttcccggtggcgagtgcaagcaggtcgtggccacgcgcaagtgcttctgcaagaagccttgctagttcatcggtcttgctaattgttgatgggtgcttcattaatttgatttgatgggtctcatggctacgagaaacaaaactacttttgataaaatgcagggcatgaaaagcgattttgcagtcctt

SEQ ID NO: 12529 - DNA, 275 bp, Zea mays
  Clone ID: cC-zmpo14820007c05a1
gcgctgcgctgcaacttggttgattaaacgaacaatgggggactattgcaagaatccagcactctaaatttgggacagccacgcaggtacatttttggtttcctttcctttctcaggtacatatttggaatccaggggaagaggatttgggggttaatgccagccagtctgcgacgactgggggcgggcgtcgacgacgtgctttttcatttcgatcggcggcgtcgatgtgcttttactgatcggcggcggcggccgagtcccactgtttgagc

SEQ ID NO: 12530 - DNA, 586 bp, Zea mays
  Clone ID: cC-zmpo14820007c05d1
caacgacctccccgactacgtcatccagggccgcgtctattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatctgcgaggtggtcttggtggagagcccgcgcaaggactgcgaccaggtgcaggcggacagggaccgcgccggcgtcctgctcaccaggaacgtcggcatcagcgacaacctgcgccccgccaacccgctcggctacctcaaggacgtgccgctgcccatctgcgcctcgctgctcaaacagttggactcggacgacgacgacgatcagtaatagcacatcgacgacgacgatcgatatgtaatagcacgtcgtcgacgaccgaccgcagtcgtcgcagactggctggcactaaaccacaaatcctcttcacctggattacaaatatgtaactgagaaaggaaaggaaaacaaaaatgtaactgcgtggct

SEQ ID NO: 12531 - DNA, 360 bp, Zea mays
  Clone ID: cC-zmpo14820007c06a1
gtcctttttttttttttttttttttttattttacttttttttttttttttttttttttatgtttttgggaaaaagggcaaccacttaacccaactcaacccttttaactcggaccccggggcgagccccggaatctcgcgcccgtcccggtagaggccccaaatttccctatggacgagccatatcaaaacttggcggaagaatgggcaaaagcgctccctgggggaaaatgttatccgccgaccagtcccgacactatacgaccctgaagcaaaaaggggaaaggccggggggcctaatgggggagccatctcagattaattgcgcgggggtctcggcccgcttaccaatagggaaacc

SEQ ID NO: 12532 - DNA, 324 bp, Zea mays
  Clone ID: cC-zmpo14820007c07a1
aatatcaatggccaactgctatcatataattgatgctgcaattagtcacattaatgtatttccgaatccgttgcatgattgttggattaccaattactcatgtcataaaagagaaggagaccaggtggtgcgcgcagagttttcaatggccgatcgagtcctatcaatggtcgatccgctgcacgtccgcatgcatatgcatgagccggccattaccattaggtagctataaggaagatacggatgggatcaccgccggtcggcggcggcgtggcgcgggcggaggatccggcagcgctcggagaccttgtgtggaggtagagg

SEQ ID NO: 12533 - DNA, 594 bp, Zea mays
  Clone ID: cC-zmpo14820007c07d1
cgcagatacaccggccggcagcaaccgccctatggatacgtcggcggcgatgacgatggaccaccaccgcgcggcgccgtcgctgtccacggaagagaagcggcggatcgagcgggtggcgcggtgcgtggcgcgggaccgggacggcggggacctcacggagaagctgctgctgcggctgctcggcctgacgcgcaacgcccgccgatgggggttcctcgcgccggaccacccgctccacccctactacctccagcacaaggtctccgagcgctgccggatccttcgcccgcgccacgccgtcgacgaccggcggtgatcccatccgtatcttccttatagctacctaatggtaatggccggctcatgcatatgcatgcggacgtgcagcggatcgaccattgataggactcgatcggccattgaaaactctgcgcgcaccacctggtctccttctcttttatgacatgagtaattggttatccaacaatcatgcaacggattcggaaatacattaatgtgactaattgcagcatcaattatatgatagcagttggccattgatattaaaaaaaaaaaaaaaaagggcggccg

SEQ ID NO: 12534 - DNA, 377 bp, Zea mays
  Clone ID: cC-zmpo14820007c08a1
gaattgatactagtttttttgtatggaagttacatcctcaaaattcccgaaccgcggaaaccgcgggaggctcgcacaatgcataactaagcaacacaacatgtaggtacacactcacttgatccgaaacacgagagggcacaaaaaaaaaccctacagccgccccaaccgcacggaaaaacacacacggcaacgaacagcacaggactcccccgggcagcggtggacacccccggggtccggagaccagcgagaacagccccatcaccggcgccagagatggtgggctagaccccggagaagactggagccaggtatacctggcgacctttgaaggcctgcccgccgagcggggaccgaatgatagccctagctgc

SEQ ID NO: 12535 - DNA, 588 bp, Zea mays
  Clone ID: cC-zmpo14820007c08d1
gacagcggcatctaccacctgggcggcggtggcggtggctgtggggcgggaggaacggcggcgaatgcgggcgaaggctccctgccgcagctccggtccgcgctgtcggccttcttcaactcgccgcacccgctggagatcctcaaggacggcgccgcgtacgggccccggggctccgtgtaccgggaccacgacgtgaactcgtacctccggtccgtgcgcgccgtggtccgcaaggaggcccggcgcgcgcgggaggccgagcgggagcgctggcgcctgctcctctggtggccgttcggcgtgcacggcgtgtcgtcggcgtcggccccggggcggcgcgggggcctcgtggacgccgacagcgaggctgccaggcgcgcgcatctcttgctggtggtgctgctgcccgcggagctgctcgctctcggcgcgctcctggccgacattaggttcaggtgattagataagctctcacgcgggttcatcaatccgctcgtacgttcgtacgccgtcgacacgcgctattcttttgtaccaaacacacacttacacacatacacgttttgcaagcaaacgcgacgttgc

SEQ ID NO: 12536 - DNA, 391 bp, Zea mays
  Clone ID: cC-zmpo14820007c09a1
gctggcagtttgatgattagatgaatagaactaagtttattgcatggaagttacacctcagcattcccgtacccttgtatagcgtatagctgtacaatgcagaattaagaacacatcatgtaggtacatattcacttgatccgatacaccagagttcacaaaaaaaaactctgttgccaccccaaaacccacataagtacacctaaggaaacgaagaacacaggactcctccggccaccggtggacgccgtcggtctccggagaccagcgagatcagccgcatcaccggcgctagagatggtgggctagtccccggagaagactgtagctacgtatatcttgcgacctttgcgggcctcctcggtgagctcggactgcatgctagtccttg

SEQ ID NO: 12537 - DNA, 449 bp, Zea mays
  Clone ID: cC-zmpo14820007c09d1
gtcagtgacgcggacccggagctggtcgttcgtggagcggtcgttctcactgctgctcttatgcttcttcgccgggcacctgttggcgacgtgcatagcggtgtactccgactgggacttctgccgcatccaggggatcggctgggcgacgggcgccgccatctggatgatcagaatcggcacctacatcacgatggaattgctcaagtacatgatccgcgccgcgctgaaagacagggccgtaggcgacaacaggcacaacaagtgatacgtttctctggatgctcgtcgcgggctgagtttaggaacaaggactgcggcaagggccgtcgaacgcgaggcacagtgggccgttaactatatacactccactggcctcataccagcttgacaccacctgcttctccgaccttctagggaacatggtctagcatgcggaccgagctcac

SEQ ID NO: 12538 - DNA, 308 bp, Zea mays
  Clone ID: cC-zmpo14820007c10a1
gccaacatgcaaatcattttagaactgaccagatgcagaggcaggaattctcgaggcgggctacacaagtgtgcaccgggcactgcaatgcccaacaacaagattgtagcagcaaacatggaatagaaaggcgcggggggcaaggcaacagttccgaatgacgagttaccgcggtttacaatcttactgatacccaaccgtagggaaccccccctagatcttgtcgagcttgtctgccttcaccaccggattagccttggcaatggcgtccctggcagcagtccggtaggagaacttgcagtcgtgct

SEQ ID NO: 12539 - DNA, 510 bp, Zea mays
  Clone ID: cC-zmpo14820007c10d1
agcccaccgaattccctgcgattcctctcccctcgccttctcgtctccccctaggggatcgtcggagaggaatcgcaaagagggccgtctcatccgagttaaggaagccatggagcacaaggaggctgggtgccaggccccctagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgctgcccaagttgagttgcaaacaatgaacgtgcagcagcccgctgatgttgccggacccagcgagggggtggcggcgatctccaaaggggggaaggtagggccgaaccggtgcagcgcctgcaggacgaaggttggacttacgggattcaactgccggtgtgggaactt

SEQ ID NO: 12540 - DNA, 373 bp, Zea mays
  Clone ID: cC-zmpo14820007c11a1
gaacgaaagtttgtttcctaagaatcccttgcacttcatttccagggaaaatattgccttagcaatatatagcaaaaaaaattattgcctatcaaggggaggcgggaacagggatcttgcaccttgacgctttatgggggtagtaaacacatgcaaacgtcaatacatagaggccgtaccgagaaactaatacgcacgcctgcccacgccaaaaataaatcaacaattttgcacacccccgcaatggacatgtaagtgattgggtgcgcatgccaccttatatattggggctaaatttattctggggccaccaactctccatagagcttaataaccctggaacccaggacgaggcggccatgcgtttttgggg

SEQ ID NO: 12541 - DNA, 106 bp, Zea mays
  Clone ID: cC-zmpo14820007c11d1
catagatgcccactgcgaacgtttgtctaacgataatgtgacatctagtctgactaatagaggcagaagttcttagaggagagtttaaaaaataacaaaacaccga

SEQ ID NO: 12542 - DNA, 288 bp, Zea mays
  Clone ID: cC-zmpo14820007c12a1
attccatcaggcacttattatataactggtcaatccatttcttaactcttgtctctgaaacaacagcgaagtctcactctagctatatatggagatgaagaagatggcgaaggaggatgacaccatcattggtggcgccagcatcactggcgtaatagggtagtggtagcaaatagacatcacggcccaatgcatgcatgtgcaatgcattgcttgggatccaacccaagctagtatagctagcgtaggtcagcttaaagtacttgcagcactaaagccaattattgg

SEQ ID NO: 12543 - DNA, 520 bp, Zea mays
  Clone ID: cC-zmpo14820007c12d1
cccaagtcccctcaggcaagaacattacggccacctatggcaaggactggctggacgctaaagcgacatggtatggcaagccgacgggtgccggtcccgacgacaacggtggtggttgcgggtacaaggacgtgaacaagccccccttcaatagcatgggcgcatgcgggaacatccccatcttgaaggatggtctgggttgtgggtcctgcttagagatcaagtgcgataagcctgtggagtgctccggcaagcccgtggtggtgcacatcacggacatgaactatgagcctatcgcggggtaccactttgatttagcacgcacggagttcggcgccatggccaagaagggcgaggaggagaagctgagcaaggcgggcatcattgacatgcaggtccgaagggttaagtgcaagtacgactgcaaggttaccttccaccttgaaaaggggtgcggacccaactacctggcactggtggtcaagtacgtttacggtgacggtgacattgtggcagtgga

SEQ ID NO: 12544 - DNA, 330 bp, Zea mays
  unsure at all n locations
  Clone ID: cC-zmpo14820007d01a1
ctcccaacggggaaacaaaatccctancaccccccgggccccccgggagacccccaaccccccccaccgtgccaagaggcccccccccccccctataatttttggggagcgagcacctttggggccagaaccccccccccccccccgagaccccaaaagggatcaaaaaacgggtcgctcccccccccctttttggggcagagagagaaagcccgggtcggccaagccccctcttggaaaccaaaaaaaaaaacccccccccccccttttttcccccaagtcccgggccaaaaaataagcgggggccccccaagaagacccccccccccc

SEQ ID NO: 12545 - DNA, 179 bp, Zea mays
  Clone ID: cC-zmpo14820007d02a1
caaaaaaaacccccggggggggggattaaccaccccccggggggggaaaagggggaccccccggggggggggtgggaaaaaagggggacaaacccccccccccaaaaaaaacggggggcccaacggggggggcgccctttctgggcccgggcgcaccgggcggcgcgcacatgaccggg

SEQ ID NO: 12546 - DNA, 306 bp, Zea mays
  Clone ID: cC-zmpo14820007d02d1
aatttatccttcttgaccttcacatttattatgtgcagccatgggtgcctgagcaactaagcctaagacgctagaggggaaagccccagctgaggccaccatgttcacacccaaggtagcacctgagaccactaccatccacattgaggacgcggcaaaacatgcagcaatcgagaacgtggtggaagacaaggaggaggcactaacactggcggccaaacaagagccagcacccaccatcgagcctgagcagattgctagtgaggagaccacctcggatgcggcggtcgccgatgccgagcctga

SEQ ID NO: 12547 - DNA, 352 bp, Zea mays
  unsure at all n locations
  Clone ID: cC-zmpo14820007d03a1
aaagcccaaaaaaaacaggggggttcaaaaaaaaaacccggggggggaaaaaagggggggcccccggggggttgttgggccccggggggggccggggaaaaggggttctcccgcccctgggccaaggggagaaaattgaggggggggcccctgggggggacccgggttcccccccggaaaatggggggtttttggccaatttttttaatggggcccccggcccgggcaggnaaaaaggtttggggggccagtttttccttccggggccccggggggggttttttccccccccccgggngnagggggccgggggggggggggaacccttcccctgggaggggggggggggggg

SEQ ID NO: 12548 - DNA, 625 bp, Zea mays
  Clone ID: cC-zmpo14820007d03d1
ccacgcgtccgcacctactcttcccccgccgggcaacaactcatccgccgcaacctccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcacaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgtcgtcgagaccacgacgacggtggaggcgaagaaaaacgccgaggaggccgggaaggagaagctggcgcagcaaagctgatcgactgtccgtgcatgcgtgccaattaatataattggctgatgatgcctgatgttcaatgtgtgatactgtgatcatagcaggagacgacacttgaattctctacagtttggcataggtcgggagagacactcttgaccgccacaccatgtaacaaac

SEQ ID NO: 12549 - DNA, 293 bp, Zea mays
  unsure at all n locations
  Clone ID: cC-zmpo14820007d04a1
agtacaagatgtagtaataatatattacacacacgtacatatttgccgcccatccaaatccgatgtatataggaagaggagtatgtgcccgaccgggccgctgtctactagcacgggtggccgacgatgcacttgagaggtccggcgaatcgcgagagctgaccgacgttgcggccgtgcttggccgggatgaagtcgaacctgtcgnacttgcgctcgttctggccgccggactcgntgaagaatgcgccgatcatcaagacgtggccctgagacttccacacccactcctt

SEQ ID NO: 12550 - DNA, 489 bp, Zea mays
  Clone ID: cC-zmpo14820007d04d1
gctggtgcagcggatgccgcgctgccgctacggcttcttccacgtggtgaacaacgactacacgcactggatcatgtacgccatcggcggcaacatgaaccccaccatcatcagccagggcaaccgcttcatcgcccccgacgaccccaacgccaaggaggtgaccaagcgggagtacacgccgtacaaggactacaaggagtgggtgtggaagtcgcagggcgacgtcatgatgaacggcgccttcttcaacgagtccggcggccagaacgagcgcaagtacgacaggttcgacttcatcccggccaagcacggccgctacgtcggtcagctcacgcgcttcgccggaccactcaagtgcatcgtcggccagccgtgctagtagacagcggcccggtcgggcacatactcctcttcctatatacatcggatttggatgggcggcatatatgtacgtgtgtgtaatatattattactacatcttgtact

SEQ ID NO: 12551 - DNA, 387 bp, Zea mays
  unsure at all n locations
  Clone ID: cC-zmpo14820007d05a1
ctgtagagaaatcgatatattccccggacaaactccggcgaaggccggagcctgaaacgagacaaaacatctttgtcctcccctccctgctttccctcccggctgggncacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagncagatcgtaggcttccgttccgtcccgtcccgtccctgccggtcagctccgcagcgcgacggcgggctcgtgcaccagcgacccggtggcctgcgcgcagccgtgcgcctcccg

SEQ ID NO: 12552 - DNA, 513 bp, Zea mays
  Clone ID: cC-zmpo14820007d05d1
cggggcgtacacggttgacatatgaaagatttgttattatattttaatacgatactattgttgctgccagacaaggcaacaacagtctgtggctggcgcctaattaaacccaaataaaaaacacactgtacccaataatccgatcccacagaaacttttctctcggtccgttcgatcgatcgctgccgtgtcgtttgccagacaccatcagcacccaaaaccatgggctgcaacctggctcactgcgccaccgccggcgaggtgaccgtcgcgccccggacccctcgccctgctgcgtacgcgtccgtctccttctcctcgaggaagccggcgggcggcagcctgcggctgcagcggcaggcgtgctgcgagccgtcagtggcgccgtcgcgggcggtgttcgcctgccgggccgcggcgtcggggagcgcggccgacctgtccttctggggcaggaagtcgtcccgcgtgccggtgtttgacatgatgccgctggacaccgtcaaggagtgc

SEQ ID NO: 12553 - DNA, 536 bp, Zea mays
  Clone ID: cC-zmpo14820007d07a1
gaacaacaacatatctccattccagcaaacaacatgtgagcctaaaactcggaaaaagatcaatacaatgtgcagggaaaacaacggcatgcagctaattcccagcagaatcctcggtggcggtgcgcctccttagcttggcgcgcgtcacacggatcgtctcctccatcggcgtctcctcgagcgcagggtcaagctcttccgcgccctctgcagcatcaccactgacctcatcgattgccatgttgtctacttcttcggtctagaaagtggtggggcactaggctcggattttggtgaatctgcacttgtggctggagtttgaactgggtcgacagcaggtttgacctcacctttctttgggctaccgccaaggttttggtgtggatgcagctgctgcaggctttgtggatgccaccgaccaggtctcctgatgtttgacgcttgatttgggtgaagatgaacgggtatagtctccaagattgctgtgccattgctgcttgccgagcagcaatagatgctcctctgcgcataac

SEQ ID NO: 12554 - DNA, 548 bp, Zea mays
  Clone ID: cC-zmpo14820007d07d1
ggggaaaccagagctcctgactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggagagatttggagattttacaatatcatggctaccgttttactcagaagcaaaggtgttgttctttgtatatttgtggtaccctaagacaaagggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacg

SEQ ID NO: 12555 - DNA, 462 bp, Zea mays
  unsure at all n locations
  Clone ID: cC-zmpo14820007d08a1
gttgatcacaactggttaagatgtcatttgaatttgcacattgatttacatttttttaactccggcaccgtatcggagtgcatgagcgaaagaatgaatatgcatgcatgatgcatgttatcatccgtatggctgcttgctggcatgcaggttgaagaagaggagggaaagtggctacttagaagttcttggacgcctggtacgtgacgccgaacttccagtcagcggggagaacgtgccatgaggtggccttgcggtggtcgctggtcatcacccggaacgtcagtgactcgcaggtgaggtcctccccggtctgccacacttgcccccagttgcgcttcatctccgtccacttaacgcgcttgctccccttcaccgacaccgccgcgatgtcgccggcgccgcctacgttggtgatcgtcaccatgttgaagtacttgntcccggtgatggtgtacccgc

SEQ ID NO: 12556 - DNA, 460 bp, Zea mays
  Clone ID: cC-zmpo14820007d08d1
cggtacaccatcaccgggaacaagtacttcaacatggtgacgatcaccaacgtaggcggcgccggcgacatcgcggcggtgtcggtgaaggggagcaagcgcgttaagtggacggagatgaagcgcaactgggggcaagtgtggcagaccggggaggacctcacctgcgagtcactgacgttccgggtgatgaccagcgaccaccgcaaggccacctcatggcacgttctccccgctgactggaagttcggcgtcacgtaccaggcgtccaagaacttctaagtagccactttccctcctcttcttcaacctgcatgccagcaagcagccatacggatgataacatgcatcatgcatgcatattcattctttcgctcatgcactccgatacggtgccggagttaaaaaaatgtaaatcaatgtgcaaattcaaatgacatcttaaccagttgtgatcaac

SEQ ID NO: 12557 - DNA, 396 bp, Zea mays
  Clone ID: cC-zmpo14820007d09a1
atgacatcacacaataatacaagagcaccaagtaacttttcctatatctatcatgggtacaaatgctatatggtcactgccctagcacccaatggatcaaacgacacaatactgctaggaacaccgactgtacaaataaaatgaactgagaaaacggtgccatcgtcaccatagaattaaagcgcatagcacacattgtctatatatattgggtataacaaattatattacttgcattaagaaaaataaaaaacaaacgagagagacatataataaataaagaaataaacaataattaggcaagcacattccactgtgtttgccactcgcattccatacactgatgcacgtacatgtttctatatatcagggtgcaacgtatatactggtagttat

SEQ ID NO: 12558 - DNA, 517 bp, Zea mays
  Clone ID: cC-zmpo14820007d09d1
caaagccacaacacatacaggaaagcaagcaagaatcattggaataatggcccgtgcatgcgtgttcctcgtcgtgctcctcctggccgccatcgcggtggcaccgttcgcgggcgccgcacgcgtggacgttgtggagggtaggtccatggcatccgccgatgcaccggaggcggcggccgatgctcccgctcctagccccgactccgtctcatccccagactcgtcatcggaggcgccctctagcagcagttcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctctctcggttgtcttttatttttcttaatgcaagtaatataatttgttatacccaatatatatagacaatgtgtgctatgcgctttaattctat

SEQ ID NO: 12559 - DNA, 300 bp, Zea mays
  Clone ID: cC-zmpo14820007d10a1
aattgaccaaaaaacagggggaggaaaaggtaaatgaggactccacgattagagctcctttttttgggaaccccagaaccaagattggacagggccaccttcaaaaaaaaagataaaccgggcacgtagtttcactgaattacgagttgtcgcgatttggatttttaagtacacacaggcgggggaaaccacaaggagaaaacgaggcgctttgttgttttccccccggactatcctgggccatgtagatcctgcccacataccgttaggcagcggagggcggtttgctggcctgatgaa

SEQ ID NO: 12560 - DNA, 467 bp, Zea mays
  Clone ID: cC-zmpo14820007d10d1
agacaaccctggcatgtggagcgtgcattccaacatctgctagcgttactacctcggggagcactactacatcagcgtagtctcgccggcgcgatcactgcgcgacgagtacaacatgcccgacaacgccctccgctgcggcaagggatcggggctgccgctgccgacgtactactcccccgcgcgctaagacaacaaaagcctggccttctcctggcggtctgaccatgcaatccaaactcaaaagaacaaattcgatggatgcgtaatgaaggggaacaaatgaatggatatatgcaatcttgagacgcatgccgtctgaaatcactgcactggggttgtcaaaaaaatcattgtaatgggagtgatatatataactttatctcaccattgatttacccagagagggggtggcggtgaatctcaaagggggcaaggtatggccgcaccggggccgggcgttctag

SEQ ID NO: 12561 - DNA, 407 bp, Zea mays
  unsure at all n locations
  Clone ID: cC-zmpo14820007d11a1
attgcaaaggcgtggtttttaaaattttttaaaaaatgaacaatgaaatgaatcatctcgtttcatttaatggccatctccctcatttcatgagcaacggaataaatgcaggccagggacaattacacagagtttgctcaacctaactcgtaatttcaatgaattcttaaatgaaaaccaagttgctcctcatgtacaagcattccctgcatgcggcgcgccgccacctcacgctggagtgtaagcacatgccaaactgtccccggccgcatatatatgattcatatcatgtttgcaagcgccatgcagctgttggccatctggctgagctccttatcgaacttacccatggggttggggacaccggcatgggtgaacggacggtcacacgagtanaaatcctggac

SEQ ID NO: 12562 - DNA, 229 bp, Zea mays
  Clone ID: cC-zmpo14820007d11d1
ctcaactacatgggcatcaactgcatggctcttgcaaacatgatatgaaccacgcatgcaaccccagcgtgaggtgacatcgcatgcaaggaatgcttgcattcatttttcatttaattaagaattcattgtatttatgagttatatatatcgagtgactgtatgtatttgttcctgacctgcactatttattcaatagtatgtcatgaattggtcgcgctgaacatgc

SEQ ID NO: 12563 - DNA, 325 bp, Zea mays
  Clone ID: cC-zmpo14820007d12a1
aagtgatgaaggccgtataacttgaaagaagtatcttgcgattaacacgccagaaatgtacagcgctgagagaaagaggtgactataattagtggtgctgaagagggggacgatgaacagcaccttaaacgactgagtatattattatatgtaccgacgggatctggagacatgaatatatgaacagaagaactagatggagacatgcatgcatgaaccaacagatcggagacatgaatcaaaccccggcgggctggctggctggtcagcagtatgatcagagccccatcccctgcgaggccggcgggcacatggcgacgccgga

SEQ ID NO: 12564 - DNA, 232 bp, Zea mays
  Clone ID: cC-zmpo14820007d12d1
cgtggaccacggcatgacgtcagtgcgggacgagcgcagcgctgttagtgctgatccagcggctgtacgtgtcacagtgcacgtgggccttctcctgcacgtaccgaaccaggctgcgcgcgcagcacgggctcccagaggcgccctgcgccgactatcgtggcacctgtgctgactccactgcgcgctgtgccaggagtacagggagctaaaggcgcgcggatacgagccc

SEQ ID NO: 12565 - DNA, 329 bp, Zea mays
  unsure at all n locations
  Clone ID: cC-zmpo14820007e01a1
aattctaaacaagatgaaaaccccgatgaattatataattataaaggctagtttgacaacttcattttctcaagtgaatcctattttttcaagagaaaatgaattaaattcccttgaaaaaataaaacctcttagaaaaaataaggttgtgaaactagccctattaataaatttatgcagaatgcaacatcggtttccaccattttcctctttacagaatactactgctccgngtatacggagaaactacatttcacggagtagtaaataaacagggattaattagcgccgagtgcatgcatgcatacagagttgggctggccgacatg

SEQ ID NO: 12566 - DNA, 421 bp, Zea mays
  unsure at all n locations
  Clone ID: cC-zmpo14820007e01d1
agacgcgcttgtctgtgccttttagactgttatagacacccataaggacgccgtcgtcggcaggccacaacacatctaccgcaagacagcttaaaacatactgcggaggcggggacgcatcgatcctacacgcttngtgtcttcggcttaattaatcaattaattgatatgatcatgtcggccagcccaacgccgtatgcatgcatgcacacggcgcttattaatccctgtttatttactactccgtgaaatgtagtttctccgtatacacggagcagtcgtattctgtaaagaggaaaatggtggaaaccgatgttgcattctggataaatttattaatacggctattttcacaaccttattgtctctaagaggtggttttatttcaagggaatccaattgattttctcttgaaaaaata

SEQ ID NO: 12567 - DNA, 253 bp, Zea mays
  unsure at all n locations
  Clone ID: cC-zmpo14820007e02a1
gcaacataatagcttttttgcatttaccccgaaattggacgaatagcgttgcaaaccaaagaaggatgatttgaacaatcatggccaatagggggctacgaacaatttactacatagnacaaaatggaaacacacccagcagcagtatccaatggaggggaaccatagagtttttactcaaaataacccaaccattaaccaccagagaactacttattagccagctatctaataggcgnctccctggtaaccc

SEQ ID NO: 12568 - DNA, 501 bp, Zea mays
  Clone ID: cC-zmpo14820007e02d1
ggcaagagaaaccgcggcgcgcggagagggaggaagggcagacgcagacggtcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagctcttccacccagagcagctcatctcggggaaggaggacgcagctaacaactttgcccgtggccactacacggttgggaaggagattgtcgatctatgcctggaccgtgtgcgcaagcttgcagacaactgcactgggctgcagggattcttggtgttcaatgctgttggaggtggtactggctct

SEQ ID NO: 12569 - DNA, 327 bp, Zea mays
  Clone ID: cC-zmpo14820007e03a1
ctacgcgaaggttaaattgaattgttgaactggtccagacaaatggcaagcaatggtacaggagtcgatccctctctcgtgggaaagaacaaataacggggcaccaaattaaactggtacatcagcgataccaattagttaaatgaaaatcagaaagaggaaaggaaaaaaacaaacaaaaggaagacgaaggtgtgccactgccgtgcccaatcagagcacacccacccacgcatcgggaatgcgcgggagcagcagagcagcgcagcgcagccaagtctctccccccctaggtctcttccctccggcagtccgagtcctcgtccg

SEQ ID NO: 12570 - DNA, 470 bp, Zea mays
  Clone ID: cC-zmpo14820007e03d1
ggcaagcgatcgtcggagcagagagagacttcctcgcctccatcccatcccgccgccgccgtctctacggtcggtaataagccgccgcatccagggatggagatgaagaagatcgcctgcgccgtcctcgtcgccgcctcggccaccgtggcgctggccgcggaggcgccggctccgtcccccaccagcgggtcctgcgcggtcgcacccgccatcgtcggggccgccgaggcctccttcttggcgtactacattcactgagccgccggacgaggagccggactgccggagggaagagaccaagggggggagagacttggctgcgctgcgctgctctgctgctcccgcgcattcccgatgcgtgggtgggtgtgctctgattgggcacggcaggggcacaccttcggcttccttctggttgattttttcctttcctctttctgattttcatttcactcatgggtatcgct

SEQ ID NO: 12571 - DNA, 215 bp, Zea mays
  Clone ID: cC-zmpo14820007e04a1
gggaactcttgggcagctcggggggggagccgcgagagatcaaccaggaaatcagagacgggccccgccggggagccaacattgcccaaaagggggggggcaaaaggggggagaccccccggggaaaaaaaggtcccaggggaaaaaggtcaggggggaaacgcgccgcaaccaaaaaaggggaaagccgaaggggccaagggggggggccgaag

SEQ ID NO: 12572 - DNA, 176 bp, Zea mays
  Clone ID: cC-zmpo14820007e04d1
acccacgcgtccgcccacgcgtccgcccacgcgtccgctaaaaaaaaaaaaaaaaatttaatttaaaaaaaaaaaaaaataaatcaacaaaacgacaaggtccccaatgtgctggtccttgcctctggggctttcctgcgtttttgattcagtgtgttcctgaacctctacaaatt

SEQ ID NO: 12573 - DNA, 289 bp, Zea mays
  Clone ID: cC-zmpo14820007e05a1
gatcccctggggacacaccagggaaccccggaaaaaccccgccgggccaaccaaccttccctaatgtcaataaaagaaaaccctgcaaaacaaagggaactcacggtccccacacacaaaaaggaaaaaactacacaataccccccaccaccaaaaccaaaggctaaaggaaaaaaaacccgggagccaggggagccagcaaacccaaataaaacatataaaacccgggggccgaccagcccaggcgaacccaaagaaccaagggacgctaaggaaaaacccaaaaccc

SEQ ID NO: 12574 - DNA, 532 bp, Zea mays
  Clone ID: cC-zmpo14820007e05d1
ataaaaaaaaaaaaagagaaaaaaaaaaaaaaaaaaaaaaacaaaattatataaaaaaataaaaagggatggcgttctgggggatctaatctatccaaccctgccttgccaggttaacgtctcttatatattttcaaataaattaaattaagtgacctgcgtgggacaccgtttatactgggaaagccggggaatcccccaccttatccgctttgaaaccaattcccttttccccatttggggtattttgaaagaggccgaaacggaccgcccttcccaacacttcctcaggttgaacggtttttgggacgctccctgttccccctcataaagctcataaatcgtggtggttttgctcaattttacctatacaattgccagagccgtaagccccggaccgttggatttattacttttcttgctttccacgaccgccgcctttgcccggtttagctttaaaatggtgaatgcgttggggtcttgagtaactggattaagggctcttcaccccaaaaaactaaaaaaggttgat

SEQ ID NO: 12575 - DNA, 180 bp, Zea mays
  Clone ID: cC-zmpo14820007e06a1
atattactatacggaaaaaaagaggagtacatgcatattatgtattttctgctgggagtaaaaggtgttgtaaaaccatggaactgaaaagtacgagcaagccagaatatggtatcgttcaatgcagattgccatgctatagctcagcacgtttctttaacttccacggtggctgggtag

SEQ ID NO: 12576 - DNA, 121 bp, Zea mays
  Clone ID: cC-zmpo14820007e06d1
cgcgtgccgatagcatggcaatctgcattgaacgataccatagctccagagtttatctacctgttagttgactttataaagaagtggtagggtatcaaattccaagacgatgtccttagta

SEQ ID NO: 12577 - DNA, 445 bp, Zea mays
  Clone ID: cC-zmpo14820007e07a1
gacgtgcactgcatcccgtacctaaggctcgtatacagtggaggggccgtcctttttttttaaaattgggatcataataatattagcatcgagtcacgattacagaacaaacccttcgacaattcacacgaccacgaaacgaacgaacaaacaaacaattaaccgatcgcgagccacgtcaataaaaaaaacatttgattaatcggatgaaccaaacacgatgcatcccaacgttgacgtcccgcgcgtagtgggtcagaggaggtagtaggcgaggaaggaggcgacgagcgccccggcggcgggcacggtggaagaggaggggccgcttgcgctagggccagccgcaccaccggacgagccggcgggcgcctcggaaggcgcctatgaagagaccgatgccattacggcgtaggacgtggactcggtgacgagggcgcatcaa

SEQ ID NO: 12578 - DNA, 544 bp, Zea mays
  Clone ID: cC-zmpo14820007e07d1
gggacgacccacgcgtacggatcaccggtcgatgagcgagcaggctcccaattccacccaataactaataacatgttctcgaacgccaggttccttggaccactatatccaggagcgacgaagtgatccacccgccagccatggagatgaagaaggttctctgcgccgccctcgtcgccgccgcctcggccaccgccgtgctggcctcggtcgcctacgaggcgccctccgaggcgcccgccggcgcggccggtggtgcggctggccctagcgcaagcggcgccgccgccgccgccgtgcccgccgccggggcgctcgacgcctccttgctcgcctactacctacactgagcgacgacgcgcggggcggcaacgttgggatgcatcgtgtttggttcatccgattaattaattgcttttgttatgtacgtggtttgcgattggataattgattgtttgttcgttcgtttcgcggtcgtgtgaattgtcgaagggtttgttctgtgatcgtgactcggtgctcatgttattatgatcccaatttt

SEQ ID NO: 12579 - DNA, 574 bp, Zea mays
  unsure at all n locations
  Clone ID: cC-zmpo14820007e08a1
agcaaataatgacaattggtcaggcatatatatgtcacatccatacaaaatcaaattcactgtcagacaggaagaagcaactattctaggggactcggaagacacaaatttccaaccttaggaatccatataatatctatggtatcatcttaaaggttgctaaatgatgatatagcaaagccaaaggaactactttcatatattggtaatgtgctgaattagacctttggagcaccctctctcagtgttgtttcttctcagacaacattgtggatcttagagataaactttgcatcaatcactttgtactgcttttttatctcaatgagggccttctcgcctacgatatcaacttgatcttcgtatttctcatacaacatggngcagagtgtatgccatcaggaaaatagtgtaagacagagtcaagaaactgaagcagcttccaattatggaaatgaaccacagcactgtaactgtcatcagatatgttttcaaatcttttccagaagcaacattgcgcaatgtatagaaagcctcgttgatttctttccttgcaacatgagctaccttcatg

SEQ ID NO: 12580 - DNA, 600 bp, Zea mays
  unsure at all n locations
  Clone ID: cC-zmpo14820007e08d1
ggttattcattcgtccttctattatctttgcctttgtcttctttcctaagatttcactacttctgcggggtgtcacagtcttaagatcatgtcagggtaggaaatgatgtccgagagtgaagagcatggctcgctcctagacaagatcaacgacaagatcaacgagaagatccatgagtacaagcactcgtcgtggtcgccctcctcttcggactcagatgatgacaagaagcccaagaagtctaagaagaagaagctttttggaagaaaacacccattgcatcatgtcctcggaggaggcaaagccgccgaccttgtgctgtggaggaacaaacaggcatctgggagcatattggtaggggtgaccgtgatctggttactgttcgagggcatcggctaccacctgcttaccttcctctgccacgcactaattgtgtttctcactatctggttcatctggtccaatgctgcgtcctttgtcaacaggtcacctccaaagttcccagaggtcattctatctgaagtccagtgcatgaaggtagctcatgttgcanggaaagaaatcaacgaggctttctatacattgcgcaatgttgcttc

SEQ ID NO: 12581 - DNA, 429 bp, Zea mays
  unsure at all n locations
  Clone ID: cC-zmpo14820007e09a1
aaacaatgtgaaacaaatcgcacagctcaaatgacaagtatggaacaaagaaggcagactcctgtaggacaatccaccaacatattgccaaaccgggttaacagaattataaacacaaaatccctgatcaatacctcttgcgtaatttacagctccaatgctatgcgacatgcaaaaaagaggaagactggagtgcgctttaagagctagtgcagatttaagttcaattcttctttttcgagtgcttcaccagccattcaatgacagaatcaatgttggttagagttcttgcaagatgtcatgaaacatgccacttctcggtcagtgattgtctttaggcccattagttctgtgaaggtttgcttgnggaaagcttcaggtttgtcaattttattgccaatgactagtaacggaatcccggtcaaagat

SEQ ID NO: 12582 - DNA, 579 bp, Zea mays
  Clone ID: cC-zmpo14820007e09d1
caggaggcctccaccgaacccccctgcgcccttcaacccgtcgccgccccgcacgatcccctccgccttcttcgccgccggcctccggaccgcgcagctccccggagccgacaaggacccggcgccatggggttctgggaggcttttcttaactggctccgcagcctcttcttcaagcaagagatggagctttccttgatagggctccaaaatgctgggaaaacgtcacttgtgaactctattgctactggaggctttagtgaggatatgatccctactgtaggattcaatatgagaaaagttacgaaaggaaatgtgacgataaagttgtgggatcttggaggccaaccaagattccgcagcatgtgggagagatactgccgtgcggtttctgcaattgtgtatgttgttgacgcggcagatcgagaaaacatggtcattgcaaagggggaactccatgacctcttgagcaagccatctttgaccgggattccgttactagtcattggcaataaaattgacaaacctgaagctttccccagcaaacctttacagaactaatgggcctaaagacaatta

SEQ ID NO: 12583 - DNA, 278 bp, Zea mays
  Clone ID: cC-zmpo14820007e10a1
aaagattgagccactgaataaggaacgaaagagtatggccaatatactacagggaatggactaaatgcctgttccatacgaaccaagctactcggatacacatgaggagccctcagagtacacgaaagcctgcctagcacgttcattgattaaaaccggtgagaatcggtaccatatgattgagcgatgacatgacacatcaggcccctataaagaacatacgtatgggaacaccaccgctaggcgccagcaagctgcgggcgcatgatacccatttt

SEQ ID NO: 12584 - DNA, 513 bp, Zea mays
  Clone ID: cC-zmpo14820007e10d1
ggcaaggaaagtggtaaggtgggagagagagggagacagggaaagctcttttcctcctgctcctcctttcgaattccgtctcttgcccctgccgtccttgcccggtttccccggtttttgagagggcaaagacgaggcggaggagagggatggggagggactagaggctcccggcgcgggaggccgctctcacgaccagagtctccgtcgccttcgacggtggactcgccggtgtctacctatgcagagccggaccgagactaccgcttactcagggggacacgtaagttcaaggaactacaaatgctaagtgtgcaccttgagaactatgctatggagtacaccctacaggtgttggatgggaattgcacttagtacatcatcatgccgtcctttttgatcccagggacaatattcatgtcactgcttgctggtgctttgtttgggcaactgggcggccttgctctgggggtctttgttgccactgcaggagccttatggtgctattttcct

SEQ ID NO: 12585 - DNA, 327 bp, Zea mays
  Clone ID: cC-zmpo14820007e11a1
ttttgtttttttaatatggatagttatggccaggtctctgggtcggtgactaaggagcaaatccgcgtgaaaggcacggtgacaaaggtggtacgtagtatgttgaagtcagagcacgggttcatgagcacgccgaccttctttgcgagaaccatggagttgctgatgctattccatggacacggccaaggaggtgacgacggatccatgtgttttgctgacgaggctgcactatgtgcacgccctggcatggccatgtctgagccgcagtcgatcgtgatgggcttcttcttattcaggccccgtcgatgttcttgccgaccatgt

SEQ ID NO: 12586 - DNA, 221 bp, Zea mays
  Clone ID: cC-zmpo14820007e12a1
ctttctggacgtttaccctggctaggacaggccgatcatttggacagggtatatggagctgacacgcatcaccgacgtgctgccgatggagtgatgcggctagatgaactgggagcagcgtattcctgaccacgaacgagctctccaagcagaaccttagagggcgctgtgctcctccatggatcttggcgacagatggggacgaactcaggagtcttgtg

SEQ ID NO: 12587 - DNA, 271 bp, Zea mays
  Clone ID: cC-zmpo14820007e12d1
accgcgcagatgtctgcataactttacagcgacattaggcccggactccgtgatgcatcatcatgggctgtgtcgagaagcgggtaaagggggactcctgtgccggtgccggactactctgcctgctcatccacgactgcttagaagacggctgcgacgcgttcatcttgatcgatcctatgtccaatgaggcctttgagagggaggcggggagcatacatgtgcgcggagggctaccacgtgatcgatgggatcaagacggccatgggga

SEQ ID NO: 12588 - DNA, 502 bp, Zea mays
  Clone ID: cC-zmpo14820007f02d1
catgaagatcgcctgcgccgtcctcgtcgccgcctcggccaccgtggcgctggccgcggaggcgccggctccgtctcccaccagcggttcctccgcgggcgcacccgccatcgtcggggccgccgtgggctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttacttttgtttgttgtttgtccttcctctttctacttgattttcatttaacgaaatggtatcgctgatgcaccagtctaatttggcgccctgttatttgttgtttccctcgagtgagggaacgagacctgtgccattgcttggcatttgtttggaccaggtcaacagttcgatttaaccatcataatagagacaa

SEQ ID NO: 12589 - DNA, 113 bp, Zea mays
  Clone ID: cC-zmpo14820007f03a1
aattaggttccgccccttttagtttgaatggggggatgcttgccaacggaagatgattacccaacaacgaccccgtttggggctggcccaggccccggcttcggacgcgtggg

SEQ ID NO: 12590 - DNA, 76 bp, Zea mays
  Clone ID: cC-zmpo14820007f03d1
aatccgaggtctgtgccagaccaaaacgtggtcgttgttaggttatcatcttccgtttgcatgcatcaaccaattc

SEQ ID NO: 12591 - DNA, 294 bp, Zea mays
  Clone ID: cC-zmpo14820007f04a1
acagttagaaaaaagaactatataaacacaggcacacatctattctgaatggtagccctgctcgagaccatacatctcctcgtctcttgtcaatctagcggcgcggagctgccatctgccttacggctttggcggagggcagtgcagcagttgagtgattacattacattaatctcagattttgagagcttcgccataggtagattagaatcccggatctgcaacaggatgcactgcagagatgtttcaactattttactccgatcccaagctaatcaggaccaaccaacccaa

SEQ ID NO: 12592 - DNA, 533 bp, Zea mays
  Clone ID: cC-zmpo14820007f04d1
cttttcgtttggacgatgcgctgcatcttggagctaactttcgttgtaaacaggactacaggaggatcgtggaaacttgtctgaatatgattggtagccatgtgtatgcataatcttgccgctttactgaaaaaaggcagattaaggctaattatagccttatagtcatttgagttgggctgggtaccttgtgtggggcccataacgaacacagacatgccttatttatttcggcctaatagcctattgggttggttggtcctgattagcttgggatcggagtaaaatagttgaaacatcactgcagtgcatactgttgcagatccgggattcaaatctacctatggcgaagctctcaaaatctgagattaatgtaatgtaatcactcaactgctgcactgccctccgccaaagccgtaaggcagatggcagcaccgcgccgctagattgacaagagacgaggagatgtatggtcacgagcagggcaaccattcagaatagatgtgtgcctgtgcttatatagttcatttttc

SEQ ID NO: 12593 - DNA, 324 bp, Zea mays
  Clone ID: cC-zmpo14820007f05a1
agtaaacgtctaaggattaatacttcactacagactagcaagacaagtcgatctgtacgctcaggacgccctcctctagcagcgcgacctcgccaccagaatgcagctccaaaacgggagcgacattcaacaatgagaacgggacaaacattgaaattccctgggttaagggaagagtcccctcgaggccatgtcggagctaaagaacaggtatggaaatggctgctcggagggatacaaacagatgctcggctcttcagtttactcctcggcatcatgcggtgcatgcccggacccaccttttaggctgcagatgcttctccc

SEQ ID NO: 12594 - DNA, 523 bp, Zea mays
  Clone ID: cC-zmpo14820007f05d1
cccacgcgttcggaggggagaaaggcgaactcgaattgggggaagagagcgagagacgaatcgcatcgagccggagaggaagtcagagacagggaggagggcggcggaatcggcgccggcgggaggcaggcatggaggacctgagcgtggaggagctcgcctccaacctctccacctacaaagagcagctacgcgaggtcaagaagcttatcaaggagaagaaggatgatgctggaatttctgaatatattgatatggagaaggagcttcaagaggtcataacgttaaccgaagagattttggcaactgcaaagcaaactgagagtgcccagaatgttgcaggtctatcaccgccaagctattcagctggagtgcagtctgagggactggatgacctttcacattcccataagtttgccgttggtactagagttcaagctgtgtggagtgaagatggagaatggtataatgcaaccgttgaagctttgacaccaaatggatactatgtagcctacgatggctg

SEQ ID NO: 12595 - DNA, 360 bp, Zea mays
  Clone ID: cC-zmpo14820007f06a1
atcctctacagcggacggcctgtcctttttttttttttttgtgatattttgtttttttttttttttaagagaggaattgtacaagaaccaatgcattacttgcttggatgggaaagatgcggaaaccggtggaactgattccgccttccaagcgccattggaccgtcggaccatcatgccatggagcttccaggaaaatggactatggaaccttaaaagggaagccagctttgtacggggccataccatatgttcggtttattgcgggcgggcgggcacaaacccaacccattccgcccgggggaaggccttcactttgttcccactatcatctgaagggcagaactcggccggcaattc

SEQ ID NO: 12596 - DNA, 337 bp, Zea mays
  Clone ID: cC-zmpo14820007f06d1
attgctgggcgagtttcgacttccaataatagtaacaacaaagcaaaggccttcctcccggcgtatttgctttggctcttctcctccacgccataagatatctagcaattggtgactcgccttaattagttcgctttgcttttgaggttgactcgaccattttgctgtagcgtgaattgcatggacatgcaacgctccaatggcctttggaatgtggaatttttttttcccgtttctgtatttttcctataaaatgaagtaatgaactggttcttatataattcctctcaaaaaaaaagacaaaaaagacaaaaaagaaaaaaaagaaacagaatgg

SEQ ID NO: 12597 - DNA, 375 bp, Zea mays
  unsure at all n locations
  Clone ID: cC-zmpo14820007f07a1
aatcaaatccattagttacataacggttgaccccataatgttacaagagcaaacgaagtgagcaaagcaaagaaacacttggtccctccctccccaccagacgagagcgattacagcacagccaattacgtgtccaccctaatgtctcaccgcgacacgaccatcgtcggtgagtttagtagaagaagatcatggtagcaacagcagcggcaacgccggcgatggcagctccacttccaagggcagcagcaccggcggagtcatcagcagccggtccctcagccgcaggggacgccgcgacggtggatgctggcgnggaagggctcaactcctcgtccgtggaagagggtggtgtagangctggtggctggcgcg

SEQ ID NO: 12598 - DNA, 374 bp, Zea mays
  Clone ID: cC-zmpo14820007f07d1
cgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattagggtggacacgtaattggctgtgctgtaatcgctctcgactggtggggagggagggaccaagtgtttctttgctttgctcacttcgttcgctcttgtaacattatggggtcaaccgtcatgtaactaatggatttgatt

SEQ ID NO: 12599 - DNA, 407 bp, Zea mays
  Clone ID: cC-zmpo14820007f08a1
gatagggagagtttctttattgcagtgtagtgaaatatatatacaagagttcccaaggggtgtgtcccttgggaaataactgtcacatatggattagatcacatgtacaaaatattttgtaacaatatagaccttgctgcgatcgcaagcaggtttttacgtcaccagacctgaacagacccattgccatccctaacgttgcgttcttgcagatgccgacgctagctaataagacagtcgcaagcaacatcggagacgaatctagctggacagggcatgcaggcagacaggccatgccgccccgtcgccatcgctcgccagtcgccagtaacgagaacgtgcgggggcagctaggcgcgtcgtcgtcggtgccggcgtcggccgacgttgccgcctaccggttccgc

SEQ ID NO: 12600 - DNA, 408 bp, Zea mays
  Clone ID: cC-zmpo14820007f08d1
cggaaccggtagtgcggcaacgtcgccggacgccggcaccgacgacgacgcgcgctagctgcccccgcacgttctcgttactggcgactggcgagcgatggcgacggggcggcatggcctgtctgcctgcatgccctgtccagctagattcgtctccgatgttgcttgcgactgtcttattagctagcgtcggcatctgcaagaacgcaacgttagggatggcaatgggtctgttcaggtctggtgacgtaaaaacctgcttgcgatcgcagcaaggtctatattgttacaaaatattttgtacatgtgatctaatccatatgtgacagttatttcccaagggacacaccccttgggaactcttgtatatatatttcactacactgcaataaagaaactctccctatc

SEQ ID NO: 12601 - DNA, 426 bp, Zea mays
  Clone ID: cC-zmpo14820007f09a1
attcattgtttaacaaattttacattttcaaatgacatgtttggaacatagaaggcatgactcctgtaggacaattccaccaacatacttgccaataccggtgttgacacgattttatcgccgcgggaatcccctgatctataccatcttgcgtaatttacagcctccaatgctatgggacatgcaaaaaacacgaacactggagtgcgctggaggagctagcgcaaactcaagttcaattctcctctttcgagtgcttgaccacccacccaacgacagaatcaatgttggtagagatcttgcaagatgtcatgaaacatgccactttttgttcagcgactgcccttaggcccattacttctgagaaggggtgctagaagaaagcttaaagcccgcccttttattgtcaatgactaccaacggaat

SEQ ID NO: 12602 - DNA, 478 bp, Zea mays
  Clone ID: cC-zmpo14820007f09d1
gcatagacttcctccacctcgacggctacgccttattcggtgtctggatggggcctgtgacgtggtcttcggagatgaggaagacgtacaacctactgtacacggtgagccggcacacgatccacgtgtacccgctgtcatggactgcgatcatgctgacattcgacaacgcgggcatgtggagcgtccggtccaacgtctgggagcggtactacctgggggagcaggtctacatcagcgtcatctcgccggcgcggtcgctgggcgacaagtacaacatgcgcgacaacgctcatccgctgcggcaaggtcgtggggctgccgctgccggcatactacgtcggctagcgctaaagacgaccaatgcgccgctatcaccttgtgttctgaccattcagtttagcttatccattcctgtgctgatcggtgaaataagatcatcaaaaagaacaaagaccaaggaagcctagggaaggca

SEQ ID NO: 12603 - DNA, 313 bp, Zea mays
  Clone ID: cC-zmpo14820007f10a1
ggaccaaatgaacatattgtatgtgtaaaacccttaaatacgatatgggataacattctatataactcgcatgaacccaacacacctgggcgccctattcggacatcgagcatatgcttatttcttgcgtggtgtcttgccaccagatacccagccaacaacaaataaacattaaactcgatggcacatggatcacaagacctctttcaaaatatacttcctcatcacatgcttaccagatcttgagggcgctttcacacgtggggtccgccttatagttctcacggacgacctcatcggagattccctcccc

SEQ ID NO: 12604 - DNA, 435 bp, Zea mays
  Clone ID: cC-zmpo14820007f10d1
ggcacgcatggtaggacggttggagagacacgtagacagagaaacatcagtacatacacattacctttttaactggccaccaacaatggtgtctaggttgtccatcatgctcggcacatcagagctgactaagttttttgagaaagggtattggacaaccccggtaaccttccaggtaggaaaaggctccaagcctggccacctgatgataactcccaagattgacaccatgtccgaaacgtaaataaaggagaacggcggccatgactcctcgttcgagctgaaggaggggccagccggaacctggacgtttgacacaaaggacccactcaagtacctcctgtgtaaccgctgtgccatcaaatgtgcatgttaccctatctgctgtgatgtttttccttgaaattttaaggccaacagcaactacaagaccac

SEQ ID NO: 12605 - DNA, 401 bp, Zea mays
  Clone ID: cC-zmpo14820007f11a1
cttcgacgccgatgcgtccgacattgcacgggggcagctgctttcccttcgggagggcgacggtgaccttcccgacgactttgacttcgacatccacgtggactgtaccttcggcaacgagcgcctgagccgcgcgtacgtcgcgctccaggcctggcgccgcgccatgtacttcgaccccaacaactataccggcggctgggtaggaaccgacgtgtgctcctacttcggcgagacgtgcgtcccggcactcgacgacgctaacaccaccgaaggtgagggcatcgaccttaacggaggcgacatcgatggttacctccccgcggggcttggcatgctcaccgatatcgccttctttacattaactccaaccgctgctgcggtatcatccccaagagctt

SEQ ID NO: 12606 - DNA, 285 bp, Zea mays
  Clone ID: cC-zmpo14820007f11d1
ggcggtgatttgactggcgctggaggtgacctcggcgcgaacagtggtggatattccacagatggaggtggtgaagtcatcgataccgcactgggacgggattcatacctagtgtggtggcgagctcaccggagaccggggaggaggagaatggataactgcgggaggcgagctaatagtggctggcgctggtgctggcgcctgggccgctggttgtcgcacaggtcctggtggaggtctgaagcggttgaggaccaactgcgtggggactggggtacttattat

SEQ ID NO: 12607 - DNA, 357 bp, Zea mays
  Clone ID: cC-zmpo14820007f12a1
ggaaaaaagggatacataaggcacacaaatcacactcttttacaacttgccgcctcatgtatgggagttagttcacacatacacacgtccgaacatatgtatgaataagaatatactcacacgtgcgcgtgcaaaaaaaaaaacaatttcacacacgtttacagggttttacatgtaccaggttgactgcgcgtgggaccttataaactgttcccttgatgcttcataaaccatgtctctggggggcttaattcccttggaactgagggggaggcggagatgcgtacttgatggccatgataggcggaaggaatgatgtattgaatgacggtggcatgttgggattctgctgggggg

SEQ ID NO: 12608 - DNA, 449 bp, Zea mays
  Clone ID: cC-zmpo14820007f12d1
aaatctgcttctccaccggcaccagttagctcttctccaccagcaccagagaagccaccatcactaccaccaccggccccagtaagctcaccttctacggttgccacccctgccccggcgaagaaagaagagcagacattaccacctccagcataatcccaacctgcaccatcattcaatgacatcatccttgcacactatcatggccaacaaggacgcatatccgactgcccctaagatacaagggtattaagcgccacagagacatggctgctgaatcatgaagggaacagtctataaggtcacacgcgcacacaaactgctacatggaaaacactgtatacgggtgttaaattgttttttcttttgcacgcgcacgtgtgagtatattgtcattcatacatcactaccgtcgtgtgtatgtgtgaactaactacactacatgaggc

SEQ ID NO: 12609 - DNA, 363 bp, Zea mays
  unsure at all n locations
  Clone ID: cC-zmpo14820007g01a1
atactgcaattacagtagtatatatgtatatatgaaacaaacttatagcaattaatgatagacaaagcaacaaacgttccacactgctggactggacatctcttgccgtccaggtccacgtgtcctgttagatttagatggtcgatacaccaccagctagcaaggaaggaaaggacaatgaaacgaaccaacgatcgaatagcgtcggtctctgatcgatactaccagncgntgntgntagnaataacaattataataaatactagnacgtaggtagcacataaattgctgcttgaacgcctnccatcccatcccatggccgggcgggcgcccgagctcttgtctgcactacttataaccacc

SEQ ID NO: 12610 - DNA, 538 bp, Zea mays
  Clone ID: cC-zmpo14820007g01d1
gacgacgagtcacacgagtcacggctcgtgcgtgcgtgcgtacgtacgcagcccagggacaccgaccgccgccggcgcccaagaaaggcaagatggcggcggcggcgcgcgaggacccttcttcctcttcctggctcgcgctcggcagcatgtgctccatgcacggccgctgatgagggagccagcggtggttattagtagtgcagacaagagctcgggcgcccgcccggccatgggatgggatgggaggcgttgcagcagcaatttatgtgctacctacgtactagtatttattataattgttattactaacaacaacgactggtagtatcgatcagagaccgacgctattcgatcgttggttcgcttcattgtcctttccttccttgctagctgagtggtgtatcgaccatctaaatctaacaggacacgtggacctggacggcaagagatgtccagtccagccttgtggaacgtacgttgctttgtctatcattaattgctataagtttgtttcatatatacatatatactactg

SEQ ID NO: 12611 - DNA, 300 bp, Zea mays
  unsure at all n locations
  Clone ID: cC-zmpo14820007g02a1
cagaggatactagctatccatgccatgcgcgcgttcgctctgtatcatcgttatagttttgagcagcctgtccgcgacgccgccgaggtacagtttactggtcgtcgtcgtcgtccgagtccagctgcttgagcagcgcggcgcagacggggagcggcacgtccttgaagtagccgagcgggttggcggggcgcaagctgtcggatatgccgacgttcctggagagcaagacgccggcgcggnccctgagcgcctggacctcgncgcagnccttgcgcgggctggccaccagcaccacct

SEQ ID NO: 12612 - DNA, 585 bp, Zea mays
  unsure at all n locations
  Clone ID: cC-zmpo14820007g02d1
cccttgtatcaccctccctccctcacacagagtaataaggaaaggtcccttccttttcctccgacatccacaggggggaggggaaaacacgtgcattcacccggcggcaataatggcctcggttccggctccggcgacgacgaccgccgccgtaatcctatgcctatgcgtcgtcctctcctgtgccgcggctgacgaccccaacctccccgactacgtcatccagggccgcgtgtactgcgacacctgccgcgccgggttcgtgaccaacgtcaccgagtacatcgcgggcgccaaggtgaggctggagtgcaggcacttctgcaccggcaagctcgagcgcgccatcgacggggtcaccgacgcgaccggcacctacacgatcgagctcaaggacagccacgaggaggacatctgccaggtggtgctggtggccagcccgcgctaggactgcgacgaggtccaggcgctcagggaccgcgccggcgttctgctcaccaggaacgttggcatttncgacagcctgcgccccgccaacccgctcggntacttcaaggacgtgccggtccccgtctgcgccgcgct

SEQ ID NO: 12613 - DNA, 315 bp, Zea mays
  unsure at all n locations
  Clone ID: cC-zmpo14820007g03a1
caagagccattggcaatgtttgttattcactaataacaaggcacgcagcaacagcgcccacgggcttggaaatttgatcacacagggaaagtcaggcagagcccttattacatacaaaagaatcaaggggtaacaagctacagatatactctgaggatgcacacccgcacttcgtttttttttttaggctcgttcgcagaggcaaaagcctcgctgctttgccactacgctctccagaggaggagggattcctccggcgagcagccgatcgccaaacagcagnatgatacaaggggtgttttcttaaaccctttt

SEQ ID NO: 12614 - DNA, 490 bp, Zea mays
  Clone ID: cC-zmpo14820007g03d1
ctaatcaaccgcggaatgtaactgttgtcgttgaaaacccaatgacagtttatgacaagggaaaattggtgagcaatgttgtagtaggggttacgagcggcgggaaaaagtgacggcatatcacaaccgtgtgtagctttgtccaaactatctaaaaagggtttaagaatacataccttgtatcatactgctgtttggcgatcggctgctcgacggaggaatccccctccctggagagcgtagtggcaaagcagcgaggctttcgccactgcgaacgagccaaaaaaaaaaaacgaagtgcgggtgtgcatactcagagtatatctgtagcttgttaccccttgattcttttgtatgtaatatgggctctgcctgactttcactgtgtgatcaaatttccaagcccgtgggcgctgttgctgcgtgccttgttattagtgaataacaaacattgcaaatggctcttgaaaaaaaaaaaatttatcaaaat

SEQ ID NO: 12615 - DNA, 303 bp, Zea mays
  Clone ID: cC-zmpo14820007g04a1
aaaaattaagtttaggtccataaattactcatgtgagggtccgagccactcatgaccgagagcacgggtgataaaccaattttacactctacagagggggcgcatctttacccaaaaggcgggttacccatatgccaagggggcattgatctcatacatctctaccgaggaaacgaggcagggtagcacttcgaggcctttacataggttcactagcttcagaaaacccgctacgggttctgagaagggcaatataggaatccctcgtccgaaaagccatcggagcatgacgacccgagaacc

SEQ ID NO: 12616 - DNA, 425 bp, Zea mays
  Clone ID: cC-zmpo14820007g04d1
gacgcccttggctgactaattaggaaagctagtggaggactaccttacccgaaaggggcaagggcggtagaggagctgcagtatagagaggttctcgggtcgtcatgctgcgatggcttttcggacgagggattcctatattgcccttctcagaaaccgtagcgggttttctgaagctagtgaaactatgtaaaggcctcgtagtgctaccctgcctcgtttcctcggtagagatgtatgagatcaatgaccccttggcatatgggtaacacgacttttgggtaaagatgcgcaacctctgtagagtgtaaaattggtttatcagccgtgctcacggtcatgagtggctcggaccctcacatgagtaatttatggaactaaacttaatttttaaaaaaaaaaaattaaagaaataaaaaaaataa

SEQ ID NO: 12617 - DNA, 437 bp, Zea mays
  unsure at all n locations
  Clone ID: cC-zmpo14820007g05a1
cgcgaatgggtcgatggatcgaacacattatattgagtgactccagcccggcccacgtacagcgaaagcacccatgcatgaggatacacaaaaagagacagcccgcccggcgcccgaattcagttgaacaaaatgcatcgtggtggatgcacgtcgtctagctcttggcctccttgtaatcagttagttggcaacggcctgttcgtcggtggtggtcttctcctcctccgccgacggtgctgggacgacggtcgtcgcctccttcgccttgtgctcgtcgaccgccggtctcgcttccaggggttccgnggctgaatccccatcctcattcatcggatgctcctcttcgatgtgttggctctcaaccgtcttctcctccccgtctttgattttgagtgggttcgtcaaccttgggcccctcatccacagcaagcgcc

SEQ ID NO: 12618 - DNA, 575 bp, Zea mays
  Clone ID: cC-zmpo14820007g05d1
tcgcgattcctctactccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggatgaggggcccaaggttgacgaaccactcaaaatcaaagacggtgaggagaagacggttgagagccaacacatcgaaaaggagcatccgatgaatgaggatggggattcagccactgaacccctgtaagcgagaccggcggtcgacgagcac

SEQ ID NO: 12619 - DNA, 253 bp, Zea mays
  Clone ID: cC-zmpo14820007g06a1
gaattaagcactttgttacatttttttatttacttagattacttttatttcaccaggatacctgatgaccatgccatggcgcacacactttctgcattatcgttatagtttagagcagtcctgtccgtgacgccgccgtggtacagtgcactggtcaaaaaaggctgccgagttcacatggtagagcaccgcggatgcaaacggggagcggtacgtacatgaagaacacccacgggtccacggtttgaagggt

SEQ ID NO: 12620 - DNA, 408 bp, Zea mays
  Clone ID: cC-zmpo14820007g06d1
gtgccgggccgaggccatggtcgatgcagggaggaggatgccgccgctgccgcggagattgatagtactagtataaagcaggcggagacagccggcccctctggcctcgctgctcccccttcctccccgtccccacccacatgccctgcctgcggcccgccccgccctgcccaagctgagctcccccaccctcaacaaacacttactagagtatctgcattggcggggaaattaaagcgctagaagctcatcatcaatggcggaacacgcgggcgtcggaaggtactggtgccacatgagccccgcggtcgttagcccccctgacggcgaggtggacaggaagtgcccgttctgccacagaggcttaattgaggagattgacaccgaccgcggtgccgagaacgacga

SEQ ID NO: 12621 - DNA, 401 bp, Zea mays
  Clone ID: cC-zmpo14820007g07a1
atatgaaggtgggattatatgaagttcacgcttggccaagggtatgcggcgacacaatggcggaagctcggtggttggcgaagggcacagccggccagcccagtgcagataggtgagatcttgggtgggggcccaagttccaccaacgcacctacacgctcagaaaagctccatcttttacagggaactgcgcgcgagtttaccctgcagcactgagtaatccaaaagagagatggagtcgtgaaaaggcgccgcatttttctcttccctgaccagatgaaccgttgctgtaccggcacgtcctcctcgtccggcttcagtcgtaggggttcctgaacttcttcaggaggtccgggatgtcgtaggccagcattgtcgtccacgccctggaccatcttggg

SEQ ID NO: 12622 - DNA, 518 bp, Zea mays
  Clone ID: cC-zmpo14820007g07d1
aagaaagagatgcctgcactgatgggcaaggccaaggctcagcataagctgctcgacgggctggatcaacagttcgccaaggtccagaaggagctgcacctgccgccaggggacttcccgagcgtagaggagtacagggagctcctgagcgcctacaacttcgacaggttcgagaagctgaggcccaagatggtccagggcgtggacgacatgctggcctacgacatcccggacctcctgaagaagttcaggaacccctacgactgaagccggacgaggaggacgtgccggtgcagcagcggttcatctggtcagggaagagaaagatgcggcgccttttcacgactccatctctcttctggattactcagtgctgcagcgtaaactcgcgcgcagttccctgtaaaagctggagcttttctgagcgtgtaggtgcgttggtggaacttgggcccccacccaagatctcacctatctgcactgggctggccggctgtgcccgtcgccaaccaccgtgc

SEQ ID NO: 12623 - DNA, 133 bp, Zea mays
  Clone ID: cC-zmpo14820007g08a1
ggaacccaacggggaaaaaaggcatttgaaattgcccaatggtttacattttttaactctggcccccgatcggggtgcatgagcaaaaaaaagaatatgcctgcatgagggatgttatcaatggacccggggg

SEQ ID NO: 12624 - DNA, 212 bp, Zea mays
  Clone ID: cC-zmpo14820007g08d1
cccacgcgttcgatgataacatgcatcatgcatgcatatttattttttcgctcatgcactccgatacggagccagagttaaaaaatgtaaatcaatgtgcaaattcaaatgacattttaaccagttgtggtcacccaagatcactacaatcttatatgtagtcaaagctcgtataaacagcatacaaaagacatcaaagaatgaaaaaccag

SEQ ID NO: 12625 - DNA, 324 bp, Zea mays
  Clone ID: cC-zmpo14820007g09a1
aaaaggaaatatcatatatattccatcacaagattacagaacgacttgacgcaaacacatgaattttaaatagtaatgtctacgtaataataataattaaataacacagcccgttaccatgcatgcatagatattcatagcataccagtcgaactatatgggaacatgggagcaagggacgatcggcatgcatgcatagatgttcaacagtccatgcatgccaatgccatgcgcgcgtacgtgcctctccccgcttaatgcaggtacttttcgaggaggggaaaaaagagcccagttgggcgtggaagaaattgttgacccagc

SEQ ID NO: 12626 - DNA, 443 bp, Zea mays
  Clone ID: cC-zmpo14820007g09d1
gactaaactgtcaacaactagactgctatacatgcctggtcattttaatggggccgggagagctggatcctggggcgaggaaaacgtacacgctacatgcacaccgacgaggacgagacacatagccaatgagttcccagggttctggactgcgaatcatgttgacattccacaacgcgtcgacattgtggagtgtcccttacaacgtccggcagcggcactaccccagggagctgcgatacatcagcgttatctagacggcgcggtcgctgcgtgaggagtacaacatgcccgataacgcccttcgctgcggtaaggatgtggggctgacgctgccgtcattactacgcccgcttgcgctaaagacgaccaaggcgccgttttcaccttgtgttctgaccatccaattgaactaatccatttctgtgcttttcggctaagtt

SEQ ID NO: 12627 - DNA, 289 bp, Zea mays
  Clone ID: cC-zmpo14820007g10a1
gaattgtacttttttttgttgctttcccttcggtagggagacggtgacaatcgggatgaccgcgagtgacccatctcacatgggcgcccgattggacacgagcgcttgcgcactgcgaacgtggtgctccgggcctggtgccgagccatgtactcccatatcttaaacttcaagggcggttgggcagaaaccgacgtgagctcctacttcggcgtaaggcgcggaccggatcttgacgacgctaacaccacgcgacggcgggggcatcaacctcaagggtgacatcatc

SEQ ID NO: 12628 - DNA, 370 bp, Zea mays
  Clone ID: cC-zmpo14820007g11a1
ccgacgccgatgcgttcgacattgcacggcggcagctgctttccctaccggagggcgacggtgaccttcccgacgacttcggctcacatccagtggacgtaccttcaacacaagcgcctgagccgcgcgtacttcttcgctccaggcctggcgccgcgccatgtactccgaccccaagaacttcaccggcggctgggtaggagccgagtgagctctacttggcatacgtccgtcccggcactcgacgacgctaacaccaccgacggtgagggcatcgacctcaacggcggagacatcgggggttacctccccgaggagcttgggaagctcaccgatagcgccttccatcacattaactccaaccgctgct

SEQ ID NO: 12629 - DNA, 452 bp, Zea mays
  Clone ID: cC-zmpo14820007g11d1
gggggataattgaagctggctctggcagacacgattgaggggtaagcgtgtggcggcaaattccacaaaatggtatgtggtgaagctgattgtatactacacggctgaggctgatgtccaaaatgtggacgataggagagctatacctgagcacgtttggaagatgagaaatggaaatattgtagcaggttgagcacatacagtgatactgtttgtgatgatgacgcggctattgcagggctagaagagccagaacatgttacttggggccaccatgtaccggggtggggaagtaggttccaaatagttgtaggcgtaggtcatacaaactatttggaatacgtgaaatgagagaaaattggatacattaaggcctttatcttaaaacagattaattcttgggttacagacatctatggacatgacgatataagactgtttgcaccatacta

SEQ ID NO: 12630 - DNA, 312 bp, Zea mays
  Clone ID: cC-zmpo14820007g12a1
aaatgtgatgcatggggcacacaatgcatactcttgtacgacatgccagtcaaaagaaaggccttccgcgttaacagactcacgttcgcgcatatgttggaaaatgactataccctcatttacacgtccaagagaaaaaacctgcaaaacaaaggaacactggtgtacatttaaaaagttaaatgcgagtgggacccaattgtctggtggcgagagcgctaacaaccattgaatgacggagcccttgttggcatagctcttgacggaggggaggagacgtgccactcctggctaagatattgggaatggggc

SEQ ID NO: 12631 - DNA, 401 bp, Zea mays
  Clone ID: cC-zmpo14820007g12d1
actcaccgtcatcaactgtaaaattacctctttcactaactacaatggtttcaccatcgattactatgaaatccggtccaccaacggtacccgtctgctggtcgccaccgtgtgtaaaatcacatactacaccggctattgtgattacaccatcacctccggtgaaaatcctcccaccaccggcaccagctagctcacctcacgggccaattgccctgagctcagcatccccattagcaaaatgggcaccgacacagataaaaacacctgcgccaccaacttagagaagatctctatctggaccggtgaagccaccgacacgcaccgtgacttgtaaggtctacaccacgtgacaccaatgaccttttcacctgcaccaacaccggcgagctcaccgtctt

SEQ ID NO: 12632 - DNA, 322 bp, Zea mays
  Clone ID: cC-zmpo14820007h01a1
tccttttgctgtatgctctctgtcggagcggtcgtttgtgcttatcttggtggttgttacaagggttcaaatgaggccttatgtagcgcccttttaagagaaaggggcagagtatccgtccccaggggtgcaaaagcctttccgacaggacggcggaaaccccccggaagctggatcaccacggacccgccaagaagcgggcatgatccaaccgaaaagggactggggggtagagggcgacggctaggaagtccacacacccctgtaaaggcccccagacgagggccctgaaccgataaacggcccgccccccatactatgg

SEQ ID NO: 12633 - DNA, 435 bp, Zea mays
  unsure at all n locations
  Clone ID: cC-zmpo14820007h02a1
agcccccctcccccccccccccccccccccccccccccccccccccccccccccccccccccccccccctcctcctcccttccccctccccccccctcttccttctccggaacaaaccccctgggggaaggggtcccaccccaggggcggccaaaacccccggggcacccccccccccggggggaaaaacccccgcggccccccccaaacccnctaaccaaggggaaagggggcccccaaaaaaaggggccccaggggggggnaaaaaaaaaaccccccccccccctggaaggcccccccccctttcccccccccccccccctggattcttccccggcccccgggccccccgcccggggccgcccccctaatattnnnggccaaaaagaaggccccgggggcccccagggggggagggggagggccccccccccc

SEQ ID NO: 12634 - DNA, 359 bp, Zea mays
  Clone ID: cC-zmpo14820007h03a1
aggttccacacatgatgatgacatgaatttacgatgatccaggaaaacaagagagaagagagcctgcctacatcctacgcaggttcagcaacagcgtatgggatatacatttctacagagcatccatgtccattgagaccgggaagcaacaaccagatactggaacaccccacagctgaacgtcctgcactctagaacgacagcagactggaagctcctgcggttctccggtagcgaggattctcaaactcgaggttcatgcctgcgcaacggggagcagcccaagctctccgatgaccccagccgcgccgagcagctgcgcgccagcgctggaaccgcatgtgcgcacctcgtcaaac

SEQ ID NO: 12635 - DNA, 358 bp, Zea mays
  Clone ID: cC-zmpo14820007h03d1
gtttgacgaggtgcgcacctgcggttccagcgctggcgcgcagctgcgcggcgcggctggggtcatcggagagcttgggctgctccccgttgcgcaggcatgaacctcgagtttgagaatccacgctaccggagaaccgcaggagcttccagtctgctgtcgttctagagtgcaggacgttcagctgtggggtgttccagtatctggttgttgcttcccggtctcaatggacatggatgctctgtagaaatgtatatcccatacgctgttgctgaacctgcgtaggatgtaggcaggctctcttctctcttgtttgcctggatcatcgtatattcatgtcatcatcatgtgtggaacc

SEQ ID NO: 12636 - DNA, 319 bp, Zea mays
  unsure at all n locations
  Clone ID: cC-zmpo14820007h04a1
gattcttgatgaaaattaataataaagaattgaatgaattaatgtctgatgtacaagatctaatggtacaaatgctacaactatgctgcgataaaaatacacgatgtgacagttttcaaggatgtgaattgaacaaagatacaagagccgccacctggctgtgacattggtgggaggccagaggaaacaatgtaataatcaattgtgaaacatagnatgtaccgattttcctgatcatgtgagcatacaatgaattcgctgggtcagaaaggtttactgggcttgctgntgnctctcttgagtagaactttcaactttt

SEQ ID NO: 12637 - DNA, 444 bp, Zea mays
  Clone ID: cC-zmpo14820007h04d1
ggataccaattaggtggtatccattcatcacactaatggctgtttgtgcttaagctggagaattgtggcttacgagaccgcagcttccatttgtgtgatcaatggatacaaattaggtgcgtaaatggtgacagattaacgtcaagagatgacaactctttggacagtaaaccatttctgactcctcgaattgattgtttgctcacatgatgaggataatcggcacatactatgttacacaatagattattacattgattcctgtggcctcccaccaatgtcacagccaggacggggctcttgtctgtttgaacaacttaacattcttgaaaactgtcacatcgtgtatgtttactcgggcgtattcgcaccatttgtcccactagatctcgctcatgatacattacttaattcaatgcttgagttttcatcttcatgatgaat

SEQ ID NO: 12638 - DNA, 291 bp, Zea mays
  Clone ID: cC-zmpo14820007h05a1
gggggcaggggaaactttttctgacctgtatttatgtgcagggtaatgaccggttatttttatttaaggaacattatgttacaacacattctgggatgtaggggggggggggacatgcgggaattcaatggaaaccatttttggggaaggaacaccgcaaaaagctcaaggacaagagggcaaccatgggagcccacaagagggcattcccccccttggagcttgaccccgaggagggattgccagccccctttggcgccggggagttggggggtgatcacaagtttaact

SEQ ID NO: 12639 - DNA, 456 bp, Zea mays
  Clone ID: cC-zmpo14820007h05d1
aattctgggtcgaccacgcgtccgggcagcccccgggacgctggctccggcgggagcaccggcacctttgctccaaccctccgacgttgtggacccgccgctgcctccagttaaagctgtgatcaccgccgacgcgccggcgccagaggcggctgacaatacctactcggcgtgcagctccaacgcggggaatggcctcttgtgggctgccatcgttgccctcttgtccctgagctttctgcgctgatccttcctcgatgatggcttccattgtactcccgcatgtgcccctcccccctacatcctcgaatgtgctgtaacataatgttccttaaatagatataacctgtcattaacctgcacataaatacaggtcagaaaaagtttaccctgcgccacaagaaagcaaattgatcgtacatcgaaaaaaatttacaaagtggcaggtaacttaag

SEQ ID NO: 12640 - DNA, 283 bp, Zea mays
  Clone ID: cC-zmpo14820007h06a1
ccattcaacccgtattttcatttccagaacaaaagcaggtctgaacaagcccttggactccattttcaaggaaaagctttccttatctatctgtaagaaaaagaattcatgccttacaaatgacgccccagacatgtgttttgcaccttggcgcctaatggagtgggtccacacaagcacacgttcatacctttagagtgctcggagaagcaaatactcacgcgtgcccatgctgaaaataaatacacaatttatcacacgcctgccatgtacattttgctgt

SEQ ID NO: 12641 - DNA, 423 bp, Zea mays
  Clone ID: cC-zmpo14820007h06d1
acccgtacgacacaaattgtgacgtctacaattggcaacggctagctcaccatttcctacgcctaagtcgacaccttcacctgctcctgtgagctcaccacctacagtggtgaagtcttcttcaccaccggcaccattcatctcaccaccaccgacacctaagccattacctccacctgcttctgtgagctcaccacctccggaggcgaagaattcttcaccgccgacaccagtcagctgaccaccaccgacacctaagcacattgcctccacctgctcctgtgagctcaccacctgcagtggtgaaattttattcaccagctgtaccagtcagattaccaccactgacgactgaggatgtacaccacatacttctgtgagctcaccacctccagtagtaaaggattgtccaccaacaacact

SEQ ID NO: 12642 - DNA, 579 bp, Zea mays
  Clone ID: cC-zmpo14820007h07a1
agacgtgacatgcactcctccctatacctaggctcctatacagcggacggcccgtcctttttttttttcacacacaaatacgaacgtgacatgacattttatgagcatcattacatgtactaaagctgtcacgaacgagggttggggatctctgatagcatccgacagacaacatcgaccccttggtataaagattgcacaccacacacgcatctaggacgaggaggtcagcgatgttgctgccgctgggtcgccgcgccccccgaggcgggcccgtactcggttgtgccgctgaagccgccgctgaactcgctgctctcgaaggccaccttcctgaacttgctgatgtaggccgcataattggccccggaatcgtactccgatccggagctgaacatcatgctctgccctggctacaccccctcgttcatgtcttccagcgacgcgtccccttccagagcacggacgatcggtttcatcttgggccgccgcttggctgagcggcggacggccgccgcggcagaggagcacatccgctccagctccagccggtcgatcctgttatgcagcccggggtcg

SEQ ID NO: 12643 - DNA, 604 bp, Zea mays
  unsure at all n locations
  Clone ID: cC-zmpo14820007h07d1
cggaattnttgggcttctggggccgggcgggttcgggtacgtgtacaagggcgtgctcgcggtcagcggcaaggaggtggccgtgaagcatctcaaggccgggagcgggcagggcgagcgcgagttccaggccgaggtggagatcatcagccgagtccaccaccgccacctcgtcttcctcgtaggctactgtatcgccggctcctcccagcgcctgcttgtctacgagttcgtgcccaacaacaccctcgagcaccaccttcacgggaagggtgtgccggtgatggcctggccggcgaggcttgccatcgccctcggctacgtcaagggcttggcttacctgcacgaagattgccaccccaggatcattcaccgcgacatcaaggcaggcaacatccttctggacgagaatttccaggctaacgtcgctgatttcggacttgccaagctgtccacagacaccaacacgcacgtgtccacacgtgtcatgggaactttcgggtatttggccccggagtacgcgtcgagcggtaagctcaccgacaagtcggacgtgttattctttggcgtcatgctactggagctcatcaccggcaggagaccg

SEQ ID NO: 12644 - DNA, 348 bp, Zea mays
  Clone ID: cC-zmpo14820007h08a1
aaaattactgggaactgcatcccgaaatggagcatcttatacccgaaaatgaaacatgacctcacattgagttgagtttgctgctctcttctacgattatagagaaaaacctcactgtatcctcagctcagaattcgtctttccgaggaagcaattctttttcatcagtcaaaaatttgcatggtattatttccagaaagcacaaaacagtcggcgggaaagcactggtaagtaactttatatgtcaagcagcaacctcctggggtcctcaacgacatccttgatgcgacggaggaagaatacagcctctctgccattgtgcaacgccctgtggttgtgaatggtgac

SEQ ID NO: 12645 - DNA, 394 bp, Zea mays
  Clone ID: cC-zmpo14820007h08d1
agatttgttgggacgacccacccgtccggtcaccattcacaaccacagggagttgcacaatggcatataggctgtattcttcctccgttacatcaaggatgtagttgaggacctccaggaggtgtgctagcttgacatataaagttacttaccattgctttcccgtcgactgttttgtgctttgtggaaatagtaccatgcacattcttgactgatgaataagaattgcttgctcgcaaagacgaattctgcgctgaggatacagtgaggtttttctactataatcggagaagagagcagaagactcaacttaatgtgaggtcatgtcccatttggggatataagatgctgcatttcggtatgctgttgctagcgctcataaaaaatacataag

SEQ ID NO: 12646 - DNA, 269 bp, Zea mays
  Clone ID: cC-zmpo14820007h09a1
ggggagggaaaacccctggaaaacgtgttatttttcctaaaaaacaacgggacaaacaccaaaaatttgggattttgaaccctccgcccaaaaaaaaaaatttcccaaaaaaaaggtccttttttaaatgaataaaggccaccccgtaccacccgttagtttttcgccgtttttaaaaaaacaccccccggggggaaacccccgctgacccgggaaatattttccccacttccactggggggccccacggggcttattggtgcctttaa

SEQ ID NO: 12647 - DNA, 263 bp, Zea mays
  Clone ID: cC-zmpo14820007h10a1
aataatgtgaatatactgtatacatgaataaaatgatggaacctagactacatgaactggggaaggccaccttgcgcttatttgaatatggttcccacatgaacaagcgactacagctcagagctatccatagcgcaccctatacatgaacaagatagtaaaccttgatcataccttaacaagatacagggccggcatcagaatatacatgacagccgccaaataagacgtgccattccgaagtgaataagaacgagatgagt

SEQ ID NO: 12648 - DNA, 371 bp, Zea mays
  Clone ID: cC-zmpo14820007h11a1
gtgttctacatttgtctggtgtttgttgttttccctacgggagggcgacggcttaccttctagaaaaaaacgagcagcgacatcacactagacctccacattgaacgacgagcgcctgcaccgagcgaaccttgcgctccaagcctggtgcccgcgacatgtgctccgaccccaataacgaccacggcaggctgggtaggagcagaagttagctctctacttggagatacgaccctaccggcattatacgacgctaacaccactcgacggtgtgtggcatatacctcgaccgcagcgacatcggggtttaccccaccgaggggctcagcgagcacagcgaaagccccttctgtgacattaactgcaaccgc

SEQ ID NO: 12649 - DNA, 345 bp, Zea mays
  Clone ID: cC-zmpo14820007h11d1
gggggatgatgcactcgagcaggcagacaccatgatggttactttgccggaaaaccaacaaaactatgtgcggtactggcttatggagacaactgtgccgatgaccctgattggcatatggcgctatcctagaaaaactttaggctgagaaaataatctgttgtacctggcgaagtcatcagtgcaacaatttgtgctgagaacggcgtttttgcactgctctaagatgctgaacatcttgcttggaaccatcgtggtccgtgctggctaggccggtccctaaacgtcataggtgatgagcatacaatcatatttggaaggcacgcacatgcacaaacagtgcta

SEQ ID NO: 12650 - DNA, 197 bp, Zea mays
  Clone ID: cC-zmpo14820007h12a1
caggaccgtaggacggcccatgacctagagaaaaaaccggcggcgcatccgaagagaaccccaccttgaacgaatagcgtcatgcaccgagacgaccttagcgcacaagattcatgaccaagcaaaggagcggtgcactttcacgaacaagatacatggcttgcatgaaaagtttctgttcagtttggagaacatac

SEQ ID NO: 12651 - DNA, 227 bp, Zea mays
  Clone ID: cC-zmpo14820007h12d1
gttggatctcgtgctctggaatgcagtcaacatcaagctcagtttgcgggcaaaccacgaaaactattagaggggctggcataaggaacccgctgtgcttgaacgccaacgtctgacatagagctttatccagcgaagtttgtgaatgagacaacatctattataggaatctccatactacgtgatacagttttttaatataacgggattattgcagtgcgctaaga

SEQ ID NO: 12652 - DNA, 421 bp, Zea mays
  Clone ID: cC-zmpo14820008a02a1
ccagaggcaaacattattagcaagctgaatcaagctgtagagtatcctcacaaaaagctagggggagggaaatcagcatccgcaccagcgcaaagtttgtagcttacatagcactgcacggttaaacaaaaaaatagtctgatctgtcttcagcacatcaccgcaacagggtgaagggttggaacatcttcagcggactttacacggcggcggcgttgatgacgttgatgaactcgggcttcaaagaagcaccgcccacaaggaaaccattgacatcaggctgtgctgccagctctttgcagttcgcagccgttactgaacctccatagatgatccttgtagattcagagacctcagggctgacattgatctttacccaatcccttcgggaggcgtgcactttctgagcctgagctggggt

SEQ ID NO: 12653 - DNA, 141 bp, Zea mays
  Clone ID: cC-zmpo14820008b01a1
tttcttttatctatgtgactattccttttccttgacaaaacaggctgccgcccgcaccatacttcagggaattacatttatattctgttaaaaataaataatggttacattgaatggctccaaagatacagttttttacct

SEQ ID NO: 12654 - DNA, 121 bp, Zea mays
  Clone ID: cC-zmpo14820008b02a1
attcaattaaatggtaaaccaaatcatatatcctaggggttgagtacataacgacttgacataaattgataaattataattacgtttttgataataacacagcctgttttctggcctatat

SEQ ID NO: 12655 - DNA, 530 bp, Zea mays
  Clone ID: cC-zmpo14820008b03a1
aatcacgaaaacaacccttattcatcgaatgctttcacagaagatttatccatacatgtatgctcattgtggtagacgcagctgaccacctagagctagctgtatacagattgactcagcatgtggcaacgtaggaacacatgtttatagacgacattcttcgtactaatagcctggcttggctgctaaccaaacgacaaccacgagatcgcaacgatataaaaagaaaaaaactcagaagcaaatcgacaccagaaacccgtcttactcatcaagcactccatccttctcctcgatagcatccaacttccttcaagcagacaagattagccagcttgcagtccttcgcaaaaggtgctgcattctcgccatcaaagcagcgaagaacggatttgggcgagctagcaacggcgtcttcagcagcacagaagctctggtagatgaggatcccaccttcaggcagcttctgctcgacatgttgttgcagtcataagcctccgaccaagttcctttcccatgtcccagcttgg

SEQ ID NO: 12656 - DNA, 470 bp, Zea mays
  Clone ID: cC-zmpo14820008c01a1
tattttttttttaatcaccctttagcccactgcatatttgtattggctaatgactgtacaactgatatcatgggctttatgtttacatgggtcatcagactatcgtctctctcaaccgcaagcaatcccaggtggacacctgggaacttcactatcgccatgggatctcattacattaacattgtcacagataggtgtaaccaatttaaatttgaaatggcagggactgattgcggatttacttctgttttctggactgtccacattaagcaggaagttgcctagcagaaacccagcaacctcttgatggtcgcagctttggcttgtggaacgcgtctgcttggccttgcaatttactttgacctcttaggttcatatctgacattgcttggttcattgatggccattgcactggcttctggctaaggagcttgtttggaggaaccgatgtcttctgccatgggtttcag

SEQ ID NO: 12657 - DNA, 551 bp, Zea mays
  Clone ID: cC-zmpo14820008c02a1
gagccaggaaagagggccgtgtatttaaccgccgacactttacactccagtggcgatattcatcaaacccaatgcttacaatttacagacaatcatgaccagtaaacagaaaagaattacacatattgagtcctggtgaaggacacccatattcagaggagaaccagtgcatatatatcggctgagcgattaaaagaagaagaaaaaaaacacgccaaacaaaggaaaacacctgaatcaatcgtgaacagaacacaagctctcaatactcccggaacaaagtagggacagcgacaactgaaacgcgtggctgacccaaaacaaaccagtgtcgtgccaaggttttcagaaatggcttcattcttctgactgtgcatttagtttctagatgcggcggcttttgtaataccgaaaggatctttgtcatcggagcttatgatgcgcaccttggggatctgctgcacgagatgccagttcttgctaccgtcgaagcagcttctgtgcaatgacagaccacactgtaacctaaaccgtttcaggcccttggcctt

SEQ ID NO: 12658 - DNA, 69 bp, Zea mays
  Clone ID: cC-zmpo14820008c03a1
gtgtcaggaaagagggccgtgtatatataccttcggcacttgacactccatttgtcgatgattcgttac

SEQ ID NO: 12659 - DNA, 455 bp, Zea mays
  Clone ID: cC-zmpo14820008d02a1
aaaccaagttagttaaattttgcaatattgtcttcgaaatggcactgcctacacggagtgactgtgacaccgtactcaccgagcagctgtacttaccgagcactgtctagagtagtttacatggagtaagagaacactggcaccggcggtgcaaaaaacggtacacgggtacatgcagaggccgccggtcgatgatgcaagacaaacagctagcactgctctgacggatccggggcatgcatggcgatcgcgcgagcggatgcgcgtcttcctttttagagagcttgcgccctgacaatggccatgctcatcttgctggggtcggaggcctgcatcttcagctggatgcccttcagcttccttttgaaccggtcctttggagcttgcgttcagcatcttgctcctgaccctcgaggtgtccggggaccaggagatgaaacagatcttgttttttg

SEQ ID NO: 12660 - DNA, 67 bp, Zea mays
  Clone ID: cC-zmpo14820008e01a1
aaaaccgatttgtgagttcaggctgtacgttcgggcatgcggcttggggcggtataaccaatatttg

SEQ ID NO: 12661 - DNA, 445 bp, Zea mays
  Clone ID: cC-zmpo14820008e02a1
ggcggtctccttgggaggagcttcgacaccctcgtggagaggctcagcttcgcggccggcgacactccgcgctccccgatgatggactccagcacggcctcgcagaggcgcttgttttcgatcgtcacgccgccggccgctggcaccgacgagtccttggagaaggcgactgtgaggactcctgcgggcgagtgcgtgaagaggatggaggcgcccggcgcgaaagtctctggcttgaacaccttcctgaacttttccacggcgacgcccttggcgttcgtgaacaggccggcggtctttcagaacgccacgcagttctccggcactttcttcgcgtactgctcgcccgttagcgggaggatcatcgttaccctcgtgaacttcttaaagtcgcccgtgaccgacttctcggaagaaggcggcgtctgaggcgagctcgtcgggc

SEQ ID NO: 12662 - DNA, 487 bp, Zea mays
  Clone ID: cC-zmpo14820008e03a1
aacaagaaaaaaaattcccgcatttcattgcgaaagggggcgtgaacaacattcttcaaatatatgcagaagaagaaaaaatatttgcttagtaatttggagctctgttgtccatgcacatttacgcttcagccaaatgatcgaaccaaccccaaaaacaaaaaaactgaactaaagcgggtcatcggaactgaatattcccagcgcaacaattggtatcttgtggcgcggacaatagccgctcaagcaaatatggtaggtaggagggtcttcgctttgttgttattactgaaaacgaagttggaaccagcaacattatcaacctgcattctaggggaagggggtgtcaattacataccttgttcgagcaggtagtcgcccagcctttccaccaccaggttgccttgccgggagttatgggcttgccgtagatgccattgatgaatgactggcctgttttcttcacagtgatgcccccggatccctt

SEQ ID NO: 12663 - DNA, 52 bp, Zea mays
  Clone ID: cC-zmpo14820008f02a1
ttttcttttttaaacgaacgggggaagctcttgttacatttcttggattaac

SEQ ID NO: 12664 - DNA, 465 bp, Zea mays
  unsure at all n locations
  Clone ID: cC-zmpo14820008f03a1
acaaagagaaccaataatgttactcgcacaagtacagttacaatacgatcctaggaacttcaataatttccatcctttctttttttgaggttgctgctctcaccactgttgtcattgctgttttccccactagcaagtatgacagcaaacttggcatgaaaagaagatggagcaacgcatgcattgtagtgatccacaagatacacatccaacaacattgcctgctcaaaggccggcaatctcaaacatagtagcttataagaaaagcactcaaggaaaggaatacttagaatggggacgaatggggcccttgagcttagaagcacttccggtgaacaatcgctggtcctgacttaatngactcagcctttgagatccacatctgttggaaggtgctcatggaggcaaggatggacccttctatccagacctgtatattcttttgggtggagccaccaccttgat

SEQ ID NO: 12665 - DNA, 325 bp, Zea mays
  Clone ID: cC-zmpo14820008g01a1
tttctttttttagttaaattttgcactattgatttctaaatggcggtgactacactgagtgactgtgacatcgtacttaccgagtagctgttcttatcgatcactgtatagtttagttttatatggtgtaagagaactttggctccggtggtgcaaaaaacggctcattggtacatgcataggcctccggttgatgatgcaagacaaaacatcttgcactgctttgtcgcaattcggggcatgcatggccaacgtgccagcggatgcgtcgttttttttttagagaagttgcgccctgacaattgtccatgctcatttttctggg

SEQ ID NO: 12666 - DNA, 386 bp, Zea mays
  Clone ID: cC-zmpo14820008g02a1
aaaaacacaggggaaactctggttacatttctatataaaaacacacgggagcatgcgtattatgtatttggagcttggagcataaggtgaagaaaatactaggacctgccacgttctagcatgccttaatatacgaacggaacacatagagtaacggcgctagcactatcaaccccctctggagagttagctatgataaatgaacagaacgataccatattctatatacggctgaatgcagggggtggcactctaacaccactcatggtatttcggcgccaggagaatgctgatggtcagacaagcaactaatgggccgagtacaggggcgccctctttgattgcgtgggtcttacacagtaatcatggtttcggtaccattactg

SEQ ID NO: 12667 - DNA, 441 bp, Zea mays
  Clone ID: cC-zmpo14820008g03a1
gccaagtcttattctgtatatacagccacaaattgccatgtcttactctgtatatacagcccaggatgtaagaaaactggagacggattgaccaatatgtgaccaagaatatattcaggcaaaatgatgatacaacaagccttagatggcgaacagtgaattgtaatacccagctgccggttcagtaacgaagtttgattggcgaacggttcccacttcacactgctaacctttttgtttgggcgttcatgtacaaccacattatatcctgcagcttgccgtgcagtacacgaattggttaaaatctaaagtcactcttccttgcttgcttgtatcgaacgaaatgaacagggttacgagctgactgaacaaaattgctgagggatataaactcattccaatgaatcatgcccttcttgctcttggcaaagcttcaaaaat

SEQ ID NO: 12668 - DNA, 184 bp, Zea mays
  Clone ID: cC-zmpo14820008h02a1
cctacattggggcccgaccaggtgtccggtggccaaattttgataacataacatactgtttactattggttgaaagcttttcgcgcaagcaatcttaagaagggtctcccaaattaaaaccatggggggagctagtccattcttattgatttattgtcaagaaatcaatcttttccttttaggg

SEQ ID NO: 12669 - DNA, 527 bp, Zea mays
  Clone ID: cC-zmpo14820011a02a1
ctctcaatctcaataaaagagatgaatatttcgtggtaaagaatacccatagctggggttaactgaacttagttccacgcgccatagcaggcgagcagcactaaagatcgagattaacatttctccactcttcaattacagagcaatagagcatttctcggggctggaaaaacgaaatgctagagatgctgcagcaaacgaggatcaccagtgttgagtatagttaagttcggtcacaaccaccaatcagctaccaacccggatagaaaatgctagcttccaagtggaagtggcacgattgggactgcttccttctgatgacttgaacattcagcgaaaagataaaattcagaaatgactgccctcttttttttggatgtttttttataatatccattacaaagcgaaatccaaggttgcctgctcggtcaacgaactccaatcgaactcagcatgtttgctaaagatacgtttgagttttcttacacatgcagccgagtcagtaagtacgacaacctcataagttt

SEQ ID NO: 12670 - DNA, 251 bp, Zea mays
  Clone ID: cC-zmpo14820011a03a1
gacaacagcataactaacaatgggtattgattaatttccaattgtcatgtccaaacgaatagtgtctcccattctcccctctttacatatcgaaattaacagaaaagggagaaatggcaaagcaaataaaatgaatggatcaatcgacatgttcagacccaaattaaagtacttaaatatatatataaacggaatccaaccgaatacaggcaatggcagccagcagcctctccctccgatctaaaactagt

SEQ ID NO: 12671 - DNA, 490 bp, Zea mays
  Clone ID: cC-zmpo14820011a05a1
gcccaagcattttccatttccatttatcaatcatcaatcacattgttaaatatatcacatacattttttattattacattgcatgtacgtgacattgttgtagaatagaagagaagtatttccccttccaaacaaacaaaaaagaagggaaaacgaagttcgtaatcgtagtatcgaacacacaatcatgtttccctttcctcgatcctctcttcttcccgcggaaaacgaaggaagcccacgcatcgccggaggagcttgtggatagctcgctcgcgggcctgtcccgatcacctgtcgtcgttgtcgtccagctgcgacgggctcctccaaaagccggtgccgtagaacctcgcccacacctccttctccagctcccccttttcctccagctgcaaggcgggcttcacgggcagcgccaccgcattggcggcgccggcattcacctcgacgacgccggtgtcgtccacgaggagctcgtatatctccg

SEQ ID NO: 12672 - DNA, 758 bp, Zea mays
  unsure at all n locations
  Clone ID: cC-zmpo14820011a06a1
aaagaaagaaaggaaagaaaagaaaggaggaanaagaaaaaaaagaaagaaaaaaaagaaaaaaaagaaaaagaaaaaagaaagagagagagaaaaaaaaaaaaaaaaaaaaaaaaaaaagaagaaaaaaaaaaaaaaaaaaaaaggaaagggaaaaaaaagaaaaaaaaaaaaaaaaaaaaaaaaaaaaaaaaaaaagagagaaaaaaaaagaaagaaaaaagaaaaaanggagaaagagaaaanagaaaaagaaagaaagggaaaaaaaggaaaaaagaagaaaaaaaagaacaaaaacagagaaaaaaaaaggaaaaaagaaaagagaaaaaagaagaaaaaaaaagaaaaagaagaagaagagaagaagtgaaaaaaaaaaaaaaagagggaagagaaaaaaaaaaaaaaagagaagaaagaaacaaagaagaggagaaaggagaaaagagagaaacggaaaaagagagaaagaaagcagagagaaaaaaaaaaggaaaaaaaaaaaaaaaaaagaaaaaagagaagagaaaagggaggaaaaggggaggaagaaaagagagaaaggagaagaaaaaaaaaaagagaaaaagaaggaaaaaaaaaaataaggagaaaaaggataggaagaaaagaggaaaaaaaaaatgaaaggaaaaggaaaagaaaaaagagagaaaaaaaaaaagaaaagaaaaaaaagaaagagaaataaaaggaaaagaggagggaggggaaaaaaagaaaaaagaaaa

SEQ ID NO: 12673 - DNA, 406 bp, Zea mays
  Clone ID: cC-zmpo14820011b01a1
ccccccccggggggggaaaaaaagaaggggggggggggaaaaaaaaaagggggggggaggaaacaaggggaaaaccccttttggggggggaaaaaaaaaggggggggcaaaaattttttaaaaaagggggaagggggggacaaaaaaaaagggggcaaaggggggggtaaaaaaaaaaacccccccccccttggaaggggccccaccctataaatttttcccccggttattttttttcccggcccccggggaaacgggccgggggggttttattaattttttaccgaaaaaagggggggaggggggcccccggggggggcccccagggggggccaaaggggggagaacccctgggggggccccgaactaaacactcccggggaacccccagggggcccccgggggg

SEQ ID NO: 12674 - DNA, 454 bp, Zea mays
  Clone ID: cC-zmpo14820011b02a1
agtaataaagaagcacaaattagcatgttatagaatcatatatataggctgccctacacgcgtgcctctcaacgagccgtttcatcccacggtctcaagacatgtgccacgccgcaagaggcaacaccgaaaagaaggacacgcgctaggtccgcatgaagtcggcatgcgtccagtctatcgactgacagacacacgcgaccagcatcaaattacatatgttttaggccggacgacgacgacgacgacgacgacgacgttaccgaacgtagtagggggtcgggaaaaagaaacaaacaaatcaatggacatgttcgtaagggatcatgttggagagcgtgcggcagatctcggacatctcgatgagcgacctgttgtggtcctccatggggttcttggagacggccttcctgaactcctcgtcgcagttctgcgtgtcctgcgccaccatgct

SEQ ID NO: 12675 - DNA, 540 bp, Zea mays
  Clone ID: cC-zmpo14820011b03a1
agtagtaactgccagcatgcctttttattattacccattcaatcgatgaaaaacacacatttgcgtgacattacatttggagttccatcgacggtatatttggaaaaaaacaattagcttagaaaatgccagattaataggaatacaatatatagttccgtccatatcagatggttatcgcatgcgtggccagccggtgacgacgtacgtatagactcgctcagcgcctgagctgaacgccacgtcaccccggcgcatgcatacatgcatgcatgcatggttcattcatttcaaggggcttcgcttcaagaaggaggaggggtgcaggacctcttgcagttctcgctgaggcgcgggttcttctccttggcgcaggtgacgctgcaggccttggtgacctcggccgccttcaccacgtacgccttgtcgcactcctcctggcagaccttcatggccggcgccgtgatgcccttctgctcggtgcacttgcccttgactggatcctgccgtacagcaccaggttggactgctgggagagcg

SEQ ID NO: 12676 - DNA, 462 bp, Zea mays
  Clone ID: cC-zmpo14820011b04a1
gaatcaagcactctgttacatttttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtagccgagcgggttggcggggcgcaggctgtcggagatgccgacgttcctggtgagcaggacgccggcgcggtccctgagcgcctggacctcgtcgcagtccttgcgcgggctggccaccagcaccacctggcagatgtcctcctcgtggctgtccttgagctcgatcgtgtaggtgccggtcgcgtcggtgaccccgtcgatggcgcgctcgagcttgtcggtgccgaagtgcctgcacttc

SEQ ID NO: 12677 - DNA, 354 bp, Zea mays
  unsure at all n locations
  Clone ID: cC-zmpo14820011b05a1
aaaagaagaaaaaaagaaaaaataaatgaaatgagaaaaaaaaaaagaaaagaaagaaanaagaggaagaaaaaaaagaaaaataataagaagaaaaaaacaaantaaanaagaaaaaaagggggaagtgctgagaanacaaaaagaaaaaagaagaagaaaaaagaaaagaaagggaaaaagaaaaaaaaaaagaaaagaaaaagaagagaaagaaaaagaaaaaaaanagaaaaaaaaagaggaaaagagagaaaaaaaaagaaagagagagaaaaagaaaaaaaaaaagaagaagaaagaagaagaaaaaaaaaagaanaagaagaaagaaaaaaaaaaaaagaagaagag

SEQ ID NO: 12678 - DNA, 368 bp, Zea mays
  Clone ID: cC-zmpo14820011b06a1
aaagataggaaacaaagagagagagaatagaaaaaaaaaaaaaagacaaagaaagacaagaagagcagaaaaacaaaacaaaaggacaaaaaaaaaaaaaaaaaaacaaaaacgaaaagaaaaaggaaagaaaaaaaagagagaagaagaagagaagaaaaaaaaacaaatgagagaagaaaagaaaagaatatagtagaagaacgaaaaaaacgagtagaaagaaacgaaataatgagcaaaaagaaagtagaaagagaaaataggaaagaaaaaaagagggaaaaaaaaaaaaggaagaaacagaaaaaagaagaaaagaagagaagaaggaatgacaaaaagacaaaaagaaggaggcacaaaaa

SEQ ID NO: 12679 - DNA, 536 bp, Zea mays
  unsure at all n locations
  Clone ID: cC-zmpo14820011c01a1
cttgccaaatcactggtacaccaaagagtacccgtatatgtaatttttatatccacatctccgcatctattgaacagtgataatggtttgtttacagagagcaggaatatatggagcatctgaaaagaagttgatattggtcacaaacgaacagctgctattcagactagttagatcaggaggaacagattggatgaagctagagtttacaagaatcatattgctccatgggtctgattacgagacagcgagcaataccagtgatttggcaggtaggattaggaataccatgccaccggatgacatggcatcgtcttagattaagagacaacgaggtgctgtctcattaatcttaatattattcatgggcaaaaatcccatggcgacggaccagggtttgcacatcatcttcgccctgcttgcctcacagcttcgagagcgcaatgtccatcacctcaatgaagaagtcggaatcctctttggtgaagcacaacggtggtgttatcctanaaacgttcccgtagaaaccaccctta

SEQ ID NO: 12680 - DNA, 431 bp, Zea mays
  unsure at all n locations
  Clone ID: cC-zmpo14820011c02a1
ctggaggaaatcgatatattccccggacaaactccggcgatggccggagcctgaaacgtgacaaaacatctttgtcctcccctccctgctttccctcccggcttggtcacaatacaatctcatctacgccggagctgcactgcactgcactgcactgcactgcacgagagactgctcgctggctctcgactgcgctccctcgctctccacccaaaggaaaacccaacaagaacccgagctccctcccaagtcccaacccctgtatgtacagtcgatcgtaggcttccgttccgtcccgtcccgtcccggccggtcagctccgcagcgcgacggcggcctcgtgcaccagcgacccggtggcctgcgcgacgccgtgcgcctcccgctccgnggcctcccggcacgacccggcgccgttcatgcggcgcacg

SEQ ID NO: 12681 - DNA, 513 bp, Zea mays
  Clone ID: cC-zmpo14820011c03a1
ataagaaccagttcattacttcattttataggaaaattacagaaacgggaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaggcgtcatcggctcgtcgtagatgccaaccacgagtgcctgccctgtcttcttcacggtgatgcctcctgatcccttcttgccacggatgacggcaccaggctcgccttggatgaccatgtacttggtaggttcgaggaacagg

SEQ ID NO: 12682 - DNA, 476 bp, Zea mays
  unsure at all n locations
  Clone ID: cC-zmpo14820011c04a1
gatgaataataattcatggcaaagcgattaattaataatggagacaacatccacagtaagcccaattagaacatgttgtttcatcagaagaactccgtggaggaaaataatgggagacatcgaagaaggttagtttgttacatggtgtggccagtcgagagtgtctctcccgacctatgccgctatgccaactgtagagaattcaagtgtcgtctccttgctcgatcacacactgatcatcaggtatcatcagccaataattatattagttggcacgcgcatgcacggacagtcggtcagctttgctgcgcctgcttctccttcctgngcctctcgacgtccttcttcttcgcctccaccgtcgtcgtggtctcggcggcggtggcgaccttttcctctgcattggcggctgccgctggcttctcctcctcgacgacggtcttctccacggcttcctcctcttgtgatcgggctcg

SEQ ID NO: 12683 - DNA, 345 bp, Zea mays
  unsure at all n locations
  Clone ID: cC-zmpo14820011c05a1
aagaaaaaaaaagaaaaaaaaaaaaaaaaaagaaaaaaaaataaaaaaaaaaaaagaaaataaaaaaaaaagaaaaaaagaaaaaaaaatataaganaaaagggggaacactgtgagacaaaagaaaaaaaanaaaaaaaaagagaaaagaaaaaaaaaaaaaaaaaaaagaaaaaaagaaagaaaaaagaaaaaaagaagagaaaaaaaaaaagagggaganaagaaagaaaaaaaaaagaaaaaaaagagaaagaacagaaaaaaaaaaagaagaaaaaaaagaaaaggacaaaaaaaaaaaaaaaaaaaaagagcaaaaaaaaaaaggaaaaaaaaagaaaa

SEQ ID NO: 12684 - DNA, 537 bp, Zea mays
  Clone ID: cC-zmpo14820011c06a1
aaaaaaaaaaaaaaaaagaaaaagaaaaaaaaaaagaaagaaaaaaaaaaaaaaaaaaaaaaaaaaaaaaaaaaaaaaaaaagaaaaaaagaaaaaaaaaaaagaagaagaaaaaaaagataaaaaaaaagaagagagaaaaaagaaaaaaaagaaaaaaaaaaaagaaaagaaaaaaagaaaaaaaaaaaaggagataatagaaaaagaaaaagaaaaaaaaaagaaagaaaaaaaaaagaaggaaaaaaaaaatagaaaaaagaaagaaagaaaaaaaaaaagagatagaaaaaaaaaagaaaaaaaaaaaagagagaaaatgagaaaaaaaaaaagaaaaaaaaaagaaagaaaacaaaaaaaagaaaaagaagagaagaaagagaagaaagaaaaaaaaaaaaaaaagaaaagagaaaaagaaaaaaaagaataagaaaggaaaaataaagaaaaaaaggaaaaagaaatagcagaaaagagaaaaggaagagaaaaaaaaatagaacagaaaaaaaaaaagaaaaagaataa

SEQ ID NO: 12685 - DNA, 740 bp, Zea mays
  Clone ID: cC-zmpo14820011c07a1
aaaaacaaacaaacacaaagaaaaaaaaaataataaaaaagaaaaaaaaaaaaaaaaaaaacaaaaaaaaaagaaaaaaaaaaaaaaaaaacaaaaaaaacggaacccttgaaaaacaaaaaaaaaaaaaaaaaaaacaaaaaaaaaaaaaaataaaaaaaaaaaagaaaaaaaaaaaacaaaaaaaaaaaaaaaaaaagaaaaaaaaaaaaaaaaaaaaaaaaaaacacaaaaaaaaaacaaaagaaaaaaaacaaaaaaaaaaaaaaacaaaaaaaaaaaacaaaaaaaaaaaacaaaaaacaaaaaaaacaaaacaaaaacaaaaaacaaagaaaaaaaaacaaaaaaaacaaaaaaaaaaaaaaaaacaaaacaaaaaaaaaaaaaacaaaaaaaaaaaaaactaaacacacaaaaaaaaacaaaaaaaaaaaaaacaaaaactagaaaaagacaaacatacacaaaaaaaaaacaaaagacaaaaagaaaacaaaacaacaaaaagacaaaacaaaaaaaaacacaaaaaaaaagaaatacaaaaaaaaaaaataataaaaacaacacaaaaaaaaacaaaaacaaaacaaaaacaaaaacaaaaaaaacaataaacaaaacaaaaaaaaaaacaaaaaacaaaaaaaaaaacaaaaataaaaaaaaaaaaaaaaaaaaacacaaaaaaaacaaaaaaaaaaaaaaacacaaaaaaatagaaaaaccaacacaac

SEQ ID NO: 12686 - DNA, 489 bp, Zea mays
  Clone ID: cC-zmpo14820011d01a1
aacaatatgttaatcatggaataaacaaggtagtacacagtacaacagtccaatataatccgcttcatgcatatatatacatataaagaagggcgcggctcagctccccgatccgaccctagaagttcttggtggcctggtacgttttgccgaactgccagtcgcggggcgtgacgtgccaggaggtagccttgcggtggtcggcggtcatgacgcggaacgtcagcgactcgccggtgaggtcgacctccgtggtccagagctggccccagctgcgcttcatcggcgtccacttgacgcgcttgttgcccttcacccacagcgccaccacgtccccggcgccgcccacgttggtcaccttcacctcgctgtagtgctggttccccgtgatcgtgtaccggatgccgcctttcctctcgcacgccaccttgcggtaggtgatgggcacgatgccggccttcttctcggcgatcttgaggaaacgccgta

SEQ ID NO: 12687 - DNA, 426 bp, Zea mays
  Clone ID: cC-zmpo14820011d02a1
caagttaatatcattattagggccggcttttaccattttttttaactccaaaaaatccagcctcacgacaactgttgaaaagggaaaatcagtccatgatggccacaaacatgcaaaagctggaagtagattccgagtagaggtccaacgtccaaggcgagctatctcgagtccacaacggtgccttctggaagcgcggacaggtgcacaagaggggcatgtgatttcagggaagcattggcaccagggatcttggtctcctttgttctgtggagcaccttcctcacctcgtttgcaagctctatgatcgaatcatcttcggggctaatgctggctaatgccttctccattgagaacaggtaatccctattatagccagtagggccattggctgtagcaatttgcattgccatatcctgcaaagga

SEQ ID NO: 12688 - DNA, 453 bp, Zea mays
  Clone ID: cC-zmpo14820011d03a1
gatacgaaatttctttgtttccaaactggatcttctctcgatgactgtccatgcatctagaccagaccacacaatttcacaaagataagatgacacaacaaaattatagagcaaacatctgaatctgattatctgaatgcacttcacaccacactagcatagtatcatccttcgccggttttgacgcggtgacgcctacacgtacacctaatctcgggctgtcaagtatccgaggcgtgcaaggcgggcccgggggcgtcgtgctgcggctggtgcatggcgaacgagcttgaccgcgacacgggccgggagtagctggatcggcggaagctggcggcggcgatgtcgtcgtcgtcggggtcggggcactccgcctcccgctcccccgggatcctgcacttctccccgaggatgatgcccttctttcacagcgtgtcctccgactccaccttg

SEQ ID NO: 12689 - DNA, 338 bp, Zea mays
  Clone ID: cC-zmpo14820011d04a1
aagaatccgttgcaagttgcaactctgattcagaattgtgtgaatacatcacacaactcgcaatatggaaagtcgttttctataggtgtatcggacaccgctcgtgcgtgtggcacggcgaaacgaactccgttacataattcgtacgtgtccccgaaaaaaaatctcgggacacaccgggaggcgcgagtaaagccatcgcccatagccgtaggtagtagtagttctccgtactcctgtcctgctcctcgtatcgtatcagcagttcagcacaccaagggggcgagaaggcacacccgctctccctcggtccgcagcctaccagaccagaccgcgtc

SEQ ID NO: 12690 - DNA, 684 bp, Zea mays
  unsure at all n locations
  Clone ID: cC-zmpo14820011d05a1
aaaaaaaaaaaaataaaaaaagaaaaatctgtaggaaaaaaaaaaaggaacatagaaaaaaagagaaagagagaaaaatacaacaaagaaaagaagggggaactgcttgagnacaagaganantgaagaaaaaaacgaaaagaggaaaaaaaaagaagaagatagagaaaaaaaaagaaaagaaaagaaaaaaagggattacgcggaacggaagggggaagagaaaaataaaaaaataaaaagaagagaaaaaaaggaaaggaaaaaaaaaggatataagaagaaaaaagagtgaaaaaggaaataaggaaaacaaagagaaaaaaaacaaaaagaaaagagaaggcaaaaagaagaaaagaacagggagagaaaaaaagaagggagataaaagacaaaataaaaaaagaaaaagagaaaaaaatgacaagatgaaataaaaaaaagaaaaaatagaagagagaaagaggaaaaaaagaaaaagggacaaagaagagggaaagaaggaggaaaggcagaaaagaagaaaaaagagaggataaaacataaaaaacaaagaagaaagggaaaaagagaagaatagaaaaaaaaaacgacagagaacaagagaagaagtagaaagaaaaggaataaaagaggggaaaagtgaaaaaaaaagggaaaaaataaagatagagagggagg

SEQ ID NO: 12691 - DNA, 452 bp, Zea mays
  Clone ID: cC-zmpo14820011e01a1
atattactatagaaaaaaagtcgagtacatgcatattatgtattttctgctgggagtaaaaggtgttgtaaacccatggaactgaaaagtacgagcaagccagaaaatacgaacgggccatcgtgtcatggtgctaccaggtagataaactctggagctatagcatggcaatctgcattgaacgataccatattctatctcccgttcaatgcgtgcgtgcgcgcgcagacacgacgcatggtggccgggggccggcgggcagcggcgcccaacacgcaactaaggggcgtagacgggggcggggcttggagcaggtgactcggacacggtatccttggccaccttacccttacccaccaccactgcttcgacgggcttgcgcgggatcatgttggaatcctcatgggttgccgctgatggcttgatcttgcgcttaccacccttgccgcggc

SEQ ID NO: 12692 - DNA, 95 bp, Zea mays
  Clone ID: cC-zmpo14820011e02a1
agagttgaacattaattaagggcggaatggccgacacacgagttatatacaacacaaccttgcattgttacgatggatcggcaaagatgaaaggt

SEQ ID NO: 12693 - DNA, 451 bp, Zea mays
  Clone ID: cC-zmpo14820011e03a1
gggacagccacgcagttacatttttgttttcctttcctttctcagttacatatttgtaatccaggtgaagaggatttgtggtttagtgccagccagtctgcgacgactgcggtcggtcgtcgacgacgtgctattacatatcgatcgtcgtcgtcgatgtgctattactgatcgtcgtcgtcgtccgagtccaactgtttgagcagcgaggcgcagatgggcagcggcacgtccttgaggtagccgagcgggttggcggggcgcaggttgtcgctgatgccgacgttcctggtgagcaggacgccggcgcggtccctgtccgcctgcacctggtcgcagtccttgcgcgggctctccaccaagaccacctcgcagatgtcctcctcgtggctgtccttgagctcgatcgtgtacgtgccgttcccgtcggtcaccccgtcgatggagcgct

SEQ ID NO: 12694 - DNA, 456 bp, Zea mays
  Clone ID: cC-zmpo14820011e04a1
agagttcagacaaactgtgtttatcgatgcgatcactgatacatttcttcctgatccatattgggtagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccaccctcagcaccctctttctggtcgctgtccatctggtgcagatcctcagcggacgcgtagcggctggtcatgcccacctccttgatctcgaagccgaaccgtgcctgcgacggcggcgggaggatcacgtcatggtacacatcggcgtggcccaacggcggtggcggcggtggcggcgggtaatactccaac

SEQ ID NO: 12695 - DNA, 684 bp, Zea mays
  Clone ID: cC-zmpo14820011e05a1
aaaaaacaaaaagggagaaaaggaaagagagcaaagaaggaaaaaaagaaagaagggaaaagaaaaagagaaagaaaagaggaaagaaagaaggaaagagaaaagaaaaaaaagaaagaaatagaagaaaaggaaaaagaagagagaacaagaaaaaaggaagaaggagaaaagaaaaaaagggaaaaaaaaaaaaaaaaaaaggaaaaaaaaaaaaaaaaaagaaaaaaaaaaagaggacgaaaaaagaaaaagaaaaaaggaaaaaaaaaaaaaaaagaaaaaaaaagcggagaaaaaaaaaaaaaaaaaaaggcaaaaagaggaagaaagaggaagaaaaacaaaagaaaataaaaagaagaaagaaaaagaaaaagaaataagaaaagaagaaaaaaaaaaaaaagagaaagaaaaaagagacaaaaagaaaagggaaataggagaaagaaaaggaaagagaagagaaagcaaaaaaaagagggaagaagaaaaaaaggtgaaaaacaaaaaagaaaaacaaaaacaaggagaggagatgaagaaaaaaaaagaaaagagaagaaggagaagaaaagaagggagaatagaaggagaaaaaaaagaagaaagaaaaaaaaaacaaaagaaaggaaagaaggaagaaaaaagaaaaaggaaaaggaaaaaagagaagaaaaa

SEQ ID NO: 12696 - DNA, 281 bp, Zea mays
  Clone ID: cC-zmpo14820011e07a1
gaaaattaaaaataataaaaaaaaaaaaatattaaaaaaaaatataaagaaataaaaataaaaataaaataaaatagaaataataaaaaaaaaaaagggtgatcctttagaaaaacaaaagagatataagtaaagaaagaaagattaaaaaaataataacggcagaaataactaaagttaaagagtatataaaaaaagaaataattaaattgttaaaaaagagaaatataaagagatgtataaacacagaataggtaatgaaaaaaaaagaatataattac

SEQ ID NO: 12697 - DNA, 485 bp, Zea mays
  Clone ID: cC-zmpo14820011f01a1
ggatcgaatgtcacatctttactatataacaggagttctatacaaaataaataaataatttcattataaggagacaacggtccagcaacccaaagttgactgggagacgatggcctagacctctcacgaactcgccacagcatcctccatgcgcctcatcctgcggtacctgttcttgacctgggacttgagattccaggtaccaacttgctcttcagctgactcgtgacctcactgcgacggcggtggtgagtgcggtgctgcccacggcgagatgcgggcgtgaatgtcgctgagtggatgaacaggcgaacaggttggtcccgtgcggcagcgggagcgcgcggaggcgggtgccgacaggatctcggtggcagcagtgcgggcgagcaccgatggaaaggagcttgggcaccgctcaccgaagatcgaaatccacagcgccatggcgtggtcggtccgggtttgtgccgacgcgtgggtcg

SEQ ID NO: 12698 - DNA, 539 bp, Zea mays
  Clone ID: cC-zmpo14820011f02a1
gacagcaggaatgctgcttttattctccccgtacgcactagcagaacctcctcgtgcaaaaacaaggcggcgaaagcgaaaccaatcgcgcgatcacgcagcgtctccacaagacgaacgcaatccgatgggatcggtcactcacatacagtaattacacacagcagaggcaggagctagcctctgtcgatgatttactactggtcgtacctagagcgcggtcacggtggcctcggcctcgccggccggcgagcgtcgcggctcctgccgcttcgtcttgcacttgtcgacgaccgcgtacaggcggtagggcgacgcgtcggtggcgagccactgctcgacggtgaagagctgctgcgcgcacccgaggtggggccccgtgaccgtggcctcgaggtagttgcagtaccagccgtggtgcgcgccggtgccgtcggaggtgaggttcatggcgcagggcgcctggctcatgcaggggccccggccgctgaagatgtccaggttgccgcgctcgtagtagtcgtggcccgcgcccatga

SEQ ID NO: 12699 - DNA, 217 bp, Zea mays
  Clone ID: cC-zmpo14820011f03a1
caaaaaccggtgaatcttttttttttaaaaagaaattgtttagaaggcaacactggtctccaaatttccctttatggggaaaaaaaaaaaaccccccgaccctttacatggggggcccccaattaaccggggttaattagttgcaagaggggttaattggcgccgggcatgcatccatggggggaggggggggccagaaataattaaaaataagggg

SEQ ID NO: 12700 - DNA, 452 bp, Zea mays
  Clone ID: cC-zmpo14820011f04a1
ctcaagccttgttcacatatatattcaagtgcagaaaggagatcgatacaacaccatcccggctcttacaactggcaggccggccagcgcgcacgcggctagtgcccgtgcttgtgcgcgtgctccggctggttgacgacgacgaagatgttgaggacgttgtcgacgaggcggtagacgttccgctgcatgggcaagaatggggacctaatcgccgggaagtcggcgaaggcgttgtcgcagtcgctggcgctcgtgacggcggccgacagcttcgtgttcatgtcgtcggcctgggcctgggtgcccgccgccggccgcgtggcgacgatcttccgcgcctcctcgagcgtctgcacaacgttgtcgtacccgttgctgcaggctccgaggatggactccatcggccggccctcgtggtttctcgccgcgaactcgtccacccggctctt

SEQ ID NO: 12701 - DNA, 294 bp, Zea mays
  Clone ID: cC-zmpo14820011f07a1
agactatttttttttctatttattttaattataaatctatgaaagaaaaaaaaatggacacaggactaacttcggcgaaggtcggagcataaaatgaaaccaaacatatttgtatacatacatgatttacctttacgattagattatattacaatataaaattatgaccggaaaatggactgtaatgcaatggatagaactgaaagaaaaaatgtaaggtgggattagaatgagatatattatactctaaatctaaaagtgaaaacaccaaaaaagaatctaaaaacttatgta

SEQ ID NO: 12702 - DNA, 576 bp, Zea mays
  Clone ID: cC-zmpo14820011g01a1
tcgcgatctagaactagatcaccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttttatttacgtggtttgcgattggttaattgtttgtttgttcgttcgtttccgggtcgtgtgaattgtcgaagggtttgttctgtaatcgtgactcgatgctaatattattatgatcccattttatttttaaaaaaaaaaaaaggttctagaacgcgagc

SEQ ID NO: 12703 - DNA, 452 bp, Zea mays
  Clone ID: cC-zmpo14820011g02a1
agggcacgggcgttcatatcgtcatatgtgtgtacacacgcatcatgagtcatcttagtagacgctggacagatcccaagctattagtggtttagctttccctaaacaagatagcggtttgactagtcgtagattccgtcaaggaaatcttgacaactttgctctgaacctggcaccttatttatctatctgttcatctgaagtttccagaggttcttttccttgaatcttttatcctactaatttagggagatgctctctgatatttgtcttctgcattcacctagctagattatttgaagggcatccaaatctttgtgcactctaacaagcggtgtcagattccatagtaaaaaaaaaactgaaaaatcccatgggtcacatggtgatgggggacatgctgcatacttaaacacttgaccagtctgcaaatgctatttgtgcaccttttt

SEQ ID NO: 12704 - DNA, 222 bp, Zea mays
  Clone ID: cC-zmpo14820011g06a1
aagcaaaaaaaacaaaagagccggagggaagcacaaacacaaaccccaaaagaaaaagccaaacgaaaacgggggaaaagggaaaaaaagaaaaggaaggacaaaaaaaagcaaaaaaggaaaaaaaaaccaagaaaaggaaaaagacaaggaaagcaaaaaagaaaaacgaaaaagggggcacaaagagaaaacagcggaaaaggacaaaagaggggaaaa

SEQ ID NO: 12705 - DNA, 270 bp, Zea mays
  Clone ID: cC-zmpo14820011g07a1
aaaaaaaaataattatataaatatggttgaaaagggaaaaattttatatgatggtaataaaaattcaagaattgaaagttaattccaagtaaaggtaaaaagttaaaggggagttattttaagttaaaaaaggtgctttttggaagaggggaaaggtgaaaaaaaggggaatgttatttaagggaaatattggaacaattgaattgggatatttattgatttgttgaaaaaatttattaaatttgttggaagtatttataaatgaaaaat

SEQ ID NO: 12706 - DNA, 483 bp, Zea mays
  Clone ID: cC-zmpo14820011h01a1
aaaaaaaaagaaaggaaataaagaaaaagaggaaaaaagaaaagaagaaaaaaaaaaaaaaaaaagaaaaagaaaaaagagaaaaaaataaaaataaaaaaaaaaagaataaaaataagaaaaagaaaaaagaataaatagaaagaagaaaaaggatagagaatgaagaagaagataagaaagaaaaataaaaagaaaaaaaaagaaaatagaagaataaaaaaaaaaatagaagaaagaaaaataagaaaaaaaaaaaaaaaataaaatagaaaaaagaaaagaaaaaaaaagaaaaaaaaaaaaaaaaaaaaaaaaaagaaaagagttaataagaagaggagaaagaatgggataaaaaaaaaaaagagagaagaaaaaaaaataaaatagaaaaaaggagagaaaagtaaaaaatgaaaatgaaagagaaaaagaaaaaaaaaaaaagaaaaaaaaaaaagaaaaataaaaaaaaataaa

SEQ ID NO: 12707 - DNA, 583 bp, Zea mays
  Clone ID: cC-zmpo14820011h02a1
gaacaagattcttcaaatatatgcagaagaaaaaatatttgcttagtaattggagtctgttgtccaagcgattcacgctacagccaaatgatcgaaccaacccccaaaaaaaaagaaactgaactaaagcgggtcatcgtaactgaatattcccagcgcaacaattggtatcttgtggcgcggacaagagccgctcaagcaaatagggtaggtaggagggtcttcgctttgttgttattattactgaaaacgaagttggaaccagcaacatcatcaacatgcattccaggggaaggggttgtcattacatcccctgttcgagcaggtagtcgcccagcctttccaccaccaggttgcactgcccgggagtcatcggctcgtcgtagatgccaatgatgagtgactgccctgttttcttcacagtgatgcccccggatcccttcttgccacggatgacagctccaggttcgccttggatgaccatgtacttggtgcctcccagtatcaggccggtcggggcgaggtgccccggctcgtcgaaattcttcatgatggcaggcatttcttcggcttgaactcgggg

SEQ ID NO: 12708 - DNA, 512 bp, Zea mays
  Clone ID: cC-zmpo14820011h03a1
aagaaaatatttctatattataaaacatccaaatatgcttgcttacatatatatatacacatagagaaagagagagtaatataagtaatccatcgacaatgcttaataatccaaaaaggatgggatcggggtacgcacacgtacgcgtgtaaaagaagaataaatgatggcagaaaatataaatgggtgatgagaattgcaattgcaataattgggcggttaatctccaccttgagtagaagcctcctgttcttctgctttggttacacgccccgcggtagctgctgcttcctcctcctgcagctgcaggttggagcggcgaccatacgcgcgtgcatccacgttggcgtggaagcgcgcagcactggagatgaggtcattgatctgcgcgccgccgtggttcctgtggcgggactcctgcgtgcgcctgttcaagtactcgtccacgtcgccgatcgagaaatgtgccgtcgcagtcgacgccgccagtagtagaagcagcaggcctaggc

SEQ ID NO: 12709 - DNA, 406 bp, Zea mays
  Clone ID: cC-zmpo14820011h04a1
cagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtcggcccagcagtcctcggaatggacgggcaggacaaagcctgtgttgatgagaagcagcagaacgaggaggcctgaagccatcgccttgctc

SEQ ID NO: 12710 - DNA, 778 bp, Zea mays
  unsure at all n locations
  Clone ID: cC-zmpo14820011h05a1
aaagaaaaaagggaggaaaagaaaaaaaaaagaanagaaaaaataaaaaagaaaaaaagaaaaaagaaaaaagaaagaaaaagaaaaaaaaagggggaaaagaaaaaaaaaaaaatagaaggaaagaataggaaaaaagaaaaaaagaagaaaaaaagaaagaagaagagaagaagaaaaaaagaaagaaaaaaaaaaggaaagaaaaggagaaaagaaagaaagaagaggaaagaaaaaagaaaaaaagaatacaaaaagaagaagaaaatgaaataaagaagaaagaagagaaaaaaaacaaaaagaaaaagagaaaaacaagaaaaataaaaaaagaaaaaaagagaaaagaagagaaagagaagcagaagagagaaagagaagaaggagaaaagagacaagaaagaaaagaacaaaaataaaaaaaaagaaaaaagaaaaagaaaagaaaaaggaaagaagagaggaaaaaaggaaacaaagaaaaaaagaaaaagaaaagaaagaaaaagagaagaaaaaaaaaagaagaaaaaaaaaagagaggaaaaaaaagaaaaaaaaaaagagaaaaaaaacaagaaaaaaaaaaaagaaaaaagaaaaaaagaaaaaaaagaaaaaaagaaaaaaaagaagaaagaagaaagagagaaaagaaaaaaggaaagaaagaaaaaaaaaaagagaaaaaacaaaaaaagaaaaaggagaaaaaaaaaaaaaagaaaaaagaaaaaaaaaaagaagaaagaaaaagaaaaaaggagaaaaa

SEQ ID NO: 12711 - DNA, 336 bp, Zea mays
  Clone ID: cC-zmpo14820012a01a1
aagagatacaaaatgcaaattctatttcatcgtttcgtattaattagagatttacaaggacaataatctccatgactgcacgacaacatagatctaaaatgccaatgcatcgttgaacccggcatcataagcggcgtcggtctcatagtcaccgatcgcctctccgagcatcatccccccgaccgcaccgcctaggagccctaggccgagccccatccccataccttcgccatgcctcgccggtgcagctaccggctgtgctgcgtagttgtacatcgccggttgtggggaagcagcattgtacccgtacggtggcggagcatggtacccgtaagg

SEQ ID NO: 12712 - DNA, 413 bp, Zea mays
  Clone ID: cC-zmpo14820012a02a1
attggaaaaaaactttgggccctcgtcttattcaaaatatttatttaaaagatgtaaaattttaagccaagtacaagctaccttacgtgataaaacatttcacaaaaaatggtaattcatttttttttttaacaagaccggggatcaaagtttttttaaaagttaactgggccctatatttatgggtgggggggggatatatgcatttcgtttgctttcgttggccgagcgccgatgccacccacaaaatgtcagaagagccccgagtttgatgggttcgtcgttcacgtgtggggggtgtctgatgtctccgccaggtgccggggcactaagactatttctagcagaccgtataaaaatcgggcaaaatactattttgtgttgtagatcacaccggttgtataatattggct

SEQ ID NO: 12713 - DNA, 419 bp, Zea mays
  Clone ID: cC-zmpo14820012a04a1
agagcatcaaacaaaatgtgattaataaactagctacgatggagtacgtgagtgttcgattatatatagcctgctaaaagaagagattaacgcctaccgtaccactagcatatatgccatgtttggtgttgatgctgatgaagatgaaatgggatcccaaaacatattacaaagggaaaggatctctcatccgtcttgcagctcttgcaagctgtatgccttgctggcccgttcctcagctaggcacactgcggccatcgtcgtcgttgtcgtcgccgccggctatgggcggcaacgcggcgagcgaggtggtcgacgcggccctccggacgacggagcagcaccggagcacccgccgccgcttgttgaacgggttctccggcttcgccaggtcgcgggcgctgtccaccgccgacgcc

SEQ ID NO: 12714 - DNA, 61 bp, Zea mays
  Clone ID: cC-zmpo14820012a05a1
ttttttttttttttttttttttttttttttttttttttttttttttggtttttgttttttt

SEQ ID NO: 12715 - DNA, 336 bp, Zea mays
  Clone ID: cC-zmpo14820012a06a1
aaaaggaagactgaatcatagaggtcattacacttacaaattgcaggaattacaaaacgatgagtcgatcctcgatcgatgtatgagatgacatcaacgcgacaaacagataatagtagtatagtagaagaatagaaaggaaaaaaattcgacggggtcgagaaattagaggaggaagattgatcgaatcatatgtgggttgctgacggagcagcgattatatcgagctgaagcgatgaatgcgctgggcgatcaagccggcgcggcgccggcggcaccggcgccctggtccgtggagccgcacgcctggttgcacatcttggtgcaggcggggtc

SEQ ID NO: 12716 - DNA, 453 bp, Zea mays
  Clone ID: cC-zmpo14820012a07a1
gccatagcacataacagtgctggcacatttcttgtaaccaatttttgcacaggtattggacgctgacacagcagctagcacaccacaccatcaacggatgcaacatgaggccgggggatatatttgcgactggcacactgagtggacctgtatggagtaaacattgcaacttctatacccatagtatgaatcttactttgacatgtgccatttcaggaaccggactccctcgggtgtctgctggagctgacatggaacgggcagaaggagataccggtggggaatttgacccgcaagttcctagaagatggagatgaagtcatcttgacaggatgttgcaaggtactgtgagttcgtctttcctgatcaattcagatctaggcctctacagtgacgctaggctgtattttgattccaccatccgctggttcttcagggtgaaggctacaacat

SEQ ID NO: 12717 - DNA, 560 bp, Zea mays
  Clone ID: cC-zmpo14820012a07d1
agccttgctagatagcggcatgaactctttgatagttgagaccgttgagacaactctctgatagctgagatcgttgagactccggagaactgatgccaagacgtgttggctcagggaagtgccggcagaaccttcccggtgcatgttccaaaaccaatgttgtagccttcaccctgaagaaccagcggatggtggaatcaaaatacagcctagcgtcactgtagaggcctagatctgaattgatcaggaaagacgaactcacagtaccttgcaacatcctgtcaagatgacttcatctgcatcttctaggaacttgcgggtcaaattccccaccggtatctccttctgcccgttccatgtcagctccagcagacacccgagggagtccggttcctgaaatggcacatgtcaaagtaagattcatactatgggtatagaagttgcaatgtttactccatacaggtccactcagtgtgccagtcgcaaatatatcccccggcctcatgttgcatccgatgatggtgaggcggtgctaactgctgtgtcagcgtccaatacct

SEQ ID NO: 12718 - DNA, 481 bp, Zea mays
  Clone ID: cC-zmpo14820012a08a1
ctcaaaatagtataacacatatttgtacataaattattatggtattatatgtttccgttgcaacgcacggacactcacctagatatcgacaaaaacttgtgtgatatgtaaacgcaacagataatttcccttatattttccacacggattttgcatattatagtgatgtttgttgttccgtatcaatgtttcatacaaatcttttacttccgtcgcaacgcacgggcacatacctataacaatacaacacacatatgtacataagttatcgtgttattatacagttccgttgcaacgcaccggcactcacctagtgattacataagttggtatctagataaatgatagctagagaaagattttatttttagctaagatgaactctattagatggttatagtgatattgatgcgggtacatttacccatgtgtagacaagtggtatgaataatataacccatactcataccaacgggtagag

SEQ ID NO: 12719 - DNA, 511 bp, Zea mays
  unsure at all n locations
  Clone ID: cC-zmpo14820012a08d1
tggcaagcccatctctctctctgagcaacagcttattgactgtggttttgcattcaacaatttcggatgcaacggaggccttccatcccaggcctttgaatacatcaaatacaatggtggccttgacactgaggaatcttacccccaccaaggtgtcaatggaatctgcaagtttaagaatgagaatgttggagtcaaggttttggactcggttaacatcaccctgggtgctgaggatgaactgaaggatgctgttggtctggttcgcccagttagtgttgccttcgaggtgatcactggtttcaggctgtacaagagcggagtttacactagcgaccattgtggaactacaccgatggatgtgaaccacgctgttctggctgttggctacggtgtcgaagatggtgtaccctactggctcatcaagaactcatggggcgctgactggngtgatgaaggttacttcaagatggaaatggggcagaacatgtgcggtgttgctacgtgtgca

SEQ ID NO: 12720 - DNA, 424 bp, Zea mays
  Clone ID: cC-zmpo14820012a09a1
agcatggaaacgccaaacgtggttgttgtgacaaagttcacgcttagccaaggttatgcggcgacgcaatggcggaagcacggtggttggcggcgggcccagccggccagcccagtgcagataggtgagatcttgggtgggggactgggggcccaagtttcaccaacgcacctacacgctcagaaaagctccagcttttacagggaactgcgcgcgagtttacgctgcagcactgagagtaatccacaagagagatgatggagtcgtgaaaaaggggccgcatctttctctttcctgaccagatgaaccgctgctgcaccggcacgttctcctcgtccgttgctgaagctctgccacccctccctatggaggaggaggaggcaagagagtgggtttccggcttcagtcgcaggggttcctgaac

SEQ ID NO: 12721 - DNA, 645 bp, Zea mays
  Clone ID: cC-zmpo14820012a09d1
cccacgcgtccggtggcattcctcgaggcccgagttggccagctctccccgtcgtcgtccgtccctctcctcgtctgcgcctccccggactccgtcagggagggagggaggtgaacgggccggggagagagatggggccggacttgtcgcccaagaagttgagcctcaaggagcagcgcgctgcctacctccagtggttcgccctcgccgacgaagacggagatggccgtctgacggtgaacgatgcgctcaggttcttcgccatgtccaacctctccaagcccgagctaaagcaggtttgggcgatcgctgattccaaacgccaaggatatcttggattctacgagttcatgactgccatgcagctggtttctctcgcacaagcagggaacgaaatcaatcaagacacccttccaaatgcagatctcgagaagttgcagctccccacaatggaaggtctggctaaaaaactaaaaaagaactctgtgagcaagatcgattctgctattgctgcatggcatccatcagaagcacctactatgactgccagcttggttaactccaaggcaggaaagaagattcctttgcatcagtcacttcattcgcgatgggttaagaaatcgtcattgagagttgaggccctgg

SEQ ID NO: 12722 - DNA, 523 bp, Zea mays
  Clone ID: cC-zmpo14820012a10d1
ggcgaacctggagctgtcatccgtggcaagaagggatccgggggcatcactgtgaagaaaacagggcagtcactcatcattggcatctacgacgagcccatgactcccgggcagtgcaacctggtggtggaaaggctgggcgactacctgctcgaacaggggatgtaatgacaaccccttcccctggaatgcatgttgatgatgttgctggttccaacttcgttttcagtaataacaacaaagcgaagaccctcctacctaccctatttgcttgagcggctcttgtccgcgccacaagataccaattgttgcgctgggaatattcagttacgatgacccgctttagttcagtttttttgtttttggggttggttcgatcatttggctgtagcgtgaatcgcatggacaacagactccaattactaagcaaatattttttcttcttctgcatatatttgaagaatcttgttcacgccccctttcgaaatgaaatgcgggaattttttttctgttaaaaaaaata

SEQ ID NO: 12723 - DNA, 536 bp, Zea mays
  Clone ID: cC-zmpo14820012a11d1
aagcacctcctcttcccccgccgggcaacaactcagccgccgcaaccgccacatcagccatgggcgcctgcgcaaccaagcccaagacgcttgaggggcaggccccagctgaggccgccgtctccacacccaaagttgctccccgaggccactccaatctccgttgaggttgcggctgatgaacaggtagctgagaaggtggtggtggaggagccggctgcggcggccgacgttgagcatcagaaggctaatgacgtgctcgcgtggagaggcggccgtcggcgagcccgaccacaacgaggaggaagccgtggagaagaccgtcgtcgaggaggagaagccagcggcagcagcccatgcagaggaaaaggtcgccaccgtcgtcgagaccacgacgacggtggaggcgaagaagaacgccgaggaggcccgtaaggagaagctggcgcagcaaagctgatcgactgtccgtgcatgcgtgccaattaatataaatggctgatgatgcctgatgttcagtgtgtgatactgtgatc

SEQ ID NO: 12724 - DNA, 149 bp, Zea mays
  Clone ID: cC-zmpo14820012a12d1
acgggtcgcgtctgtgatgcgatgcaacgggcaagctttactaccactatagaggccacatcgtgcttgagctggtacagacgctgcgttgtgtgcctagccatcacgccgagcttgagcttcacactcacgctctgctgcagccagca

SEQ ID NO: 12725 - DNA, 358 bp, Zea mays
  Clone ID: cC-zmpo14820012b01a1
agaggtcattacacttacaaattgcaggaattacaaaacgatgagtcgatcctcgatcgatgtatgagatgacatcaacgcgacaaacagataatagtagtatagtagaagaatagaaaggaaaaaaattcgacggggtcgagaaattagaggaggaagattgatcgaatcatatgtgggttgctgacggagcagcgattatatcgagctgaagcgatgaatgcgctgggcgatcaagccggcgcggcgccggcggcaccggcgccctggtccgtggagccgcacgcctggttgcacatcttggtgcaggcggtgtctttcttgccgttggcgcagcgctcgtagcagtcgtcgtagc

SEQ ID NO: 12726 - DNA, 411 bp, Zea mays
  Clone ID: cC-zmpo14820012b02a1
ggaaaagcgaatgaagcggaaattaaaaagaactagtgagctagatcatcatcaaggatgagataccatgcatgcatgcaaaaggaaggtcatcatcagaccaggcaagccagtgcctcgatgcttcccttggcggtgcccttggcgttgctgcagacggccatggttttgttgttcttgccggcgtactccacgttgacatcgatgagggagacgccgctgcatggctgcgtctccgagcagagcaggctgatggcctcgggcgtggacgacgtgccggtgatgttgcggaacgtgacgtccttgacggagacatgcgaggagttgctccgcttgccagggcataccttctgcgggcagaagtactggtcgatgacgatggggttggccacctcctccatcctgatgttc

SEQ ID NO: 12727 - DNA, 335 bp, Zea mays
  Clone ID: cC-zmpo14820012b03a1
gggattaaaagaaaaaatttttttccctcaaattcaggggggtcccccggcgaacaaattatttatggggaatgattcaccttttaccggtgggcgttgcccacgggcttccaccaaagggccctgctagggccagagaaaaatttttactttagagatgggccaatccacgggggggttaaaagcatgctatcttctttagggcccccttgggggttgccctggggttcgggccttaaaccataggctttttggtggtgccccttttctcgtcctttaccttatccctgggtacccccgtgcactggacctttgctgtttaaaaaaaggttaag

SEQ ID NO: 12728 - DNA, 393 bp, Zea mays
  Clone ID: cC-zmpo14820012b04a1
ggttgtcatacttatacattaatcatcaaaagttgagccacatacatcagtatacacctcagatatgcgaagcaagaaacatcagttgccatgcatacagtaacgatcgacgaccaatgtataatgcatgtgtgtaatatatacacacacgcggtaccacacgctaaggcctggtacctgcacgcgcgtgcgacattgacattgcgcgcacatcgaccagagagatatgatcagccgcgacagccggtgatcgggttgcagccgcgggtgtagtcgttggcgggtttccctgggcgggaggcctcggggcccaagttcttatcgcagttgcccagtaccttgcagctgatcaaattgtcaaatgacaccatcccctcggcgctgacggccccc

SEQ ID NO: 12729 - DNA, 480 bp, Zea mays
  Clone ID: cC-zmpo14820012b05a1
gtggtataatatatttatattgcagtcggtccatccatgattgaccgtatcagggattgacaatttggcagcacatcgacgtggttaaggcacaatttgatgcaacaagggaacaaaaaagaagaatgaaagaacatccttatgtgttacactcagaatcgcagcttgctggcatacgcaagcaccagctcgcttccatcacacgcaaaaccttttttctcgtgggcgtgaacaattcactgctgtttgcttctaccaacgaaagaaacgcttgcttttcttcttcttctcaatgtatgcaacgatctccaactgacgctcaagagtctcctgcaaggtcttctttgtagctgcaagctcctcttccagtgcactaacgcgggagacagcagcctgcagaacctcctccttatcagcaggcattgatgcgggttctgtcaggagtgcaatgaccttctcctcaagctccgagaggcgctt

SEQ ID NO: 12730 - DNA, 368 bp, Zea mays
  Clone ID: cC-zmpo14820012b06a1
gccgcgatctcggcgggcgtgccgacctgcggcatccgcccgcagcgcggcgccagcgtcaggaggggcagcgcgtgccgcagcctctggaacagccgggccggccgggacgacgagcccgcctggtgccgccgccgcgatggcggctcctccagcgtgtggcccggtgtgcgggcctgctggccgcggacgccgttgtcgtcgagggaggaggcagacgaggacgtcgtcgacctcccggtgccggcggacggcaggctgtcgctggggcgtccatgggcggggtggatagcgaagccgcccatagacgcgcgcgcgacggccggcggcgaggtgtccggcgacgacgaacgaccggtggatgcgat

SEQ ID NO: 12731 - DNA, 309 bp, Zea mays
  Clone ID: cC-zmpo14820012b07a1
aaaaaaaaaaggggggttttaaaaatgggggggttttgggccccaaaaaaaaggggccccctccctgggctttaattttgggggggggccccccaaaatttaaaaaacccccggggtttttttcccccccgaggggatggaaaaaacatgaacccccccccccccggggttaaaaaaattccttttcccccccccaggggggatgggggaaaggaaaaccctttccctttttttagggccccgggcccgggggtccccccgggaatatcgggccgggccccgggggggccccccctttcccttttgggg

SEQ ID NO: 12732 - DNA, 416 bp, Zea mays
  Clone ID: cC-zmpo14820012b07d1
gtgacctgatcgatggtagctgctgttcctgtcgccattgccttctgctggcaggaacaggaactctctgaagcacggggtcagggtagttcatgttgcttcgattcgatcgtaggggagataatgccggatggcttctgtaagtttgggaggacatgcatcataattgaagtcaagtgataggatcctgttttttaagtacacgatacatcacaatcttaacatactccctttgttttaaaaaaaaaaaaaacatttaaatataattcaaaaaaaaaattacatataaaataactaattctataagctactaagtgctgagcctttatcttaaacatatactataaaaaaagggcgggcctctttaagggaaccatgcttcgtaccccgggcatgctaagtcaaatctttttttt

SEQ ID NO: 12733 - DNA, 534 bp, Zea mays
  unsure at all n locations
  Clone ID: cC-zmpo14820012b08a1
acaaagagaaccaataatgttactcgcacaagtacagttacaatacgatcctaggaacttcaataatttccatcctctctttttttgtggttgctgttctcaccactgttgtcattgttgttttccccactagcaagtatgacagcaaacttggcatgaaaagaagatggagcaacgcatgcattgtagtgatccacaagatacagatccaacaacattgcctgctcaaaggccggcaatctcaaacatagtagcttataagaaaagcactcaaggaaaggaatacatagaatggggacgaagggggcccttgagcttagaagcacttccggtgaacaatcgctggtcctgactcatcgtactcagcctttgagatccacatctgttggaaggtgctcagggaggcaaggatggacccttctatccagacactgtattttctctcgggtggagccaccaccttgattttcatgcttgctcgggcaagggcnggtgatctccttgctcatacngtcagcgatgccagggaacatg

SEQ ID NO: 12734 - DNA, 621 bp, Zea mays
  Clone ID: cC-zmpo14820012b08d1
cggacgcgtgggcggacgcgtgggcagccttccttcattggtatggaagctcctggcatccatgagaccacctacaactccatcatgaaatgcgacgtggatatcaggaaggacttgtatggtaacattgttctcagtggtggcacaaccatgttccctggcatcgctgaccgtatgagcaaggagatcaccgcccttgccccgagcagcatgaaaatcaaggtggtggctccacccgagaggaaatacagtgtctggataggagggtccatccttgcctccctgagcaccttccaacagatgtggatctcaaaggctgagtacgatgagtcaggaccagcgattgttcaccggaagtgcttctaagctcaagggcccccttcgtccccattctatgtattcctttccttgagtgcttttcttataagctactatgtttgagattgccggcctttgagcaggcaatgttgctggatctgtatcttgtggatcactacaatgcatgcgttgctccatcctcttttcatgcccagtttgctgtcatactagctagtgcggaaaaccaacatgacaacagtggtgagaacagcaacccacaaaaagagaggatggaattattga

SEQ ID NO: 12735 - DNA, 420 bp, Zea mays
  unsure at all n locations
  Clone ID: cC-zmpo14820012b09a1
gtcaaattaacacaaatcaatggacgacatatatgacagatcaccgtggtcaaacaaattttgtcgagaatttaaatacgggtatatatatagagagaagctacgcacaacgacagcaatggcagtagtttttttcttttctttttggggtgtgtatgtgtaattgtgtatatatatactgtcgtagcgccaccgcctcctccaccgtccaacggcacgtacggccgcgacgacgacgtcaatgtatggtgtgcgatcggtggagccaggctgcgtgacctggcaggcaggcagaccagaccagaccagaccgaccggctcggcgacgactgcgcgccccggcagcagctagcgctgggctcagttcatgttgcgggcgcancgcgtgatggcggagcacccgcggcggtaggggttggc

SEQ ID NO: 12736 - DNA, 567 bp, Zea mays
  Clone ID: cC-zmpo14820012b09d1
cagcgaaccaagagagcagggtgtgggcgaagagaccccagccagtcgatcgttcaagaaaaataccagcttaccagcaacagcagcagcaagcccacccgttcgacgacatggcccgcctcggcgccggcgccgtgttggcgctcctagtggcggtcgcggcggtggccgcgttcctcgcggtgccggcctcggggaagtccggggagctgagcgcgatgggggtgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgtcaacccctaccgccgcggctgctccgccattacgcgctgcgcccgcaacatgaactgagcccagcgctagctgctgccggggcgcg

SEQ ID NO: 12737 - DNA, 592 bp, Zea mays
  Clone ID: cC-zmpo14820012b10d1
attgagctgaagtttgatgacagcattatgtatcacaggaaagaccttcagtgtgctcttaaagctgtattgcaaggtgtttttgagcatgctaggaacagaccagtctttttttcatcgttccatcctgatgcagcacagatgatgcgggaactccagagcttgtatcctgtacttttcctagcagaaggagggaggtcgaaggaccgcgatgcaaggaggaactcgtgtgacgacgccgtgcgggtatgcctagagtacgatctgcacgggatcgtgtcagaagcgagaggcgttctcaagaacccatgctcgggcgccagagcacaagaatctaacctcgcgcttctcacgtacgggcagctcaacaacgtgtgggaggcagtctacatccaatacctgatgggcgtgcacggcgtcatcgttgaccgggtggaggagatctcggacgccgtggctggttttggtctggggaaaccaggcctcggccggagcggtgctggcgtggacggagcgaaaacgcatcaggctgaggccttctcgcagcagcagctggagtacctgctccggcttatccctgaactgattgagc

SEQ ID NO: 12738 - DNA, 545 bp, Zea mays
  Clone ID: cC-zmpo14820012b12d1
gtcagatccttctcctccacggcctcatcggcaacaagtgggcgcgcatctccaagcacctctcagggaggacggacaacgagatcaagaactactggaacacgcgcttcaagcgccggcagcgcgcgggcctgccgtcctacccgccggacgtcgagcggcagatcaagctgctgcgcgcgcagaacgtcaacccgttcgcagacgcagacgccgacgccgcccacgccaacgccaacgccaacgccaacgccagcggcggggggccggcgccggcggggctgtacgacgtcggaaacccgttcgcgttgctctccagcataccgtcactgtcgcagacggcctcgcactcgcactcgccactgatcaaccagaactacccgcttctgaaccagatgcaggtgttccaccacctcggcggcagtcagcagccgtcgttccaccaggacggcagcgcggcggctttcggcgacatcgtcttctttcgcctgccgtcactgccaaccgtcagaacgcaagcggagctactttcgaaccaattcgac

SEQ ID NO: 12739 - DNA, 412 bp, Zea mays
  Clone ID: cC-zmpo14820012c01a1
ggggtggggttttttttttttttttttttttttttttttatgtttttttatatttatttataaaatatctaaatttaatattagaggaaaaaaaaaaagggggggggcaaacccccccgggggggccccccccccccaaaaaaaaaccgggggggggcccaaaaaccaccaaaaaaaaaaaaccccccccccccccaaaaaaaaggggttttgggggggccccaaaaaaaaatttaaaaaaaaaacccccccccgaaaccaaatggggggggggggggcccaaaagggggccccaaaaaaaaaacaccccccccctgggacccccgggggggggggcccgggggggggggggagaaacccccccggggggggcgggggggccccaaaaaaggggcccccccccgggggggga

SEQ ID NO: 12740 - DNA, 442 bp, Zea mays
  Clone ID: cC-zmpo14820012c02a1
ggggagagcaaaattttagtcacagtatcatacaaaaaatctggtgtctgctggaacaaggagcttagtacattgcaggttgcagcaagagcttgtaactatggacaaaaatcgccttggataaattctaatcagccagacgctgcatgaagaagggctatcaagactcttcttgtacaatgaatcatgtgtttttatgataataaatacaatcgggacgaaactgacagccatggtgactctcaagtctcaacccaccaaaaaaaactcgatcagttccgtgttcttgtatgaagggaccattcactgccttgacagtagtattattaaaatcttcatttttttcctctctcacaagaattacttacacagccattctgccaattccgatgaagtggcacttgtatcacaaagacgatcaaaaccgtgctccctagtccct

SEQ ID NO: 12741 - DNA, 426 bp, Zea mays
  Clone ID: cC-zmpo14820012c03a1
agctgtgtgtttacatacaaatatcaaaccgaggaaagcgaccatgttaaataaataaataaaatatcgcagagattttgcaacccctgcacgaaacgaaaccagtctccgctcctcagaaggaggcgaaggctcccgcggcgacagcggcggcggcgcatacgcgcgccgcggcgctggcgagtgcgacgggcgcgttgctggcggcggcgccgcccgcggttgcttcggcgccgggcggggcggggacgtcgtccctgggctcagtcatggtggccccgttgggcgcgccgacaggggcggcgtcctcgtcgtcgtcgacggcgttctcgtcagaggccggcttgtcgccgtccaaggaccccagcggggtatgcgccacgggggtcaggatggtgggcatggcgttggcgtcttcggcggatg

SEQ ID NO: 12742 - DNA, 449 bp, Zea mays
  Clone ID: cC-zmpo14820012c04a1
gaaaacaagaaatacataaatatcgtatattacttcatgcaaggaaaacatgtggtgaaagacaaatcagaacaacgattcacagtcatttcatagtatgataacaaatatcccaaaatacatgtgaatttggcagtttatatattatgccttaaacaacaacgaatggagcagactgggcagtcgcagttgggcaccatccatcatcgccggcgaagtgagccaatccgaggcgcccggactagtggcagttggggcgcaggcactggcagaagggcaccaggttggggaactcccagtggcagcggccgtccggcatgccgcgccccgcgcaagtgtcgtcccggcagttgtgcgtcttggtgcagatgacgcgggtgtcggcccagcagtcctcggaatggacgggcaggacacagcctgtgttgatgagaagcagcagaacgagg

SEQ ID NO: 12743 - DNA, 233 bp, Zea mays
  Clone ID: cC-zmpo14820012c05a1
ggggggggtttttttttttttttttgattgttttttatcggaagggagccggcgggcaacccaagacagtcaaatataaaacaacaagagggctaaaaaagaaaaggggagaaactgacaaaaacacaaaaagggaaaagggaaaaaggcaagaccaaaaacaaagaaacacaaaccgagatcacaagaaggaaagctaagaaatcaagcatgaaaaaagcagcggccccaaa

SEQ ID NO: 12744 - DNA, 478 bp, Zea mays
  Clone ID: cC-zmpo14820012c06a1
gcaaattctatttcatcgtttcgtattaattagagatttacaaggacaataatctccatgactgcacgacaacatagatctaaaatgccaatgcatcgttgaacccggcatcataagcggcgtcggtctcatagtcaccgatcgcctctccgagcatcatccccccgaccgcaccgcctaggagccctaggccgagccccatccccatacctccgccatgcctcgccggtgcagctaccggctgtgctgcgtagttgtacatcgccggttgtggggaagcagcattgtacccgtacggtggcggagcagggtacccgtaaggctgccgcgggtacgccgcgtacggcgaacaatattgttgcggcgggtatgcggacgccatggcctgcggcggtgggtacacggtgggcggcaccatagtcttgtccgtcgtgttcttgtagtcctgcacgtacttcttggcgtactggacttgttt

SEQ ID NO: 12745 - DNA, 483 bp, Zea mays
  unsure at all n locations
  Clone ID: cC-zmpo14820012c07a1
acgcgatgattgaatgaattgttgaatggattcaaacaaatggcaagcgatgaaatgatacaagtgttaatccctctctcaggggaagaacatcagcggcatgcatcaattcgttaaattaaggagaaagagggaacaaagaaaaagaggacaaaaggtgtgtcgaatcaaaaaacatgcccacgcatcggaatgcgcgcagccatgtcactctctctccccttcgtctcttcctcggcctccgggcgccccggccggctcactgaatgtagtaggcgaagaaggaggcgacggcggccccgagggcggcgccgacggcgggcgcgactgcggaggagccgctggtgggggccggagccggagcctccgcggcgagcgccacggtggccgccgaggcggcgactaagacggcgcangcgatcttcttcatctccatccctgaatgccgcggcggcggtggagggcgggactgaatggaacgga

SEQ ID NO: 12746 - DNA, 330 bp, Zea mays
  Clone ID: cC-zmpo14820012c07d1
cgggagcacagagctagctagccagccagccagcagccagcttgctcgccgcgcccgtccttcttcctcgcctccggtccagtccgtcccgccctccaccgtcgccgccgcattcagggatggagatgatgaagatcgcctgcgccgttcttgtcgtcgcctcggcggacaccgtggcgctcgccgcggaggctcctgctcctgccgccaccagcggcttctcctccgacgcgcccgccgtcggtgccgccctttgggccgccgtcgtctgctggtaagcctactacatttagtgagttggacggtgctcctgtaggccacagaagagcc

SEQ ID NO: 12747 - DNA, 441 bp, Zea mays
  Clone ID: cC-zmpo14820012c08a1
gcaatattgtcttcgaaatggcactgcctacacggagtgactgtgacaccgtactcaccgagcagctgtactcaccgagcactgtctagagtagtttacatggagtaagagaacactggcaccggcggtgcaaaaaacggcacacgggtacatgcagaggccgccggtcgatgatgcaagacaaacagctagcactgctctgtcggttccggggcatgcatggcgatcgcgcgagcggatgcgcgtcttcctcttcagagagctcgcgccctgacaatgtccatgctcatctcgctggggtcggtggcctgcagctccagctggatgccctccagctccctcttgaaccggtccttggagctcgcgtacagcatcttgctcctgaccctcgaggtgtccggggaccaggagatgaacaagatcttgctcttctggcagttc

SEQ ID NO: 12748 - DNA, 568 bp, Zea mays
  Clone ID: cC-zmpo14820012c08d1
catcgccatcgcgcaccgcctccccgtgtcccctccttctcgcccggcaccgtcgagctcggctgtggaaacagaggaaacccatcaaccatggcgaactcggcgtcagggatggccgtgagcgacgagtgcaagcttaatgtccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccggtacgccgacttcgatttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcaaggcgcgagctctcttgagaggaagacgcgcatccgttcgcgcgatcgccatgcatgccccggaaccgacagagc

SEQ ID NO: 12749 - DNA, 128 bp, Zea mays
  Clone ID: cC-zmpo14820012c09a1
gaatcttgaaaattgaaatgtccactcatctgaaatttgcagagtcgctcgagatctccgcatcaatttgggaccccataataaggggaaagattaaaaaaagtgtgtgtgtgttggggggggggggg

SEQ ID NO: 12750 - DNA, 571 bp, Zea mays
  unsure at all n locations
  Clone ID: cC-zmpo14820012c09d1
ccaccaccgtctcgcctcgtctccgctctcttcctcggacaaagccggggccgttcggcgggaggcaggggacgcacgggcaggcagccatgaacggcatcaaccccaacggcgggttcctgtcgtacgggaacatggagagctacgctatgtgggtggcgaccggcgtggcgtcgggcttggtctcgtccctcgggcgctggtgctgcatgcacctcgacaccgcggaggacgactgcgactaggaggaggaggacctcgaggaggcccgccgctccttctgccgcccgatccctgagtactactacgaccggtccggctcctccgtcttcgtcgccaagatgtgacctgaccggaccgcgcctnccctccgcccaagaaatgcgtggtgatacgatccgtttcttgatctatgatgtgcccttgcttgattcgttattgggtctctagccaagaagatgaagaacaacaacaacaacatatatatatatatggtgctgcgtatgcccattgtaacagttgatgagatctgtgactccccgtgccgtgtcccgtgagttgctgatgattt

SEQ ID NO: 12751 - DNA, 613 bp, Zea mays
  Clone ID: cC-zmpo14820012c10d1
atcgattctgctaatttgtgacaggtcatgtaggaataggaggctaagagaatttctacaaccacaatgaagatggtaccaggacgatgaagtccggtcgaccgaattttgtagttccttgattgttgcttccttaggcgggttcaagatgcggggacacaaagttggtaagtggtggattcctgtcggggcaccgggtgcgggcgatgcctctgtggagcctgctgagatgaagggccttgtcaagggccttcgatacatctggacagatttttgagctttgacatgagcaagaagggcatgattcaattggatgagtttatatcactctgcatttttgttcagtcagctcgtaacctgttcaattcgttcgatacaagcaagcaaggaagagtgactttagattttaaccaattcgtgtactgcacggcaaactgcaggatataatgtggttgtacatggacgcccaaacaaaaaggttagcagtgtgaagtgggaaccgttcgccaatcaaacttcgttactgaaccggcagctgggtattacaattcactgttcgccatctaaggctcgatgtatcatcattttgcctgaatatattcttggtcaccta

SEQ ID NO: 12752 - DNA, 404 bp, Zea mays
  Clone ID: cC-zmpo14820012c11d1
tcgaagtacgacaggctcgacctcatccaggccaagggcggccagtattccgagtcgctcaccaggtacgccggcgcgctcaactgccgcgtcggcaggaagtgctagtgcgtgtgcagctctaggctgcagctttcattattggcgatcgatcgtaacaatgcaaggttgtgttgtatataactcttgtgtttggaatgccgcccgtaattaatggtcaactctaacactgcttgcctttgcctgccggccagcaaaaaaaaaaaaaaaagaaaaaatacaggtggtaagaaagaggaggacaatatatggggaagtgcactgtaggggggcataaaattccttggtgttatatgaataagacaagaaaaaaagggggggcctctctttaaaggccccaggtt

SEQ ID NO: 12753 - DNA, 567 bp, Zea mays
  Clone ID: cC-zmpo14820012c12d1
gtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcggagttgcaggaattggttgcggaacaacaggatcgcttaaagaagctgaagtcagagcatggaaagacccagcttggaaacataactgtggatatggtccttggtggaatgagagggatgactggaatgctttgggaaacatccctacttgatccagaggagggtattcgttttaggggcctctcaattccagaatgccaaatagtgctgccaacagcagttaaaggcggcgaacctttgcctgatggtctcctttggcttcttttgaccgggaaggtccaaccacagagcaagttgatggcac

SEQ ID NO: 12754 - DNA, 176 bp, Zea mays
  Clone ID: cC-zmpo14820012d01a1
accttcctggacgtcgaccctggctgcgacaggccggccatctggtcggcgtcgatggagctgatccgtatcaccgacgtgctgccgctggtgttctgcgggttgttgaactcggagcacgtcttcctgatctcgccgtccttccccgtgagaaccttgagggcgctgagcttctc

SEQ ID NO: 12755 - DNA, 461 bp, Zea mays
  Clone ID: cC-zmpo14820012d02a1
cctacaacacttgagtgacttggcttgaatttcatgctgtccccaactgtacattaatagggcaacacatgaactaccctgactgaccctgaccccattaattgctggtttaagttgttacaatccgacattcacaaagaggttgaaaatgcgattgcttcgtttccttcacctgctggctgcagcaggagggatgctgagccactgcagctgcagctgaatctccccgctctccacgttcctgagccggaggatcatgtcctgcgcgaacttgccgttcctccagcacacgtggctctcgtcggcgaggcagttcgtggcgctcggccgcaccgacaggatgatggcgccgttcctcaggctcgcctccgggctcgcgttcgccgcctccaccagcggcgccacgtcgatctccgcgtcccccatcgtgtcgtccctgctgaacgtgtccttgtcgaaca

SEQ ID NO: 12756 - DNA, 485 bp, Zea mays
  unsure at all n locations
  Clone ID: cC-zmpo14820012d03a1
gaagcacaaattagcatgttatagaatcatatatataggctgccctacacgcgtgcctctcaagtctcaacgagccgtttcatcccacggtctcaagacatgtgccacgccgcaagaggcaacaccgaaaagaaggacacgcgctaggtccgcatgaagtcggcatgcgtccagtctatcgactgacagacacacgcgaccagcatcaaattacatatgttttaggccggacgacgacgacgacgacgacgttaccgaacgtagtagggggtcgggaaaaagaaacaaacaaatcaatggacatgttcgtaagggatcatgttggagagcgtgcggcagatctcggacatctcgatgagcgacctgttgtggtcctccatggggttcttggagacggccttcctgaactcctcgtcgcagttctgcgtgtcctgcgccaccatgctcatcgtggcgcggatggtgacngcgtctcggaagccgat

SEQ ID NO: 12757 - DNA, 518 bp, Zea mays
  Clone ID: cC-zmpo14820012d04a1
gaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcgaacgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgcattcccttgcctgtgccatatcggtggacacaatgagcaggagaagcaggatgacggccggctggaacctgcgtgacgactccattacctttatcttggcaggaatatatatatgcacgcttcagggattcacgaactatttattcccaattatttcaaacggacgc

SEQ ID NO: 12758 - DNA, 311 bp, Zea mays
  Clone ID: cC-zmpo14820012d05a1
ataaacacaggggaaactccggtgacatttctatataaaaacacactggtgcatgcgtcttatgtatttggtgatgggagcaaaaggagaagaatacccatggaactgccaagttctatctttcctttttattctaacagaccataagagtcacggcgctaccactatctaccactctggagagctagcttggatcaatgaacagaacgataccatattctatacacggttgattgcatggggggccactctaacaccactcatgatattcgggcgccaggaggaagctgatggccaacacgcaaataatg

SEQ ID NO: 12759 - DNA, 455 bp, Zea mays
  Clone ID: cC-zmpo14820012d06a1
aggaaaacaaaacaagggccacataagggtacaaggtttacagtagcgagagcgctcttgtttttgccctaacctgacttgagggcgcacattgcctttacctagtaacacaatcatttgacaagatcgtccaaaatttgatttagtgaagctcctgttacaatgcgaagcaagggcaaacgaccagcgcaatggacaacttacttccttgggttcttgctcctgggggtattctcagggggtgatgcatccaccttgcgttttttggccagctggtttgctttttttgcagccacggggggtcgcttagctttgcgagcagttgctccagtttcatcagttttcctctgcttcccttggttgctgggttgctgggtcactttcaccttctttacaacaccaaatttggtcgacctcaggccttgataccacagcactgatgctttacgtttggg

SEQ ID NO: 12760 - DNA, 345 bp, Zea mays
  Clone ID: cC-zmpo14820012d07a1
ctgaagatgtagtcgtttctttattttcaccagagccacaattcccataacagcatcttgttttgttgttttatgagaaagagtaagcgtgtagttctcggagagcattggcattttgcacctgaaactaagtcaattgacccgccctgatacatttgcttgccaaaatgtggggacctatacacaaaacactgaaaactgggtacagttctcgcattctctgttttagttgagtttgcaggtagtagagacgacatgactcagtcaaccgcttgttctttgacaacgacggctgctgcagcaagtgggccattgttagcgtcaagcttcagggagacatccttg

SEQ ID NO: 12761 - DNA, 379 bp, Zea mays
  Clone ID: cC-zmpo14820012d07d1
cgcgttcgcaggatgtctccctgaagcttgacgctaacaatggcccacttgctgcattagccgtcgttgtcaaagaacaagcggttgactgagtcatgtcgtctctactacctgcaaactcaactaaaacatagaatgctagaacagtactctacttctcagtgttcagagcataggtagccacattttggtcagctaatgtctaacgccgggtcaatagacttagcttcaagtgcctaatgtccaatgctcttcgagaactacacgcttactctctctatataacaacaaaccaccatgctgttatgggacattgtgggtatactgaatatcatgaaacgaccccctcttcagaagaagaccctctggcctcgtatac

SEQ ID NO: 12762 - DNA, 382 bp, Zea mays
  Clone ID: cC-zmpo14820012d08a1
ggaccacaactgggtaagatgtcatttgagtttgcacattgatttacatttttttaactccggcaccatatcggaatgcatgagcgaaagaatgaatatgcatgcatgatgcatgttatcatctgcatggttgcttgtgggcatatgcaggttgaagaaaaggaggaaaaggggctacttaaaagttcttggatgcctggtacgtgacaccgaacttccagtcaggggggagaacgtgccatgaggtggccttgcggtggtcgctggtcatcacccggaacgtcagcgactcgcaggtgaggtcctccccggtctgccacacttgcccccagttgcgcttcatcttcgtccacttgacacgcttggttcccttcaccgacac

SEQ ID NO: 12763 - DNA, 513 bp, Zea mays
  Clone ID: cC-zmpo14820012d08d1
gcgcgaagcagggcggcatccggtacaccatcaccgggaacaagtacttcaacatggtgacgatcaccaatgtgggcggcgccggcgacatcgcggcggtgtcggtgaaggggagcaagcgtgtcaagtggacggagatgaaacgcaactgggggcaagtgtggcagaccggggaggacctcacctgcgagtcgctgacgttccgggtgatgaccagcgaccaccgcaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctcatgcattccgatatggtgccggagttaaaaaaatgtaaatcaatgtgcaaactcaaatgacatcttaaccagctgtgatcaaaaaaaaataagttattatatagctcacaaaaa

SEQ ID NO: 12764 - DNA, 471 bp, Zea mays
  Clone ID: cC-zmpo14820012d09a1
gagaggaattatataagaaccagttcattacttcattttataggaaaattacagaaacgggaaaaaaattccacattccaaaggccattggagcgttgcatgtccatgcaattcacgctacagcaaaatggtcgagtcaacctcaaaagcaaagcgaactaattaaggcgagtcaccaattgctagatatcttatggcgtggaggagaagagccaaagcaaatacgccgggaggaaggcctttgctttgttgttactattattggaagtcgaaactcgaaaccatcgtcgtcgacatgcattccagctggtacgtagtagttacatgccctgttcaagcaggtagtcgcccagcctttccaccaccatgttgcactgcccaagcgtcatcggctcgtcgtagatgccaaccacgagtgcctgccctgtcttcttcacggtgatgcctcctgatccctttttccacggatga

SEQ ID NO: 12765 - DNA, 591 bp, Zea mays
  Clone ID: cC-zmpo14820012d09d1
gccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccgcgagttcaataccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtggttggcatctacgacgagccgatgacgcctgggcagtgcaacatggtggtggaaaggctgggcgactacctgcttgaacagggcatgtaactactacgtaccagctggaatgcatgtcgacgacgatggtttcgagttttgacttccaataatagtaacaacatagcaaggcctttctgccgcgtattcgctttggctcttctcctc

SEQ ID NO: 12766 - DNA, 251 bp, Zea mays
  Clone ID: cC-zmpo14820012d10d1
ggggaggtgatcgatcgattgcactgtatgtggcatggcaatctgactggctcaactcaacagtcgtatcgtcgtagtggatcactcgtctcgtgcatgtcgtcacatcgatgcatgtattgcacgttgaaaattcgaatgctagaacacagattgaaaagagtggttggtgatcagtacgtgtataagtatatatatatgtataatgtatgtacgtgtaacaactagcactgatcgataaataaaagaaa

SEQ ID NO: 12767 - DNA, 323 bp, Zea mays
  Clone ID: cC-zmpo14820012d11d1
gccgatggacctagcggaccggcgggtgcacctggtccccagggcgtcgagggtctatcgggcaatgaggacgacgatgatgactccaccaactaaggccaagcacgtcggtccggttgcatttggaacaagacatggaaagaaaagtgagagcaatgtcgtttaaaaccaaaagtccataataatgtgtggtcatccgtgatatgttcttgctctccctctttttctttctgtttgatttcgatgtgttatcatgttcttagcctataattgtatcaattcttgatatcaaggactccaaaattatcgttttttgtgttttc

SEQ ID NO: 12768 - DNA, 490 bp, Zea mays
  Clone ID: cC-zmpo14820012d12d1
cgatcctctccgccgtcgcgatggcggccttctgccgccgccgtcgtcacacgccaccgcagagctagctaccgacgaagacaaggcgggcaatggccaaggcgcccctgccgcttccgtcgctgctcgtcctcgccgccttcttctttcaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgggaaactcgacggccgcgttcgccgcgccgcgcggctacgtgctggccacgcccgt

SEQ ID NO: 12769 - DNA, 468 bp, Zea mays
  Clone ID: cC-zmpo14820012e01a1
agtattaagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggtggcgctggttccggcggttgctcctcgtcagccacgtccggcagaacctcctgggacgggctcttcttgttcatgtggttgtagctccccttctccatgaacagctgcgcgaagtggatcttgcagta

SEQ ID NO: 12770 - DNA, 379 bp, Zea mays
  Clone ID: cC-zmpo14820012e02a1
ggggaatcacgtcaccattaccatttttagtttagtagtacagtatacaactcggttttgttagggggtagtatcccctccaccggataacccctaatggatctttttacaaattacaacacaccaccaacccgccagatttgatgacccccacgagatgatgacctttaatttttacaatacaaaaacgacgacgtacgtaggatctcggatcgacgaacccaatgaattaaaaccttggaaaggaaaagcgagcgaaagaggtgtttcatgcacgattattcccctccggccgaccttttacacacgtacgattggctgtgatgatcatccacgcatgcattgatctttcgccaactcatcaccgtctttttgatct

SEQ ID NO: 12771 - DNA, 469 bp, Zea mays
  Clone ID: cC-zmpo14820012e03a1
cagaacagtgtcatcaggcaagcagtacatatatgggtacaaagagttacagagagatgatctagctgccctggctcctgacagaagcactgtagtaagtacagttcttagtacatggatcgactgttgctggaccaaaattagtacagtaacgtttttagttgacagaagacaaataaaaacaagaattttttaagaggaaacaaaaaaaaatggaacaacacattgctcaaatcgataatggatggataagctggaccggccaatggacgtgccgcggcactgtcaagcaagaagctctagcgttgttgttattgttgtcatgtcttcctcctcgtcatggacgtggcgttgccgtcgaagagctcgtcgatgatggtctccacgtcctcagcgctgagcttgacgtacttctccgtctgcctcccggcgctgaagtgctgcgcgaagcggccgaagaaggagcggt

SEQ ID NO: 12772 - DNA, 440 bp, Zea mays
  Clone ID: cC-zmpo14820012e04a1
ggaccacaaatcaacattaacattatggaatgggattacagatatacactagcataatgaataagttccaagattgtgaggcgtcggtctaataataattacatcggttggttttgtgatgatccaaagaagaaagaaaatacaaaccagcggattatatattcgggggagacttgagagtacgtgagaaagagagaggttaccaagagggattatatatataatatatgcatgttagtcaattggttcaaatgcaggcgagctcctttgccaagccgatggacttgccgatggcgttcttgcagacggccatggtcttgttgccggatccattgtacttgatgtcgacgttgacgagctgcacgccctggcatggcaggttgttggcgcaattgaacgtgatggcctccggcgtgttggaggtgccgtggatgttcttg

SEQ ID NO: 12773 - DNA, 306 bp, Zea mays
  Clone ID: cC-zmpo14820012e05a1
accacaacaacttaagatgaaggttcaggcacaccacttgccgtgaaatttaaagacagcttacaaccccatgcaggacgggaagtttgccacaaagaaatcaaccatgcgcacaaagcattgcacggggtacacacatgaaatgacaacggttgttcacgattcaaacatagcacgcagcaggcaggggaggataactttggtgagcgcaccagcacgggcatcagttgccaccgaacaggtagcccagggaagagccaccgccaggagcagcgtggaccttggttgaaggacggtccctaagga

SEQ ID NO: 12774 - DNA, 370 bp, Zea mays
  Clone ID: cC-zmpo14820012e06a1
gtcaaattaacacaaatcaatggacgacatatatgacagatcaccgtggtcaaacaaattttgtcgagaatttaaatacgggtatatatatagagagaagctacgcacaacgacagcaatggcagtagtttttttcttttctttttggggtgtgtatgtgtaattgtgtatatatatactgtcgtagcgccaccgcctcctccaccgtccaacggcacgtacggccgcgacgacgacgtcaatgtatggtgtgcgatcggtggagccaggctgcgtgacctggcaggcaggcagaccagaccagaccagaccgaccggttcggcgacgacggcgcgccccggcagcagctagcgctgggctcagttcatg

SEQ ID NO: 12775 - DNA, 450 bp, Zea mays
  Clone ID: cC-zmpo14820012e06d1
gagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcgggccgcggtggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactaccgcaact

SEQ ID NO: 12776 - DNA, 555 bp, Zea mays
  Clone ID: cC-zmpo14820012e07a1
gcatagcaagtctaggcatagctatcaaatttctgcaaatagtacccattcttcacatgttctgttgaatacatgtattgtcttctaatgcggtcgcaatggtcccattagggcttggggtaaaaattcagcaaacacaacatatgcatactttggccatcagtccaaagcacacaggttaaatcgttccagactcgggagatttgacttacaaattttcaaaacatcaaacagtggtaccataatgctacagtagcacctcttattctactttttgcccatggacaactcagttttgtgggatacacaaggcaattacatggcactataagataaactggttcaggtataatctcttcacatgtttgtgtgaatcacaagcttaacacaatcagaagcacgtacttgaggttggtgcaagagaacctctagcaatttagcctgttgtcttcgttgaagagggtcccatgccttgccttcagtgttgctgcaatgcccattcttgtttggataaatagcagtatttgttgaagaatcatcagtaccctttgtact

SEQ ID NO: 12777 - DNA, 624 bp, Zea mays
  Clone ID: cC-zmpo14820012e07d1
acacttttatgtattaataaaagtcagggatggggtcatcccacaaatctttgtttgattcctcaaacccaatacatatatggtttcttcagaaaagtaattgccaacaatgaactgtttggatttactttggcctatgttcaaatgctgataattactagaaataatgtgttggtttttaattgtttgttttctgatgtcaggaaactcggtatcgtcagagatatcttgatctaatggtaaaccatgaagtgaggcatatcttcaagacacgatctaaagttgtctcgtttatacggaagtttcttgatgaccgtgaatttttggaggtggagactccgatgatgaacatgattgctggtggagcatctgcaaggacttttattacacatcacaatgaattaaatatgaggctttttatgcgcattgctcctgaattatatctgaaggaaatggctgttggtggattggaccgagcttatgaaattggtatacaattcaagaatgaatgaattgatttacacacattcctgattcacaactcgcgagttttatatggcttatgccgtttttaatgatttgatgagcctactgaaaccatgttgtcaggatggttaagagctg

SEQ ID NO: 12778 - DNA, 416 bp, Zea mays
  Clone ID: cC-zmpo14820012e08a1
ccagaggcaaacattattagcaagctgaatcaagctgtagagtagcctcacaaaaagctagggggagggaaatcagcatccgcaccagcgcaaagttagtagcttacatagcactgcacggttaaacaaaaaaatagtctgatctgtcttcagcacatcaccgcaacagggtgaagggttggaacatcttcagcggacttcacacggcggcggcgttgatgatgtcgatgaactcgggcttcaaagaagcaccgcccacaaggaaaccatcgacatcaggctgtgctgccagctctttgcagttcgcagcagttactgaacctccatagatgatccttgtagattcagagacctcagggctgacattgatctttacccaatccctcagggagggcgtgcacttcctgagcctgagc

SEQ ID NO: 12779 - DNA, 612 bp, Zea mays
  Clone ID: cC-zmpo14820012e08d1
cgcaccttctcttccttcctctgcaagaagccaaatacaatttagaagcgcccctcctcctctcccccatccgtacccaatctaatcgacacccggccgagatgggccgcaagttcttcgttggtggcaactggaaatgcaatggaaccgtagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgggtcattcttggacactttgaaaggagagctctgctgggagaatcaaatgagtttgttggagacaaagttgcttttgctctgtctcagggactaaaggccattgcatgtgttggtgagacccttgatgagagggaagctggttcaaccatggatgttgctgctgcacaaacaaaagcaattgctgagaagaatcaagactggagcaacgttgttcttgcctatgaccagtctgggctat

SEQ ID NO: 12780 - DNA, 516 bp, Zea mays
  Clone ID: cC-zmpo14820012e10d1
cgacccacgcgtacgcgatccattgaataattgtactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggaccgttcgatcgatcgctgccgtgtcgtttgccagacaccatgagcacccaaaaccatggcctgcaacctggctcagtgctccaccgccgccgcggcgaccgtcgcgccccgcacccctcgccctgctgcgtacgcgtccgtctccttctccgcgaggaagccggcgggcggcagcctgcggctgcagcggcaggcgtgctgcgagccgtcagtggcgccgtcgcgggcggtgatcgcctgccggaccgcggcgtccgggagcgcggacgacctggcctccaggggcaggaagtcgaacagcgtgcctgtgttcgtcatgatgccgctggacac

SEQ ID NO: 12781 - DNA, 456 bp, Zea mays
  Clone ID: cC-zmpo14820012e11d1
cggacgcgtgggccagggccgattctctgcgtgacttggggcgttgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtaccttcacggacaacaacaagaacaaggcaggtggcaagaagtaggaggcagtggcgcgccgccacctctgtacgattaatcgatgccttgagcttgtaacttgttcgcatccttgtaggtgcgatgcttggtgggtcataaactctgatgatatcgagatttggtgatgag

SEQ ID NO: 12782 - DNA, 577 bp, Zea mays
  Clone ID: cC-zmpo14820012e12d1
ggcgccacgacctctcctattgccgctgctggtcgccatgctagcggtggtcgccgatgtcgccaacgccggccacgccaagcccctgacgcctggcgggcgcgtggtacacgacaaccacggcaagttcacggccgggccgtggaaacctgcccacgcgaccttctacggcgggcgggacgggtccggcaccacggcgggcgcgtgcgggtacaaggacacgcgcgagcaggggtacggcgtgcagacggtggctgtgagcacggtgttgtttggcgatggcgcggcctgcggcgggtgctacgaggtgcggtgcgtggacagccccagcgggtgcaagcccgacgcggcggcgctggtggtgacggcgaccgacctgtgcccgcccaaggacaagtggtgcaagccgccgcaggagcacttcgacctcagcatgcccgcgttcctccagatcgcgcaggagaaggccggcatcgtgcccatctcctatcgcaaggtggcgtgcgcgaagcatggcggcatccggtacaccatcaccgggaacaagtactttaacatggtgacgatcaccaacgtg

SEQ ID NO: 12783 - DNA, 496 bp, Zea mays
  Clone ID: cC-zmpo14820012f01a1
aattagggctatattttagcggaccgtaggccatgcgtagatgggcttgtgcctgggccaagccggcccacatgttatgttaagaacggggaatgggtgacagcagcaagtgaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcatacggggagcggcacgtccttgaagtagcctaacgggttggcggggcgcatgctgtctgagatgccaacgttcctggtgagcaggacgccggcgcggtccctgagcgcctggacctcgttgcagtccttgcgcgggctggccaccagcaccacctggcagatgttcttctcgtggctgtccctgagctcgatcgtgta

SEQ ID NO: 12784 - DNA, 529 bp, Zea mays
  Clone ID: cC-zmpo14820012f02a1
ctcagcacaagaagcaataaaataggagctacaccaagttttacctaaaacagagatcagatgtggtctacagaaaaagagtaagttctctgaaaagcgtgcaagaactttgacgaatttttttctttattttcctgaatttttttgacaattttatcgaaaccaaacaggccgagggcgagtttgtctggcctcagaatggtgtcaacaagctcctgtaaaaatttcagattttttggacaaccgagcgaaaagttatgcccggtttaaggaaggtacctcaagttatgtttaaaacaaccgagatgagacaatcgctttgtttcctttcccccttttttgtttgttctctgggtctatcctttctctttatttttcttttttttctttttttggttctggtttctttacgcaaccgaaggagaaaaacaagaaagcgacgctgactcggtttgtggcgagatcaaacgggagatgttggcggcggctagggtttgaatggtgcagaaagaggatggtgaaaaaacac

SEQ ID NO: 12785 - DNA, 467 bp, Zea mays
  Clone ID: cC-zmpo14820012f03a1
gcatgtcagggcctcgttagttggaggcacgacggagccacgactcatacataatacagcgtgcagtcggcagcaggaagaatcttccctttcgcgctgcgttactttaaaaaaactcgtattcttttgtaatcagtcgtgcctccagatgcacgtcacaaggcataaattcaagcaaaagaagaaaaagaggaagattcgttggtaccgccggcggtttgaacaccctgctgacctggctctctttttccagccgcctctccttcctctcttctgaccggaggtgctggtcgtcttcaaccttcgatgcacatatgtggtgcagtgcagtgcagtgcagtgcatgctctttgtcacctcacctgcgcagtctacccttaaggcaacacgcactcaatctcctgcggtgctgcctccccatgtccaactctaacagtaacagaactaaggctcttgtatatactctt

SEQ ID NO: 12786 - DNA, 370 bp, Zea mays
  Clone ID: cC-zmpo14820012f04a1
agagaactaaggatagagaaaaaagataactggcaattacatagtaagagcattgctaaaacgagccaaacaagaaaaatgtggctctctaactatgagcagtttcatggcacattggatgcggcgcacgcgtgtggattgatattggtacaatgacatacaaatcagttacaggttatatgtctaacgaacaggtggatcgatcgatcaatcgatggatgaccctctggtatatactcctacacttcgacgtctgccttggaggggctgccggcggcggataaagagcccccatcgttcttggagccggcgggaggacttcttgttggcgccggcgcgccatttcttgagcgccttggaggtctgctcc

SEQ ID NO: 12787 - DNA, 276 bp, Zea mays
  Clone ID: cC-zmpo14820012f05a1
gtggtgtccttggccgtggggctaccgctcccctcggagcttacattgttgttgcggcggccgtacttcttgggaacacgtgagaggtcctggaatgtgcccgaggcgacattgacgggctactagttctgcttcttgcggctctctcgggtgcccttcttgctattttccttacggttcttctaggcctacccgcctgtggtatccatggatgaagtgccggagcccctatagcggtgccatctcgaccctcgggtggagggggaccgggtggag

SEQ ID NO: 12788 - DNA, 285 bp, Zea mays
  Clone ID: cC-zmpo14820012f06a1
aataggcacatcatgttcattgattaaggtgaggcaatagcagaatgctaaccatagtaacccaaaaggtaatcaaggacaaggtaaatacaaagctagtcaatccttaggttgatcatggtatgcgggttgatgaattataaagtaaatgggacataataggtaagaggacacttgccttcaccaaacaaatgctaagggtctttaatcttttaaaaactaaaaaaccgggacaatttgtccgccgaagctggaccttcaattccttaaagttttaaaacaaac

SEQ ID NO: 12789 - DNA, 492 bp, Zea mays
  Clone ID: cC-zmpo14820012f07a1
aatcacgaaaacaacccttattcatcgaatgctttcacagaagatttatccatacatgtatgctcattgtggtagacgcagctgaccacctagagctagctgtatacagattgactcagcatgtggcaacgtaggaacacatgtttatagacgacattcttcgtactaatagcctggcttggctgctaaccaaacgacaaccacgagatcgcaacgatataaaaagaaaaaaactcagaagcaaatcgacaccagaaacccgtcttactcatcaagcactccatccttctcctcgatagcatccaacttcctccaagcagacaagattagccagcttgcagtccttcgcaaaaggtgctgcattctcgccatcaaagcagcgaagaacggatttgggcgagctagcaacggcgtcttcagcagcacaaaagctctggtagatgaggatcccaccttcaggcagctcctgctcgaccatgttgttgcagtcat

SEQ ID NO: 12790 - DNA, 542 bp, Zea mays
  Clone ID: cC-zmpo14820012f07d1
atgagaagcgccttgagatcacattctctgaggcacctgtctttgtggacccccatggcagcggtttgtcgtgccctgctccaggatcccatgattgatctctgtgtctcggatctctgcatcggatgcatcgatcagtgttccgatcattttccaacaatggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcacaggcagccccccaccggagcttcttcgaggaagttgctgtacttaaccgatactttgggggcctgaagtctggtggcaatgcttatgtgattggagatgcagcaagacccgtacagatatggcacatctactacgccactgagtccccagagcaaccaatggtcaaccttgagatgtgcatgactggtctgga

SEQ ID NO: 12791 - DNA, 255 bp, Zea mays
  Clone ID: cC-zmpo14820012f08a1
ggaggttcacctatcgattcgtctcatgagggttaattgcacgcttggtatgttattaacactacctgtcacctggcataaattgttatatcataacacttccacactactttctagcaacaggcatacagggtaaatcctgcaatgcctactgagtgaactcactcacattaatcgagcgaggctaactgactggtttcgagtgacggaacctttgttgcccattccctcattcaatcgcccacccacccttaa

SEQ ID NO: 12792 - DNA, 128 bp, Zea mays
  Clone ID: cC-zmpo14820012f09a1
gtgcttggttttttttttttgaaacaaacaaagggggtttgattaatttccaattgtcatgtccaaacaaataggggctcccattttcccctttttccatttttaaattaacccaaaggggggaaatg

SEQ ID NO: 12793 - DNA, 182 bp, Zea mays
  Clone ID: cC-zmpo14820012f09d1
attcctgggcatttctcccctttctgttaatttcgatatgtaaagaggggagaatgggagacactattcgtttggacatgacaattggaaattaatcaatacccatttgttagttaaaaaaaaaaaaaaaaaaaaaaaaaaaaataaaaaaaaaaaaaagaaattgcgaaatatagtcaaaa

SEQ ID NO: 12794 - DNA, 443 bp, Zea mays
  Clone ID: cC-zmpo14820012f10d1
cgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgggtattgcgacacctgccgcgccgggttcgtgaccaatgtcaccgagtacatcgcgggcgccaaggtgaggctggagtgcaagcacttcggcaccggcaagctcgagcgctccatcgacggggtgaccgacgggaacggcacgtacacgatcgagctcaaggacagccacgaggaggacatttgccacgtgggcttggtggaaaagcccgcccaggactgcgacccggtgcaagcgga

SEQ ID NO: 12795 - DNA, 402 bp, Zea mays
  Clone ID: cC-zmpo14820012f11d1
acccacgcgtccgggtaaaagctcatagatggaccttgggccgggctggccggtccttttcacggtgagaaccgaccggctcgagcctggatgccggctgatgcagctctctggctcttaacatgtgcctggtgtcgtgctcttcggctgtccggtactagtgaagaatatttgagtgctcaaatgcaagccatcggtctggatacattagcatgggataacatcataggattccggtcctattgtgctggactacgggatcggagtaatgattaatagggacagtcgggggcattctgtattttatagtcatcaggtgaaatctctggatttattgaaagacgaacatctgctatagcatttgccacggatgttttcattattctcatttaaaacacaagg

SEQ ID NO: 12796 - DNA, 549 bp, Zea mays
  Clone ID: cC-zmpo14820012f12d1
accatccctgcaaattaccgcgatggctcccaaggtcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccggcatcctccccacgctgctctccgtcaccgacaagaaactcggcgtcctcaactacaccagggccgacgacgggcagatgtacttcggcgctcccggagccccctgcgtggccaagctcgtcaaggtcgtcgcagcgcggccgtactctgtgtccatcatggagatcagcgagcccatttttgccgccgcgttgccttcccccgtcgcggcgcccgg

SEQ ID NO: 12797 - DNA, 482 bp, Zea mays
  Clone ID: cC-zmpo14820012g01a1
ctcttcaaaaacccagggggtttccccaacctgtgtttttccgcttccctaaaaaaccggcccccccccctctcccttaattatgacccccggccccccaaactttaccaacccccccctgtttttcccccccccccccggattccagccacttttcccccccccccccccggcctaaaaaggttccctttcccccccccaaggggcctctgtccccgaaccccctatttccccccttcccctccccccccccggtgtggttcccccttatttcccccccccccccctgtggggacccccctctttcctttatgggggcctttcctatccgtgggcgcaacccaggccacccgcctcccccggggaaaatattttccccgtccacattccccccaccttcaaccccggatattttttatacaccccgggcgcccccaaggggccccccccccctttgtggtggcccccccccccccctcccc

SEQ ID NO: 12798 - DNA, 389 bp, Zea mays
  Clone ID: cC-zmpo14820012g02a1
ttttttttttttttttttttttttttttttttttttttttttttttttttttttttttttttttttttttttttttttttttttttttctcacaaaaggggggggttttttttcccggaaaaccagggcccaaaaacccaagaccggtcccaacacccaaacaagggttcgtccccccccgggttttcgggagcccttgcccccccttatgtggcttggtccccggccggggcttttttaaaggggttgcgatttgagcatttccctgcccatttcgctcggggggggtggttttatccccccctgaatgcccacccgctcccctttgaacccgtccttggggctggggtacacgattttgtttttccccccttgtttttccggggccc

SEQ ID NO: 12799 - DNA, 276 bp, Zea mays
  Clone ID: cC-zmpo14820012g03a1
aatgggggatttgaatactttattacattaacgatttattaccacattctcacgtagttttgcccgcagacaattattaagcaaaagcgatattctaaacttgagcatatgcctccacaggacttctcctgaccgaccggggacaccaataagggacctgggggcatctttagtaaactcgacacgacaactgggtaattagacaatttagtaatccgctggggggggtactttggtcggccctttttgcccaaacgaaagagacagtgagaaaaa

SEQ ID NO: 12800 - DNA, 439 bp, Zea mays
  Clone ID: cC-zmpo14820012g04a1
gaactcccgaaatattcacaaattcccccttcgcccatttccagcgttcatgacattactagtatgtacataacctcctccgccatcaaaccaatctgaaaaccaatgggaaggcgaccaatgctaatccacatcctctattctaatgttccacgggtcctccctctccggctcctgctgggcctccgcccgcccgcctccgaacacgaggtagctgacgacgaccgcggccctgggcctccgcctttcctcctcgccgccctccgccgacgccgggctgtcctcctcctcctccttggccggcgctggcagctcgcggcggcagacggggcagttgccgtgcacgccgagccaccgctccaggcagcgcccgtggaagcggtgcccgcacggcatctccttgccggtgccctccaccgcgtccaggcagatggcgcac

SEQ ID NO: 12801 - DNA, 355 bp, Zea mays
  Clone ID: cC-zmpo14820012g05a1
atgattccaaacaaacgagcggggttgaaattatattgtgtgcaaggcatgctaaccgaaccgtcttgtgtacgtacaaaacttttgagtacaaagaacgtgatatacacactaccggtagcgctcattgtgtactcaacccactaacccggcgccattattctacgggtatctgaagacatgtaaaacaattaccacctgcggtcgaataatctctcactccacgctgagtggaaacaatgggcgcgtttgctgaaatggcaacgatagccccatcggagacatgtgtcccatggcacgtttaaggttttttcgattgaccctttctcaggtttttttggggaagtttcaatgc

SEQ ID NO: 12802 - DNA, 381 bp, Zea mays
  Clone ID: cC-zmpo14820012g06a1
acatgaacaagataatgaaccttgagctcattagaagataattcatacatgaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcaagcgatcgagcgatcttgtttagcactgcctagtgcaaatgcagcggcggcggaaggtgctgcacctgccggccaagaagccctcaccgcggcacacattggcgcagttgtctgcgatcatgcatgccccaacaaa

SEQ ID NO: 12803 - DNA, 522 bp, Zea mays
  Clone ID: cC-zmpo14820012g06d1
gaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacatgccagggaatgcgaaaagtacagtgagcgatttgttggggcatgcatgatcgcagacaactgcgccaatgtgtgccgcggtgagggcttcttggccggcaggtgcagcaccttgcggcgtggctgcatctgcactaggcagtgctaaacaagatcgctcgatcgcttgccatgcatcgacaacctattcttaataacgggcattatctcgttcttatttatgacgaatgtcatgtatgttctggtgactgtcatgtatattctgatgactgtcatgtatcttgctcatgtatgctcaaggttcattatctagctcatgtattaaagatgttatgaataactcatttttattaatttgacatgtatgaatatcttc

SEQ ID NO: 12804 - DNA, 520 bp, Zea mays
  Clone ID: cC-zmpo14820012g08a1
gagccaggaaagagggccgtgtatttaaccgccaacactttacactccagtgtcgatatccatcaaacccaatgtttacaatttacagacaatcatgaccaggaaacagaaaagaattacacatattgagtcctggtgaaggacacccatattcagaggagaaccagtgcatatatatcggctcagcgataaaaagaagaagaaaaaaaacacgcaaaacaaaggaaaacacctgaatcaatcgtgaacagaacacaagctctcaatactcccggaacaaagtagggacagcgacaactgaaacgtgtggctgacccaaaacaaaccagtgtcgtgccaaggttttcagaaatggcttcattcttctgactgtgcattagtttcgtagatgcggcggctcttgttataccgaaagtatctcttgccatcgcagcttatgatgcgcacctcggggatctgctgcacgagatgccagttcttgccaccgtcgaggcagctcctgagcaatgacagaccacac

SEQ ID NO: 12805 - DNA, 540 bp, Zea mays
  Clone ID: cC-zmpo14820012g08d1
gataaaaggtcccaagctaggagactccttccccagccttgtgtttttggatcttgaaaactgcatgtcatgtactaaactgccttcacttggcctcctgagtcaactccagtccctgcaaatctcaaatgcagactcagtcatcaccatcggttcagaattccttgggaccactgtactttcatcagccactccattccccaagcttgaggttttaaagctcagaaacatgaagaaacttgaagagtggtctttaactgtggaggagagccaggtagtattaccttgtttgaagtcactgcagatacagtggtgtcctaaactgaaagctctaccagaaggcctgaagcatgtagcgccgtgtgaacttcatgtggagggtgcacatagcctaactgaaatcaaggacctgccaaaactatctgacgagctccatctcaaagataataaggtgctacagaggatcttcaacctgcccatgcttcgttccctcattatcgatgactgctcaaagttgaagcatgtggcacgtcttgatgc

SEQ ID NO: 12806 - DNA, 379 bp, Zea mays
  Clone ID: cC-zmpo14820012g09d1
gatagattttgctgtgacgtcatccacccaattcaagcctgagatggccaacatcatgaaggatttcgatgagcgggggcaccgtaccttgcctcgaccggcctgttcctgggagccaccaagtacactgtcatccaaggcaagcttggtgctgttattcgtggcaagaaggtatttaactgcccatcgaacgtcgcaacgcgactgctccatggtgtttgatccgattcattcccaactgttgctgcctttgttgttcccagggattcggtctgtgaggccaatagtatcctttatttatatttttcatgtgagatcctaaaaaaaaaaaatacaaaaaataatagaataaattcttttattaataaataatatcaat

SEQ ID NO: 12807 - DNA, 367 bp, Zea mays
  Clone ID: cC-zmpo14820012g10d1
cccacgcgtccgcccacgcgtccgcccacgcgtccgaaagctgttacaagaagccagaggactggatgatcttatgaggatattgaacgatgtaaatgggaacttagatgctaagaaagcttgcgctggagcattgaaacttcacataaaatacctgaaaaaggtacaagcaaagaaaccttaaacgtgccatggaacacacgtgtgggaagggggctatcgtgaccatgtgaacatacacgaccattttctacacacaactttgagtgaagatttatcggacacatgtggtaatcgtctgacatgttcttagatacaccgagacttatggtgccaggctagtgggggtgaagtccagattaacgca

SEQ ID NO: 12808 - DNA, 639 bp, Zea mays
  Clone ID: cC-zmpo14820012g11d1
caagaacatgcacgggctggcggtgctggccaccaggatggccatcgaccacgccgccagcaccgagtccaagatcgacgacctcgcggagctggaggcggcgtcgtcggatccgaaggcgcgcgcccgcttcaaccactgcctggagcagtacggcggcgccgccgacctcctccgcgacgcgctggacaacctcaaggcgaagatctacggcaaggccatggagcagctgaccgccgcaatgggcgcctccgagagctgcgaggacgcgtggaagggcgaggaggaggatgtccccgtcgccgcgcacgacagggagtacggtcggatggcgcacatcgccttcggattcacacaccacgccgccgtcggcgccgccgccgcatgaatcgattaattattatatatatatatgcatgctatctactatgatcgatcgcttctcgaccttcttgcatcgatctgcatgcatattaataattatattatattgatgccacgccgcatgcaggtctttccaaggcgtacgtactatatcatattaatttaatttccttacatgtatatgtatgtgctgctgtcggatacgtccgtatatatatatggtctagggttaaaaataaaataagggcggccgtt

SEQ ID NO: 12809 - DNA, 552 bp, Zea mays
  Clone ID: cC-zmpo14820012g12d1
gggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaataatggttgtgtatgcatgtatgtgccaatatgatgtgcctttgccctggt

SEQ ID NO: 12810 - DNA, 287 bp, Zea mays
  Clone ID: cC-zmpo14820012h01a1
gaccaaaaaaaatttatattattcattcataagacatcaataaccaatgacaatccgaagtagcctcatcaggcgtctcattagaattgaatggaccttaacatattgtgtccaaaaatcacaagtgagaagcataggtagcgacagttattgcggtcttgatgaataggggaggaaagcggcggccgatagaccggcacaaaactttgttcgcgctaatgaagaaacggcaacgaaaacgggggcaggagaggctggcggcggtaacggctcccccacggcttgca

SEQ ID NO: 12811 - DNA, 458 bp, Zea mays
  Clone ID: cC-zmpo14820012h02a1
gaatcaagcactctgttacatttttttatttccttttcttccttttctttcagtggatactgctatccatgccatgcgcgcgttcgctctgtatcatcgttatagttttgtgcagcctgtccgcgacgccgccgtggtacagtttactggtcgtcgtcgtcgtccgagtccagctgcttgagcagcgcggcgcagacggggagcggcacgtccttgaagtagccgagcgggttggcggggcgcaggctgtcggagatgccgacgttcctggtgccggtcgcgtcggtgaccccgtcgatggcgcgctcgagcttgccggtgccgaagtgcctgcactccagcctcaccttggcgcccgcgatgtactcggtgacgttggtcacgaacccggcgcggcaggtgtcgcagtacacgcggtccctgagcgcctggacctcgtcgcagtccttgcgcgggct

SEQ ID NO: 12812 - DNA, 75 bp, Zea mays
  Clone ID: cC-zmpo14820012h03a1
caccccggtttaggacaaacttttgaaaaaaaagggggggggaggaaaaaaaacatagagtttccccgggcccgg

SEQ ID NO: 12813 - DNA, 454 bp, Zea mays
  Clone ID: cC-zmpo14820012h04a1
gcatgaaagcaacacgtttaaataaatacggggtatatcgaaatcaaaaccatagtgacttgaaaattctggacccttgggcggtgaatccacctatcggatatccccatctgaggagcagttggttgaacaagatatattcatacatagcttattaatctggggcggaccgttcagcatctactacgcttagaaaacatcagggttgaaacgcccaggtatggagctgttctgttgagcctgcttgagatgcattgtgagggcgctgttgttcatctctagagtcctaacttgctcctggtactgcagaacaagttgcttcaagttctggacctcgtgagacctctcgtcgaactccttttggcgctcgtgctgaatggcgactgcccgcttagcacggagttctctcgcagaacaacagacaactggtccttgagcatcatgttttccttat

SEQ ID NO: 12814 - DNA, 351 bp, Zea mays
  Clone ID: cC-zmpo14820012h05a1
caaaaaaaaaaaggcccccaaaaagggggtgttttttaaacctttgggttgtttccccctttttggaattcgaccttgacccccaacaaaggggttccctttcctaaaattgggaagcctcagttttttttaggggtgggggggcctgcggccaactaaattagctggggggggaggggccataccccgttgggccggttgaatcgaggggaattcaaagctttttaaaattggccgttggaagggtaaacggctttgggtttccatttcgccgggatgacctttttggggaagacctttttgccgaactttcttttaaggcgtatggaaaaggggccctttacccccttg

SEQ ID NO: 12815 - DNA, 347 bp, Zea mays
  Clone ID: cC-zmpo14820012h06a1
ggcaaaacaaaaaagccaaaccaggggggcccccgattccaaaatcagttaatttaagggccaaaaaatgggggcgggcccccagggggggggggggaaatttttaggggggaaaaaggcccccccccgggggcgggactttttgggccctgcccggccctggtggaacacaaacccaacgggaaccggcggggactcaacaaagggcccccaaaattgggtaaccccgcccccctcccggtaacaactggcccgggccccccttggggggggggcccccttggttctccccccctggccccccaaggggcccccccccccccccagggccccccgggggatggggg

SEQ ID NO: 12816 - DNA, 423 bp, Zea mays
  Clone ID: cC-zmpo14820012h06d1
acggttccatcctaccgagacggcggggacggcggatgggccagatctacagtgcagcgttgccctctgtagacgcgggcagcttcgtccctctccgttcattgacgccgccatcgccttgcgttgcctcgtgcgtcgtcgtcgctactttctggggccatgtggtgctgactcattggtccctgcctccaagcgggtccacgcgcagcatgctacacggagaggcgcaggactacgcgatgctgcggagccatcgtcgagtcgccagcagtgtgcggtgcgactgtgctggggcagcgacaggcatggccgacatagcgccgtcctctgggggtgtactttcttcccggtaaatattcgcttcccctctgcttggagcccgcgcgcattatttagtccttatatctactgattctcgaatct

SEQ ID NO: 12817 - DNA, 340 bp, Zea mays
  Clone ID: cC-zmpo14820012h07a1
ggggggaaaatcccgggctttccccacaccggttattttctggccaaattaaccccctggggggaacccccaagggggggtccccctacaggtcccgggggggcccttcttttttaacccccccccttttaaaaacaaaaggggggggggctttttcaaccctttttttaaaggccccctcggtccaaaaggcgggaaaagggggggggggaccccaagggccaaaaaaggaaaattttgggctggggggggacccccccaaaaaaaaaaaagggggggttttttcggcacgggggccctctttaaaaaaaaggggttgggggccacccaggggagcccc

SEQ ID NO: 12818 - DNA, 441 bp, Zea mays
  Clone ID: cC-zmpo14820012h07d1
acgcgttcgctctgccagggacagcaataccactacccagcatgaagacgtgctgtttgaagagcatgagcatacaacagctgatgggtcaccttccaacggtgacaagttgagcggcgtatcgaatctcaaggctgggatttccttgcttcaatattaaaactgatggcacttgaagatgaccaggagtttctcaagcatgtgtcgaactttctccaaagccgtattgatggactgcagtgtatacagtatataagcggccatctatcagagtggcggggaggtgtgacgtccggaggaataggatggggagcgccattggaaggggttgggtcatcatgaggtgttctgatgcagcagactaacgagggtgcttccactgagtgcccacaataccatctatctgaagatggatgccgttgcaggaaatacccatgctct

SEQ ID NO: 12819 - DNA, 484 bp, Zea mays
  unsure at all n locations
  Clone ID: cC-zmpo14820012h08a1
aaaccaagttagttaaattttgcaatattggcttcgaaatggcactgcctacacggagtgactgtgacaccgtactcaccgagcagctgtactcaccgagcactgtctagagtagtttacatggagtaagagaacactggcaccggcggtgcaaaaaacggcacacgggtacatgcagaggccgccggtcgatgatgcaagacaaacagctagcactgctctgtcggttccggggcatgcatggcgatcgcgcgagcggatgcgcgtcttcctcttcagagagctcgcgccctgacaatgtccatgctcatctcgctggggtcggtggcctgcagctccagctggatgccctccagctccctcttgaaccggtccttggagctcgcgtacagcatcttgctcctgaccctcgaggtgtccggngaccaggagatgaacaagatcttgctcttcttgcagttctcgtcggtggtgaagtcgaaat

SEQ ID NO: 12820 - DNA, 587 bp, Zea mays
  Clone ID: cC-zmpo14820012h08d1
acggccatcgcgcaccgcctccccgtgtcccctccttctcgcccggtaccgtctagctcggctgtggaaacagaacaaacccatgaaccatggcgaactcggcgtctgtgatggccgtgagcgacgagtgcaagctcaagttccaggagctcaagtcgaagcgaagctttcggttcatcacgttcaagatcaacgagcagacgcagcaggtggtggtggacaggctggggcagccgggcgacacctacgacgacttcaccggctccatgcccgagagcgagtgccgctacgccgtcttcgatttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccaccgaccccagcgagatgagcatggacattgtcaagttgcgagctctttgaagaggaagacgcgcatccgttcgcgcgatcgtcatgcatgccccggaaccgacagagcagtgctagctgtttgtcttg

SEQ ID NO: 12821 - DNA, 604 bp, Zea mays
  Clone ID: cC-zmpo14820012h09d1
acgtgtcttctcccgtccgcagtccgcttggcgtgcgcgacggctatttcgaccgccgccgccctacgccctacgtccagctgcccatgtcttcttcgggccccttgccggcgggaactcaccagaccaggaatcgtgctggcaaccggcgcaagtctggagatagggctgataaagctaattactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacactgaccaaacaattgacccctcagagaaaccggtaatgtattctggatctagcagctcatcatggggtcacctgaagcttcctcatcagatgaacttcctcgaggagccgcgccgtgcagtggacgctcatacagaatttgcgtcctctgtcgtcacctgcaactaatcgaagtcggcacctgcatcattatgcggtatgactaatctatggaatgcaggctg

SEQ ID NO: 12822 - DNA, 440 bp, Zea mays
  Clone ID: cC-zmpo14820012h10d1
gccaacggcgcctccaaggtcaccgtcaaggatgtcaccttcaataacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagatgctatccattggtaacgcacaacagttaaacgacagacatccgacagctatattatgttcgacggtgtaacaccctgaatttgagggtataaaatttaattctccaattccaacccaattcaaggggtaaccttttggc

SEQ ID NO: 12823 - DNA, 188 bp, Zea mays
  Clone ID: cC-zmpo14820012h11d1
ctatgcttgaggtcactgccattttcttgatcgattattttcgcttaactatttatgcagctcaaaaattatactactatatatagctacggaaagcaacaaatcaaaccatatactggagtttgtttatgtatcatcgagcagaaatatattcttgttattcgtagcattatatttgtatttttatt
